United States Patent 10,407,724 (METHODS AND COMPOSITIONS FOR SCREENING AND TREATING DEVELOPMENTAL DISORDERS) - sequence listing, part 7

SEQ ID NO: 125 - DNA, 442548 bp, Homo sapiens
ggaaaatgaatgaatgaagccctcgttcaggccacaactttaataatattaaagaggagatattttcttttggtattctagctaaagacttttgggatgagatggatagggatattaacaaatgtgtgtgtttttaaaaaatatacatattatgaaataaaacatctggaagacctccataactcaatgaaccaatattctacaaatgacccatgtgtgaagtggcagaatcatgaatggataaaaggtttgtctgaagcttaagataaacctgtgggttttaaatgtgtagactttaaaaattcagtgataggatttcagattccacactaccttatctttgagaagctattgatgatcaagttttgtcatcaaaggagaacattcacagttatttgaaaagattactaaaatactttttctaactatgtatctttgtgaggctagattttcttcatctactttaacctgaacaacataaggaatgctgatctgagaaactggttgtctcctcataagtcagatattaacaagatttgtaaacatgtaaaacagtacactcttcccctatgaaaatttttctgtttgaaaaaatatatcccatttttcataaaattatgttatttatgtaaaatgtagtggatttatctttaaaattattaaatagtcaaaaacttcattttaattttagaaaatatagaaatattaattttaatttattacagcgttaaatttaatgcaatataatttaattacagaacatgtagacatttacaatgcacaaaaacaaaagttcctctaggcccttaatcattgttaagagggcaaaagaggcagggcgcgacggctcatgcctgtaatcccagcactttgtgaggccgaggcgggcggatcacctgaagtcaggagttcgagaccagcctggccaacatggtgaaaacccgtctctactaaaaatacaaaaattagccgtgtgtggtggcacgtgcctgtagtcccagctactcgggaggctgagataggaaaattgcttgaacccgggaggtggaggctgcagtgagctgagatcacgccactacactccagcctgggcaagacagagagagactctgtctcaaaacaaaacaaaaaaagaaggcaaaggaatcctgtgaccaacatgtttcacaatttctgcttgatgttataaatgatggcactttcccccggaaatctctgcagttttatcagtctccctccctgtctgaccacctcaatccttttctatctctgctgactcaaaatggttgaagcaataaagacagcatctgtaacaagatgtacttagattcaggacctctgggctgggtcagtttgagggcttaacaatgtcctccagtagccaggttctctgtgtcttgcagtcctgtgtttcataagtcatcggcccatttcactcatggcagaagatggctgctgtacctccagccatcacagcctcatctactaatatctggaggcccaattaggatcatttcctcccagattttctcttttaagagcaaagacattctttcagggatcaagcccaattcctcatccctgatttacacacagcccctaactaaaagtaatcaggtgtaggccaggcatggcagctcacacttgtaattccaacactttgagaggctgagtcaggaggatcacctaaggtcaggagttcaagaccaacctggccaacatggtgaaacctcgtctctactaaaaatacaaaattagccaggcatggtggtgggcgcctgtaatcccagctacttgggaggctgaggcaggagaatcgcttgaacctgggaggtggaggttgcagtgagccaagatcgtgccatttcactccagcctgggcaacagagtgagactccctctcaaaaaaaaaaaaaaaaaaaaaaagcctgagaaagcatgaaggaaccctgggaaaaaatacaggctccaccaacaataaggaaaaatgatggttgactgggtagccagtagcatgtgctgcaaatcatttgcttattttgtgtcaagttgtttgccaatgtagctctttatatattatatattattatgttactctttaccaaaatataaaatattgagatgtaattgtagttgtgacccacacacatacatgtaaatgcatgtattgcaaatgtgttctctcattctgtatttgtcttcaattcttagaacctttgtcacaatcatgtcgtgcaatcaagtagcttggcacaaacatctgttctgtgccttctgagtttgattttttgttgttgttgtttgagacagagtcttgctctgtcacccaggctggagtgccgatcatggctcactgcagccttgaactcgcaggctcaagcaatcctcccaccttagcctcctgagtagctgggactacaggcgtgtgccaacactctcagctaatttttttatttttattttttgtaaagatgaggggaatctcactatattggccaggccggtcttgaattcctgagctgaggcgatcctcccactttagcctcctgagtagctgggacaacaggcgtgtgccaacactctcggctaattttttaaaaattttttgtaaagtcagagggatctcactatattggccaggctgttcttgaactcctgagctcacgtgatcctcctgcctttacctcccaaagtgctgggatggcaggcatgagccaccatgcccagctgcctgccgggtttcaatccttcctttcccagcacacatgtaattttaaaaaggtcttgtaactaactctccaataaagttgtcccaggcatataaatgtcttgacgttttcttcaaatgcctccctaggaaaattggcacacacctattcccggcaacagggaggagagaaaggtttactctgaatgcacccatgacaaagcttacctgctgccaagctctccatggcttcctggagaccaacacacacaggaacagaagcccggcaacccccgggggaagatgcctcctccgggtttaaaaacagagctacccttttgcccggggatcatgagggttgccttgtgacttagtgccttatactctgctttcggagcaccaattctcagtggaacgggagaaacaggcgggtgaggaggggtggggtgatttatggggcagagaatggtgcaacacctacccttgtttgtgttgggagaccgaggcctcctccatgccctaaacatgctgtttaaacatccctgcaatttcgccaacgtctctttctctctggctgcctcaacccttttctatctctgccaaatccatgctccactgtctccggccctcctggctccagctacccctccccaacaccctcaaatctcagaaatgcaagcagtgcctctcaagcctgcgcattaggaactcctggaggcctggttcacatagcggggttggaggaagccccgagacgcagggttctgatttcagagttcggatgcctaagaatgtgcatgacacagtttcccaggtgacgctgatgctgccggactaggactgagcctgcacatctcaccctgaattcaaaatcaaaagatggggtgagggttctcggcaaaacgcagcctgagattctattttggagacccctgttccagagagaagagcagtgctcctgacacttggtgggtggggcccagggacgctgctcaacaccctgcagtgcacaggacgccccccacagtcattcaacttaaatgttattagtgataaagttgagaaagactctatctattgtctatctatgtatccatctatccacccattcatctatcatcatttatctattacctatgtatcatttatctattatgtctatacatctagccatccatcatccatcatcattatttattatctatcatttatctaatatctgtcttcctgtctatcttcatcatcatcatcatcatcatcatcaatctcttatctatttatcatctatctccatatatgtatgtatctatgtatctctatatctatgtatcatctatttatcacctatctatctctctatcctatctatcatctatctgtccattcatcctatctcatctatcatctacctatgtatcatctatcatgcatctactgatctatttatctatccattatctatctatttatttatcatctatctaaacagtggcttacagcctaagaatgattctgcccctgctcctaccaggggacactgtgcaatgtttgaggtcagttttaattgtcactactggaaagtgtgccaatggcacccggcagatggagcccagggatactgctcaacaccctacagtgcacaggatgggcccacctcagagaatccagccctgaatgccacaaacgccttggtgaaaaactccagtagtaacttccatctaaccttgggaaagggatcaggttgacagtcacatcattctgaacagtccaggaggcaggagctgtctgagtcttttgtaaatgcccctcttgttagaacactcataagaccctttcccgtaggaggatcctcccttacccagagcaagagcacagcactccacggtttccctgctggagcaatgagaagccaacacaggccccatggaacgagttggcagcacaaggctgtgcagacatctggcgactattggagccaacaaggagaaagcatagaagctgggagagtctccccttccttgcacaagaactgagacttccttggaggggccagcttcatcctggcatttctcttctttggggctggcatccagaggatagaaaactgaggtcgtactggcaaagggggctccgccggggcacttcttggctcctaaggatttccccaatgcctcaggggctggacggatttgaaagtggaccccctatggaaaatgatacagagatttctcaaagaactaaaattttatctaccagttgatctaacaattccactacaaggtattcacccaaaggaaaacaagtcattatatcaaaaacacacctgcactcatatgtttattacagcaccattcacaatagcaaagatacggagtcaacccaggtgctcatcgacaggtgattggatacagaaaatgtgatttatgtgtacaatggaatcatattcagccatgcaaaagaatgaaattctatcttttgcagcaacatggatgaaactggaggccattatcttaagtcaaataactgagaaaaagaacgtcaattaccacgtgttctcactcataagtgggagctaaataatatgtccacatggacatagagagtggattaatagacactggagatacaaaagggtgagagagtgggaggatggtggagaatgagaaattacttaataggtaccatgtacactattcaggtgatgcttaccctggaaacccagacttcaccacaactcagtatatctatgtaacaaaattgcactttaccccataaatttacacaaataaaataaaataaatcagtaaaattggatatgtcaacctgtttaaaacaaacgaatgcagaaaaaaaacatgttgtaataacatataaaaataaataaagatggcttcttgatgtttaatatgccctgcagatatcttacaaagccccagtagtcacgagttaaattcttgcctgtagcctgctggaggtcagagatagcctccactgtttatgtacagctctggccccatctatgaagtagagctaaaaacaccaccgatacctgtccccaaggctgagctgatgcaggaacagccctcagcacagtgcctggtatccacagaccatcgatcatcctaggtattcatctagatcaggaaggcctgactgtagcttgcgttgattgccattgacagtttcggcaagaatctgggttcctttgctgtctctttcggatggacacgtgaaggctcttctccaagtaagttcactcattcgactcatgcactcatacatgcatgcactcacaccatcatcactcattcaactcatacatgcatgccctcacacagtcatcactcattcaactcatacatgcatgccctcacacagtcatcactcattcaactcatacatgcatgccctcacacagtcatcactcattcaactcatacatgcatgcactcacacagtcatcactcattcaactcatacatgcatgcactcacagtcatcactcattcaactcatgaactcatacatgcttgcattcacacattcattgattcattcacttaattcactcatgcatgcatgcatgcattcacactttcacttattcattcatgcatccattaacttgtccatgcattcaattcattcattcactcatacataatacattaattcctgaagtgtatgcagtcttcactcattcactcgtgtgtgtgcattaacacacatgctagtttgttcagctcattcctgtactcatacatatttattcactcagtcattcggccacgtattcacttgtcatgtattctcttcattcactcacacacacatccattcctgtataaatgcatgccttcacgtgctcaatcaatcctgcatgcatgaattcactcactcatgcaggcatgaactcacttgttcactcactcattcatgcactcactcatgcttgtacgaattcgcttatttactcattcatacactcatgcaggcatgaactcacttgttcactcattcgtgcactcatgcatgcatgaattcacttgtttactcactcatacatgcacttatacatgcatgaattcacttcttaagtcattcatgcactcaatcacgtatgaattcgcttgttcactcattcatgcactcactcatgcaggcatgaattcgcttgtttattcactcatgcagtcactcatgcatgcataagttcacttgttcacttattcatgcactcactcatgtatgcatgaattcacctttcacccattcatgcactatgcatgcatgaattcacttgttcactcaatcattcatgcattcaactcattcattcactcattcatagattcatgccttcacgcatgcatgcatgcattcacctatattttccacacagtcacacctccattcacgcatctatctctaaattcattcatacatgcattggctcgttcatgccttcaactcatgcattcatgtgtgaatgcattcattccctccttggcgcaaacattgattcaatggttcattcatttcctggcctgctcattcatgagtagttgtttgttcattcacgcctcacatgcattcacgcatacatgcactcacgcatacatgcactcaccgcgtgcgtacagccactcgctcgctatgcattcaacagctgaagcctgaaaccctcatttattctttctttcgtgcactcattcattcattcagtttatgcgtgtaagtacgcgcacgtgcatttttcatgcattcgacaagatcgcgtataagccctgccttctccctctgggaggcttccagagcggcctccactcttgctgcgcgctggccttgggcccagggccttaagtcatcgcaaacgtttactttggggctggctgattaaaggttaaatgtccaaacctagaaaccgccgactgccgaaggggccgcggcgggcgaggggcggggcgcgggcgtggatcgcagcccccggcggttcccgggtctctcttcccggcagccggggctgggcaccaggcggcgcgcgggcttgcgggcaggggctgcagggaggaggagaggacccgcgcccgcgggggctggcggaggcggggccgggcttccggacagaggccaatcgctgccctcggggcctccagcgccggctctgggccgaggcagccagagcgcggaagaggtgcggggggctgtagggggctgcaggggaccgtgggcagtggaggaggcctgggcgcggcggggggccggggggcgcagaggctgcccgaacgcctaggaggtctcgagggtgggtggcgtacagcggggcgggggcgcaacccagaggccgaggctgggggctgggggaggggcgccggactggagtgcaaaggaggggcgaggggcgcagggggctggaggtcagaggttgcccaagcgcgaaggaggggaggggtgcggggcgcgggagtaggccaggagcgcttaggggtgagtgcgccgagccagggcaccgagtgctggggaatacaggccgtccaggcgcggcggggcgcggggagacggaggctgccggagtacggaggacagacggggcgcgggcgtagggctgggaggcttggggaggggggcgcgggcccaaggcagaggctgcgggagcgcggggcaagggagaggtgcagagcgtggagggggctcgggggcgcttggggaggatgggcggcaggccgggtcggggaggaggggcggcgagaggcgcaggggtaggccggggggctgcactggagtgacgagggagggggcacctggccggggggcgcgggcagaggcagcccaagctcggaggaggtgcagatactggcgtccgggagcgcaggggtggtccagggagtggagaggggtgaccggggggcgccagctggggtggaggaagaggatgcccagaactccaagcaggtgcgcggggcggcggggcagctgctgacaccgctgaggtcgggtggtgtcccgggggcgttgtcgttgctgggcgcatgggtgttaagacgcagcggggtcgcaggtgactgtggggaggacagggggtcaaggggcccctggccagagggcacgaggctgacctggagcgccaaggaggaagtgcggggcgtggaggtcgcaggggcatcgggggaggcaggggccccgtggggcgcaggtgacatggagtgggtaggaggccgggggtgacactggcggggcctgcagccgagggtgtcgagactgccacgctgtcgcccccaggcctggaaatccacgcggattcccggagacggcgcctctgctctgcgggttcgtggcgaggaagtccacccactgctcccgggcgcaggtctgcaggtccgcgcccactgcccgcggcgccactgaccatgtcgggtgagtagctcaagctgcttcagttcagcctgcctgttcctactggcttgggtgacagattggtctgcactggggagaaccccactttgaccgcaggattgccccaaaccccgagtctcccccttactgcctcgcccaggtctctctggggctggagggaatggagataccagcctcagctgctgggagggggtgatttacagcaagtgaagggggccttgggatttcaccagtttccttttgtaaaatatagtcctgaaactttcaatgggcttgtttcttgggaatagcattgaactgcctgagactgtcactgcctggaaggccgatgggaagaagtctgttctcctgaaatggccctaaagctctgggaagaggctgccttgagttcttagaactcagaccacggttttaatttctgtttccagtacagatacagggatggcccggcttggtggctcaggcctgtaatcccagcactttgggaagctgaggcgggaggattgcttgaggccaggagtttgagaccatcctgggcaacatagggagaccacatctctaggaaaaaaatttaaaaatcagctgggcattgcggcacctgcctgtagtcccagctactagggaagctgaggtgggagggtcctgagcccaggagttccaggctgcagtgagctatgagtgcaccactgcactccagcttgggtgacagagtgagaccctgtctctaaaaaacaacaacaaaataagaatccaggttaatcctcctgcaggcagagggctggctggcaagaatggcaggaaaggcctgcccccgccaaggaccggtgagccccatctccctgcccttgggttttgtggacatcagatagactggttgacttaagaggcctagatatgtgaacagagtgtaacctcttcccataagaaagatgctggttctattttctatcattaaatcattaagacacctccttcttgtaccagaccacactggatcattctatgagtgcattttatgtatttatttttaaatgtatattttttaaattttgtagagacagggtcttgctatgttgcccaggctggtcttgaacttctaggctcaagcagtcctcctcctttggcctctcaaagtgctgggattacaggcacgagccaccacgcctggccatgagtgcaatttaaaacacacaaacagaacagatgacttttttattcagaggagagatttggtaaatcacagagctgcttctctcctgtttgttcccactctggacttagagatgaaaattgtcggggcagggatcttaagggctgttttcatgaggtgtactggaagagtctgttccaaggaatggcagaaaagattctctgttctagggacgcgtttggagctctctaaagtgaaagccacacatttccccaagcctgctagggtctgtataatagcagcattcaagacggacattcgcatacatcttggtcagcctcgtgccagaagagaagactcaactctttgcagaaaacaaaaaccacctttgagtagaaaagggctgagaaggaagctgctaaggttattttggggggtgatcagaagattccttgagtgcaggggggcaggcaaggggtagaaagaaactgttgtcacagattcataaaattctcagccactgtaatctccagactggacttgattttgtgacaatgtctcctttttgtgggctgtggtgcagtgacaggttttcttgctgtttttccactccatgccgttgctgaaagtgtccgccgcagtggcacttggagtggaaactccctctttgaatgcagtagcattggataattgtggatgttctctggcgtctggcgccgcaccaggacttgatcaccagttgtttcttcaaggcaaggcgatgtggaagctaagccctgtcaatcaatgtttcatcttctgttctatttcaatctgctggtctgtctttgcactttagatgggttttacagtgtcctggatgggaagcggctaaccttcaggaggtgcacatttttgttccaaagcaaaagtctgagtctcggatcccttgttgctggagagagctcgtgtgccaactggtgttgtcttgtcattgtgtgactgtggtcaatattccctccactctaaaccaaagagagaaacagggtatccagtagttccataaaactctcactctaaatgcagccctgtctgcattctcttttgtgtttgagatcaaggtgggtgtgggcagggctggttcctcctgaggcctctctcctgggcttggtcctcacagggtcttccctttgtgtgtgtctgtgtcctaatcgcctctttttttttgagatggaattttgctcttgtcgcccaggctggagtgcgatggtgcaatatcggctcactgcagcttccgcctcttgggttcaagcgattctcctgcctcagcctcctgagtagctgggattacaggtgcccgcccccatgcccggctcacttttgtatttttagtacagatggggtttctccatgttggtcaggctggttttgaactcctgacctcaggtgatccacctgccttggcctcccaaagtgttgggattacaggcgtgagccaccacgcttggcctaatctcctttcttataaggacaccaatcctattggatcagagcccaccctagtgacttaattttatcttaatctcttctttaaagaccccatctccaaatacagtcacattctgaggtcctgcaggttatgatattcatatatgaattttggaggtgcacaagtcagcccataataggataactcatttatttgaatactactgtgtttttctgctggggctgccataacaaagtcccacagactgggcggcttaaacaacacacatttactctcccacagtcttggaggctggaaatctgagatcagggtgtgggcagggctgtttcctcctgacgcctctctccttggcttgtagatgttgtctttctctgtatctccacaaggtcatccttctgtgtgtgtgtgtgtctgtgtcctcatctcctcttgtagtgaggccagcagtgctactgtattagggcccaccctagtgacctcattttaccataatcacctctttaaagaccccatcttcaaatgcagacacattcagaggttctgtggggtagggtttcatcctaggcgtttcaggatgggttatcatccgtctataacacccattaatcctcatgttttccctgaggtccccatgaagagctataaagccagcgcatgtggttatcaatcaatgatcactctgccatttctcttagttgtcactgagatcctcatgaagagattaaaaaaaccagcgcacatcgttatcaatcattgatcactttgccagttcgcatagttgtcactcacgtcctgatgaagagataaaaagcccatgcgcatggttatcaatcattgatcactctgtcatttctttcagttgtcactgagatcctcatgaaggggtaaaaaaccagagcctgtggttatcagtcactgattgctttgccatttctcttagttgtcactgatgccctcatgaagaactataaaaccagcacaggtggcgatcaatcactgatcactttgccattcctgtgtgttgtcctctgcaccttgctttgggccaattcacttgcatcatccttttctctagacagccagagggccctccctggcaatggagatgagaccttcttacaggttttggaaccctcaaatagctcctcataagcctcaggataatagaaaaggctgcatatcacctttgtaatccgggccctctgaccccatctcttcctgtgggtccttgttctccagctgctgttgctacgctgtgaggaatgcaggatgcagcatgcaacctatcatctccacctctggccttggctggtggattttttctgcctcttccttctttgccttattatttttggttcagtttcttattggaggcaggagacagtagctattttgagggcttttgttggtgttggagtcagaggtgacctcggacatttaattactcgttgaagccccggtttacttgtttttgaagcacatgtctgtgttggaaagggaattaatgagagcgcagaggtatgccctatctacacactcctggagggatgggagccatattcattcttgtttgttgctccactgatttcttgatggataagttcttcctggccatttatccctgagcttggatggtgccctttcaaaaactgctgccagccataggacttgccttgcagtatcgaaacacccatttcttagggctaatgtttctcatggagctgtgggtgtctgaggacagagcttgtaccttgtcagctgctgggcccagcacctagcagattctcgtgcctgggaattgcctgggacgtgaacccacagtgaacgtgtaatgcactgagagcacgtcattaggcccacacagacatcttctgccccttcaccttctttgtcttctgcctccagcttcaatccttcactctttctctaagcagatgcccttatgtgtgcagcttatggcatagcactgtggactgggataagcagtgtcccccataaaactcatgtccccccagaagctgtgaatgggacctgtgaacccaaaagtatctgagacaggtctcaatccatttagaaagtttattttgccaaggttaaggacatgcccgtgacacagcttcaggaggtcccgacaacatgggccaaaggtggtcggggtacagcttgcttttacacatttcagagacatgagacatcagtcaatacatgtaagatacacattgctttgatctgaaagggtgggactacttgaagcaagggggttgcggggggtggtgccaggtcataggtagatttttaaatgttctgattagtcgaaagagttattatcaatagaagagaatgtctgggttatgataagaggttgtagagaccaaggttttatcacgcagatgaaacttccaggtagcaggcttcagagagaatagattgtaaaggtttctcatcagacttgaggtctgtgtggatgtttatggtggtcagcttttcctgaattccaaaatggaggaggttatgatgaggcatgtctgaccctctcctcattatggcctgaactcgtttttcaggttaactttggaatgcccttggccaattaggtagttgcgaggcctagaattttagtttaggtttacagaccttattgggaaatagggtctttgcagatgtaattagttaagcatctcaagataagattatcctggaatatttgggtgggccctaaatccaatggcaggtgtccttctaagagatagaagaagagacacagacacagaggaggccatgtggagttggaggcagagattggagtaatgtggccacaagcccagggacatctggagccaccaggagctggaagaggcaggaaggacccttctctagagtttggttttggaatcctggccttcagaactgcaagagagtaaatgtgtgttgtttaagtctcccagcgtgtggtactttctcacagcagccccaggaagctcattcatgggtttgctagggaaaggagtcagcgatgagcccaccagtaagcaaaatgagcacagcaggtaagatggcacaagagatgaagggtcctgtgtcataggaggtgagggactgtgatgagaagggtcgtcttggggagcagggtttgcaggaagatctctgagggatgggtggttttttccatggccaccatgtgctgggaggagagcaagttccaggtgagttaagggagtggtagtagccccatggtagtagcacacatcataggatgtgcttgaagacccagaggggttgagctggacgtggggactgagtgtgggggatgagatgaccagcagtctggacccagcttacatttgcagacaatgagaaaaccattggcgttgggttggctttcagggcagctgatggctttcactgtgtgttgggggagaaaatgtggtttttaaggaccgaggagacagataacagggaccagaatctacagggtggagcagagaatgcaaaggagggaagctgtggctcagggtggttgatgcagagacccattttaaatgttttctagtctggtgcggtggctggctcacacctgtaatcctagcactttgggaggccaggacgggaggattgcttgaggccaggagtttgagaccagcctgggtgacagagcaagagaccccatctctacagaaaagttaaaaataaattagccaggtgtggtgagcatctgtagtcccagctactcaggaggccaaggcaggaggatagcttgagcccaggagttccgggcttcagtgagctgtgatgctgctgctgcactccagccctggtggcagacagagcaagaccctgtcaaaaaaaaaaaaaaaaaaaagccaggcacagaaggacacctgtagtcccagcactttgggaggctgaggcgggtagattgcctgagcccaggagttcgagaccagcttgggcaacataacctgtctctaccaaaaatataaaaaatagctggatgtagtggtgtgcacttgcggtccctgctactcaggaggctgaggtgggaggattgcttgctctcaggaagtcgaggctgcagtgagctgaaatcatatcactgcgctccagcctgagcaacagacggagaccttctctcaaaaaccaccaccaccacaacgtaatgaacaaccccaacattttctgttgtgcctctcggttaagatctcaggttagttatgcaagagtagaatgtgggattggaggcaagtggacttctccttaccccagaattcatgtcataaatgctctgcacagacgaggcttctgggactcttggggagacctaggaggtgggtaatagggatctgaatctacacggtggagctcatgacccaggtcagatgatgccaagtttcattttatacattctctgttcttcttctctgctccttaagagcgcaggtcagtaagtggggttggaaacagtggactcttccttactggggtataggagttggcacgctaaatattctgcaaagcttgctcttgcaggaccaagcatctaaatagtaaggtctaacctcagtcatctgtttctggaggaaaatcccaaagcatggcctttggagtgtgatttagccctcattctcagattcagtggtgaagttcagaggggagccaatccctctgagcatctcgaaggtggacagaacagtcagctcaggaggaaatctcaaaacaacgcccctcctcgggagttctcttacctttgtcattgtagttcctaaaggatgcactccttttcctttctattctttaattcacagggtccttaaacatggttcctcagatttcaataatctatacattggagatcacaaagaaatcttaatactgccaatgaaaggctaaaaattgtaaatggcactttattttcagtttgacattactttgctgatgattcttttcataatatatatgatttgatttaccttattttttactttgccatctgctttgcaattaaatacacacacacacacacacacacacacacacatacacacacacacacgttttctttttaaagacagggctctgctctgtaacccaagctggagtgcagtggcacaattatatctcactgcagcctccaacttctgggtcaaacaatcctgccgtctcagcttcccaagtagctgggactacaggcatgtgccaaaaaaaaaaaaattaaattaaatgaatgcaagtccattctcagtatgaaacacatactgaaataactgcctgagaaatggtacgtggtagataaatgtgcagcagatgtgctaattggcctgggtatagaaatttagctatttggtctgggtatacaattttaggttgaggaccattgcactcagagtttagatatggtggtttgttttagtgtccactattcatgataagaagtctcagtctcatccttaataggattgacctgtatttttattttactttcattttcttggcattttcacaatgttctccttagccttggtgtttttaaattccaggaatatattgtcaggaaaaggactgctgattttctttctttctttctctctctcccctcctctcctctcccctcccctcccctcccctcccttcctctctctctttctttcttttttctttttctttctcttttgttgcatactctctgggctttttaaatctaaagactgactttctgctgttgagaacatttcctgtttaatttctttgaaaacttttcttctctctattttttttttctattctcttattctgaaactcatgttggtgaaccttctgaatcactcctgtaggcttctagctttctgaaattttccatttgtccctttattctactttctgagagatttcctcaatgatgttttccaaaccttctgttatttcgttttcatttcagcaaatcatatttttaacttctaataactatttcttatccttggagtgatcttttctatagcatttgattcttggtttatagatgtatccctctccccctgatcttttgaaagaatactaattggtgcagtcagaatttttatgtctgcctgtctgttccttgaacttctattccatgaaatgtctggtatttctggggttcttcccattccaccccataacttttcagttttctcttttgtggtgaaggtgtttttcaaatatctggtaatggtttatatctatatgtataaaaatgaggaatgtcggttgagctgtacccacttgccgactcgtctgaatttgtcaagcttatgctataggttgggaattccacttctgtgtgatggtaattatttttttcttgggctttttgtttcctttagaatagatcctatcatctgattttgcccctggtgatgggtatatttggcctctgagaattctgcagaatttcagtgacttctccagtttctcttattggctgatggttttctcctgcctctttgttggcttggggttcacacttgccttccttagcacactttttagtctgttctccttttatctcagaaagaaggaaagagaaactaggagctccacatccaccatctttgcttggaagattcctggtttacacttttaattacgtgattgaattgatgaaaatggatggaccttgaaaacatcatgctgatggaaagaagtcagacacaaaaggccatatgatgcttaattccatttacatgaaatatgcagaacaggcaaatccacagagataaaaagtgattggtggttgtcacaagctagggaagggagaaaggggagatactccttaatgagtgcagggtctctttttggggtgatgaaatgtcccaggattagatagaggtggtggatgtgcaacattgtgatgaattgtgttctttacaatggcgaattttatgtcatgtgaaatttactgtgataaataaaaaggaaatatgaaattattccattttcaaaaggctacatagtgtttgattccatttataggaaatatccaaaataggaatgtagagacagaaagcggactcatggttgccagaatggggagtgactgcgtaatgggtacagggcctccttttggagtggtgagaatgtcctcggattgcctggagttagtggttgcacaacattgcgcatggactaaatgcgagtcacttgtgcactttaaaatggtttgttttatgttatgttaatttcccgttaattttttgagagtttgcatggaaaggtgaagctctaagcaggtcgtatgtttaggtgtggggatacccattatgctgcttagaaatatgttcacacttagggctcagcactgggggttctacttggtaattctttctgcttccacactctttcaagatatgggtcagagaaaccctggtgaggacggggtaggggattggatctctggctctgttttgggcattgtgtgattttcgaggtctgtgggtgaagctcacacagtacctttaccttggccagctctgggctttgcagatgccagtcccgaatgcctgcttcctctcccaactctgtcctctgcttagagacaaaagaagccttacagacagctgaatgggtccatgacagctacgcctgttcttgggaagtaattttgatcagagctcaggcctttggaaatgtctaaagaagtagtaatcaccattattatcattttaaagctagtaactaagaaaactatagatagattatagataatggtagagataatttataatctatagactgtaggtagataggtagatgattgaaagattgatagatataaataagtagatacatagaggacatatatatgataggtagatggtaggtatagatagatggatggctaatagaaagatgataggtagagagatgatggagatagatggatgatagatgatagatatatagatgatagataaatagatatagatgatatatgataaatagatgatagagatacatggattagatagctagatagataatagagatacatgatagtaagatagataataaataatagatgtgaagaggattggtagatgataggtggatagatggatggatagatgataggtagatggatagatagatgatggatggatggatagatagatatatgatagatagatgaatagatgatatagatagatagatagaaggatggatagatagatgataaagatagatcgattatagtaagatagataatagatgtacagagaattggtagatgatggatggatggatgaatagatggatagatagatgatagatggatggatgtatagatgatagatagggatagatagacaatggatggatggatatatgacagatagatggatagatggatggatggatagatagagatagatgatagtaagatagataataaataatagatgtgcagagaattggtagatcataggtagatggatggatgaatggatggatagatagatgatagataggtagatggataatatagatattatccaatgatagatagatgatggatggatggatagatagatgatagataaatagatgaatggatggatggacggatggatggatggatggatgatgggtagatggatagatatggactgatgaaaggtatcttttgttctacagaattaagttgtaaagtttgctgtctgtaattctcactcccaatggagatgtcaggaattctcgttctttcttcgttcaagggtggggaggaggagtctacaggagcagctgtaacaggcacattttggaatttaccccattggaatgtaaaggtcaaggaggcagccctgtaccacacgtctgggacgcttgtgtttgttatatttagtgcgaattgtgggttggctttgcttggagtgctgcttccgggaaaggcgctgtggtcgcctacatgctgagcattttaatttccatagacagtacactgggctgcacactgcatgggacttctcggcattgctggctgccctcctgactgttgtctttctcctggcaacaggggcttgggtgcccaagaatcaagtggtttaaaagtcattaccaaagttcacatcagtcttgtgcacagagaattaaaactgctgtaaattatatctgctgtgagagctccttcctctcatactgaggcattaggaaattgaatccattctacctaatgaaacaatgtacttttccttatgttgtctctaccgcctcatacatccctgagttgaacttgaagtctttgtaagaaatggtctgtccagaatttaaataacatgtttggctgcttctttatggagcacgattcttttctttcctttctttcttttttcttttttctttttttcagagacagggactcactctgttgcccaggctggagttcagtagtgtgatcatggctctttgcagccttgacctcctgtgctcaagcgatccgcctgcctcagcctctcaagtagctaggactacgggcatgcaccacctcgcctggctaatttttttttttttccagtacagatgaggtcttgctgtgtttcccaggctggtttcaaactcctgggctcaaatgatcccccttcttcgaccctagcactgggattacaggcatgagccactgcacctagcccaaagcacagttcttttgagtgagttgggttacatctttgctgtaactcaggtcatcaagccatcacttccactttttgccttttgttttcacctaagatctaaacactttgggtgagttttcaagagtcaaacacaacataaaataagggatagtagctatgagtttccatggcattgcagcatcaggaaatgggcatagcagttgggttgactttgtcccttgtttaaggttccttcatactcctcctgtgttttgttttgtttagaatgaaaggaagcatgtatgcgaattagaatactgaatattcactgcaagtcgtgattttttttttttttttgagacagggtctcactctgtcatccaggctggagtacagtggtgcaatcacggctcactgcagcctcaaactcccaggctcaagtatcctcccacctcagcctctccgagtagctgtaactgcaggcctgccaccacgcccagctaatttttgtatttttcgtagagacagagtttcaccatggtgcccaggctggtctcgaactcctgaggtcaagcaattcacccacctcagcctcccaaagtgctggaatgacaggtgtgaaccatcacgtctggcccaagccatgaatcttgggagaggagaggaggtgactatggccccgtcacccctgctgtccctcaggagtgtaactctggtgtttctgttgattttcacagtgactgatcaggcttttgtcacactagccaccaatgacatctactgccagggcgccctggtcctggggcagtcactgaggagacacaggctgacgaggaagctggtggtgttgatcactcctcaggtgtccagcctgctcaggtaaggctcagagatgcggcttgtgcccagctgggtcctatagaaggagggtcacctctcccctaagaggtcctaggagttattctgacgactgactgcccttcttcataggcctggatggccggcagtcatgatgggcatctgacgtttgtaaggaaccttcgaatcatgtgaaaatataggcgtgtgatcggcttcacaatactttaaaaaacaatactgggtttggttacagttcattctcccaaccatggaaactgaaaattcaattcttttttgtttgtttgttttttgagacagggtctcgctctgtcgcccaggctggagtacagtggtaccatcttggctcaccgcaacctctccctcccaggctcaagcgatcttccctcctcagccttctaagtagctgggaccacaagtatgtgcccccatgctcggctatttttatttttatgttttgtatttttggtagagacagggtttcgccacgttgcctaggctgatcttgaactcctggactcactcagtccacccaggttggcctcccaaagtgctgggattacaggcatgaaccatggcacccagccaaggagtcttttcttataatttccttttataattctctttgtctttaattctcaaataaagcaaatacataaataaatgcgtctaatgaataaagcataaggcttctcttaaatgtcatacattatgtaagcaataatctttttctttcatcaaccatggaccacttaaaaaaattgattttatacgaatgggacgaggaggcatttaatatggtagatgtagcaggaattgaatgtcatattctttgacaatgaaataataaatccagacattaatagctaaactaaaaagagaacaaataaaaaaccaaccagtgtgtcctcagacgtttgaaactggaagttttaaatgaaataactcaatccgggtacaaatgaaagcttgaattatgtactatttcagaaaatcactgcaatgtgagtgctacctatacaaagcaaagacagcaactacagtggtacaagacagaaaatttaaatcagtgaagaaattatccagttcaaatatatatgtatatacacacacgtatgcatatatatgtgtatatgcacgcgtgtgcgtatatatgtgtatacgcacacgcatgcgtatatatgtgtatacgcacacgcatgcgtatatgtgtatacgcacacgcatgcgtatatgtgtatacgcacacgcatgcgtatatgtgtatacgcacacgcatgcgtatatgtgtatacgcacacgcatgcgtatatgtgtatacgcacacgcatgcgtatatgtgtatacgcacacgcatgcgtatatgtgtatacgcacacgcatgcgtatatgtgtatacgcacacgtatgtgtatatgtacacgtatgcatatatatatacatgtatgtgtatatatttatatatacgtatgtgtatatgtacatgtatgtgtatatatttatatgtacaggtatgcgtatatacacatgtatgtgtttatatttatatacatgtatgtatacctgtatgtatatatgttcaactatatatttttatatacatgtatgtatatatttatatatacatgtattatatatgttcaaatatatttatatacacatgtgtatgtatatttatatacacatgtgtatgtatatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatacacatgtgtatatatacacatgtgtatgtacatatatttatatacgcatgtgtatttacatacatttatatacgcatgtgtatgtacatacatttatatatgcatgtgtatgtacatacatttatttatgcatgtgtatgtacatatatttatgcatgtgtacgtatatttatttatgcatgtgtatgtatatatatgcatgtgtatgtatatatatacatgtgtatgtgtatatatatgttcaaatgtatatgtatatacatataaaatatatatatttgaactggatttcactgatttaaatttaaaatatatatacacacatatttgaactggataatttcaaatatatatatttcatatatatatttgacttggataatttcttcactgatttaaatttaaaaaaatatatacatatatgtatatatatacatatatatacacacacacatatatatacacatatatatatatatatatatttttttttttttttttttttttttttttgagacagagtctcactctgtcgtccaagctggagtgccatggcgcgatcttggctcagtgcaacctccatctcctgggttccagtgattctcctgcctcagccttccaagtagctgggattacaggcatccaacatcacgcccggctaatttttgtatttttagtaaagacaaggtttcaccactttgcccaggctggtctcgaacgcctgacctcaagtgatctgcccgcctccgcctcccaaagtgccaaagtgctgggattacaggtgtgactcaccgtgcccagccccaaatatttttaaaataataatattaaaaaagcaaacagcagtaaaaaattcataaagataaaatgacaaaactaataattgggaacaagaaacaaattcaaggattaggttaacaaatcttcagggaggccaaggtgggaggattgcatgaggccaggagtttgacaagacaggctgggtgacatagcaagaccctatctctacaaaaaataaaaagagttagccaggtgtggtggtgcgcacctatagtcccagctagtcaggaggctgagatgggaggattgtttgagcccagaggttcgaggctgtagtgagttatgatcacaccactgcactccagactgggcaacagagtgagctcctctctctaaaaataaaaataacaaataaaaatgaatcttttattcgagaaaacataaatgtacaaaattgaaattagaaagaagtcatttggaggcagttttaaaagcaaatagtatatagaaccctttacagtagtgacactgggagtattgaagaagtgcttgatccttctagggaaatcggtgagatgttggttgttgtcatcagaagaaatagaaaccttttgtttgacaataactatgagaaaaactgaaaatgttaccaaaggcttatcttgtagaaaggccctggtttgggcaattttaagggaagttctgttaaattgctcatgatgaattaatttccctgctgcataaactgtcacagagcctagcaaaagatgaatatgttcacttattttaagaaactgttataatcttgacacccaaacttgatttacaggtttgattgtgtttacatttggattgagaaagccctcaaatacaggatgttaataaggcaactctagccctgtagtaaagaaataaatagtgcttacactaagaaagcaaagataggttattattttaaaacctattaatatcattcaacacattaatatgttagagaaagtcaatgataagatccttttaaaataaaaactaaacatataacaaaaagaattccaggccggccacggtggctcatgcctgtaatcccaacactttgggaggctgaagcaggtggatcacttgaggtcaggagttcgagaccagcctggccaacatggtgaaccctgtctctactaaaagtacaaaaaaaaaaaaaaaaaaaaattagctgggtgtggtggcaggcacctgtaatcccagctactcggtgaggctgaggcaggagaatcacttgagctcgggaggttaaggttgcaatgagccgagatggcaccactgtgctccagcctgggtgacagagcaggactctgtcaaaataaataaataaataaataaataaataaataaataaataaataaaaatccacatagattataaatatagaggtaaacatttaaaacatagagaaatcttagaagaaagtagatgaaagtttctcagcactgctgctatctgggactggagggttccatgtggtggggtgtcctgtgtactgcagggtgttgagcagcgtccctgggctccgcccaccagatgccggcaggagttggcagttgtgacaactaaaaatatctccacatgttgatgaaggtggatgttttgttcatctgaaagctggaaatgctggtgtaaattaaacaagatggaagaggacaccagaactgctgtgtgtcagagatattatgtgttaaagataaaacaaactgagggccacatttaaaatattataatggagaggttcttattgtccatcacgtacaaagaactctgaaaacactttaggggtttgcacgggctcgtctctagcacgccagaagcaaagatagacagacaaatacaaaaataggtattaaacacgagcaactggctgggtgtggtacctcacgcctgtaatcccagcactttgggagactgaggtggacggatcacttgaggtcaggagttcgagaccagcctgaccaacatggtgaaaccccgtctttactaaaaatacaaaaaacattaaccaggcgtggtggcgcctgtaattccagctactcgggaggctgaggcaggagaatcgcttgaacctgggaggcagaggttgcagtgagcccagatcgcgccacctgcactccagcctggtgacagagcgagactctgtcaaaaaagaagggaaaaaaaaaaaacctgactatattaaggtccaaaaatgcaccagtgagtggaaaggtacacatagcacatccagcaggttccgtgttttattttaaaagccggcgggggcgacggggtagaaaaatgctgttaaagagtgtaattgagttgcttgtaacacaaaggataaatgcttgaggggatggatactgcattttccatcatgtgattattacttattcctgcctgtgtcaaagtagacttaaggttcactcaagaggaactttaaaatattcagaaacaacatggcagaaatcgtgggaaggttcagtgttgcaagtcgggttgaggttttgtgggaccttttattatatgtttcgtagtcatggggagaattgagggatggcgctctgcggtggtcagggcagtggaagacgagcagtgagcaatgaccgtaaatgaccaggggtgtgggtggtgggagatcgcccctcccccaggctgtgtggtacaagcgtgttatggagtgatcttgcagggaaacctgctttaaactaattgtattcatgaaacataattctgcttccaggagtttattttagggaaatgagcagagctgaacaaaaagatgtaaggacataaatggcagtgccatttgtagtgaggtggagtgctgtttctcttgccctccccccagcccggatctttacgcaactgtggtgaagatgccataaattccataaataactgggccaaaagcagagggagatttgctgaaggaagggtactttttcagagaaatagttaccttaaatacagagcagtgaaatcttacaaataaatgtcgagtccaagagaaatgctaagagatagaaaaggtccgagagcttcaatatctgtcaaataggagagaaagaaaaagaaagaaagaaagaagtaactcctattatatttcagctctgagacaaagtttagattgaaagtgttccagatattgagcagagtggatgaagaaagctcaaatgtagacaccaagtggtaaaatttcagagcagcaaaaatgaagaaaaatcctaaatgcctttctgtatcaatctggttgtgacaattgatgtctcaaaattctggtgcaagataactttgaaatgaaagttctgtattcagctttagtaccgtaatttgaaagcaaaacaaagacttttcaaatttgcaaacgttaaaaatgttatccctcaaagatctttgaggaaaaagttagttgattgactcctgcaaaatggaatgtaatccaagaaaggcgagagtagccaagcacagtggctcatgcctgtaaccacagcattttgggaggctgaagtgggaggatcgcttgagttcaggagttcaagaccagcctggacaacatagtggggtctcatctctactaaaaaatttttaaaaattgctgagtgcagtggcacatgcctgtagtcccagttactcaggaggctgaggcgggaggatcactggagcctaggacattgaagctgcagtgagctatgattacaccactgcactccagcctgggtgacagagcaagaccctgtctcaaaataataataataatgataatgataatgataataataaatagaagagagcacacaggaagcagtgctgaataaataaatgtataaaacagagttaagtctgaatgtgttagtgcacagttacgaaaataatctggaattaacatttcacatgggaggtaattgaaagagcagagaagaaagaatgagcatatgttcatgtttttgtttcgtctgggaagaagacataggtaatgactatatttgatagaaaatataagcttaaatacgtgtgctgacagttgaaaggtggttaccaccagaaaactagaaaagatgtgtacaagtttcagagccttaatgggaaatgcgtggattgaagaaaacctgattcatgcaatcagaggtgggtgggaaagaattacactgatgtcaggcctctgagcccaagctaagccgtcatatcccctgtgacctgcatgtacacatccagatggccggttcctgccttaactgatgacattccaccacaaaagaagtgaaaatggcctgttcctgccttaactaatgacattatcttgtgaaattccttctcctggctcatcctggctcaaaagctcccctactgagcacctttcgacccccactcctgcccaccagagaacaacccccctttgactgtaattttccttgacctacccaaatcttataaaacggccccacccctatctcccttcgctgactctcttttcggactcagcccacctgcacctaggtgaaataaacagccttgttgctcacacaaagcctgtttggtggtctcttcacacggacgggagtgaaaactgaagaaatagaaaatctgatatatgtaaaaaagggaaaataatataaaatgaaactgcaggactcaatccaaatataaccgtgatcataataaacatgaatagattaaaattcctttttaaaaagataggctttctgaatgggaaaataaacataaaatccggacatacagtagtgtaggaggcagcttaattaaaaacaaacaaaatgttgaaaataaatggatgcatttgatatgattctgttccactatccaatctaagtaatggtcaattgttttatagattgttcttcagttgtttgttgttgttgttgttgttttgagacagagcctcgctctgtcgcccaggccggagtgcagtggcacgatctcagctcattgcaacctctgcctcccaggttcaagcaattctcatgcctcagcctccagagtagctgggattagtttcccgccaccgcacccggctagtttttgtatttttagtagagacggggtttcaccttgttggccaggctggtctcgaactcctgatgtcaggtgatccacctgcctaggcctcccaaggtgctggaattacaggcatgagcccctgtgcccagccttcagtttggttttgtccagtgttttctcatgattagactgaggttatgcatttttggcaaaaaaatcatcagaattgatgtaagttttcagtgtgtcatgctatggagtgcatgatgtctgtatgtcctgacctggtgatgttaaatttcatcacctggattaagtggtgtctgttggaattctccactgtgaaattattatgtttttcttttagtaatggaaaatatcttggcatagacattatacaaacagcctgtttcttctctaaaaatcagtgagtcttgtctgcaacagttgttactatagtgtttgcctaatcgtggttttctacttccctcattccttctatttcaattacttggaattatcttctaaattaaacctgccctttctttctcacatatttgtttattcaatagttatattaggtcaggcgtggtggctcatgcctgtaatcccagcactttgtgagactgaggcaggcagattgcttgagcccagaagtttgagacaagcttcataaacattgtgaaaccccatttctaccaaaaaatacaaaaaattagccgggcatggtggcatgcacttgtagtcccagttacttgggaggctgaggcaggcggaccacttgagcccaggagttcgaggctgcaatgagctatgattgcaccactgaactctagcctgggtgacagagtgagaccctgtatcaaaaagaaaacttatattagtgtaggctcatgaatatttatttcatattttgggcttgttgttttttgttattgattacattatttcagctttggcaattgggtgcttcccctagctggccccctgtattctttcaatatgcccccatccttttctagcacttgcttaatttttctgtcatcccaatatgttccagactatgatgaagtgggatttaagcaaaaataaataaataaatggaacagagcaaatttcactttgataaaatggacagtctttcaagcttcgagtctcaaacttgtatgcaactaacaatgtaagctttgaatacagaaagtaaaaattgatagagattgttatggacatctgttagtttctaccagctcagcatttacatttctctgcctctgcagcttacagagggaaactgtcttcctaagagctggcccaagtgcatgcatcttaagacagttctgttcaatttgtcacatttttcaagtatgcatgcatttctttttcataatattaatatttattactatatatgaatactagattgaaagcccaagcattcagtttacacacagaaattatgcaattatatatcgcttcacaaaggcagtgaacacattacattctacaaaatctacttcacagaaatttaaaaattctaaatatcaaaaggtacagctgaagaaacaggtataaatttggcagccagtaattttgacagggaagttgcagcttgcatgactttatttttttgtttgttttttgagacagagtcccactctgtcgcccaggctggagggcagtggtgccatctcggctcactgcaacctctgcctcctgggttcaagtgattctcctgcctcagcctcttgagtagcaggaattacaggcgcccaccagcacgcctggctaatttaaattttttgtttgtttgtttttgtttttttgcttgtttgttttgagatagagtctcgctctgttgcccaggttggagtgcagtggtgcgatctcaggtcagtgcaatctccgcctcccgggttcaagcgattctcctgcttcggcctcctgagtagctgggactacaggcgccaccacacctggctaatttttgtatttttagtagagaaggggtttcaccatgctggccaggctgatcttgaactcctgacctcaagtgatccggctgcctcggcctcccaaagtgctgggattgcaggcataagccaccgcgccaggccttgcatgactttaaatatatgaatatgaaaatattgaacttagagtaatcattgtgctttgtgttgattgaaaaatataacaatggctatcaaagaagcatgttcaaagatgcttaattcacttcaaaatgtcatacaaattgtggtggtttctatgcacctctaaagcttccgtcatttagctcaggtacattactaaagtaatatattaattctaccggtacagtggggtttcacaccattggcatttgcattcaagcatgcagaggcttttgggcacaagtggacggtgtgcacagctctaagccatccgtggaaatgtgctctgaacatggagaccgcagtgagggctgtggggattctctttgcattccacgtttgtgagcagcaaaacagcaccctcttgaaggaggaggtggttctgtgctgaatattcacccgctgtcccactatttggcacatgtctgttccagggtcatcctctcgaaggtgttcgatgaagtcattgaagtgaatctaatcgatagtgccgactacatccacctggcctttctgaagagacctgagctcgggctcaccctcaccaagcttcactgttggactctcactcactacagcaagtgtgtcttcctggatgcagacactctggtgagtgaagactctctgcttgataggaaaccctccaagaccacatctctatccttaagcaggctgtcaacttttttttgtgtgtgtgtgacacagtcgctctgtcacccaagctggagtgcaatggcacgatctcggctcactgcaacctccgcctcctgagttcaagtgattctcccacctcagcctcccgagtggctgctattacaggcacccgccttcatgcccggttaatttttgtatttctgtacagactgggtttcgccatgctggccgggctgtcacctcttactggtagattcctgtgaggccatgtgcatttctatttctaacacagatgttcagtctattataatcaggcataacatacccccgagcactgtgctagaccctgctgaagagaacaggggattggaagacatgttcctaccccaggaatgaattataaccacagtattttacacgcacaaaatagaatcatgagggaaaaaacttgtgactgggcacagtggctcatgcctgtaatctcagcactttgggagcttgagatgggtggatcacttgaggccaggagtttgagaccagcctggccaacacggtgaaaccgtttttactaaaaatacaaaaattagccaggcatggtaacaggtgcctgtaatcccagctactcaagaggctgaggtggggggatcgcttgaacccgggaggcggaggccgcagtgagccgagactgaagcactgcactccagcctgggcgacagagcaagactctgtctcaaaaacagaagcattggtaaaagaagcattgcggcgggttctgcgtgttttgcttcaccaggtgctgtccaatgtcgatgagctgtttgacaggggagagttttctgcggccccggaccccggatggccggattgcttcaatagcggggtgtttgtcttccagccttctctccacacgcataaactcctgctacagcacgccatggaacacggcagctttgacggtaagtcagggcagcccggacgcttagggtctctgttgcacacactcaactctgcagatgtaacacgaagtcagccgttgaccatacagtcacacctcgctcagcgacagggatgcggtctgagaaatgtgttgttaagtgattttgtcattgtatgaacgtcccagagtgtatctgcacacacctggatgatgtagcctactgtatacctaggctggagggtacagcctattccttctaggctacaaacccatatagcatgggagtgcactgaatgttgtaggcaactgtaacataatgggaggtatctgtgttctaaacatacctaaacatcacaaaggtccagtgaaaatacagtataaaatcttatgggaccaccgtcagatgtatggtctgtctttgaccgaagcacttttatgtgttgcatgactgtacttggcattgaacatgggctggccgtggtggctcatgcctgtaatcccagcactttgggaggccagggcggacagattgcttgaggcgaggagttcaagaccggggtgggcagatggcttgagaccaggagttcaagaccagcctaggcaacgtggcaagaccccatctctacaaaaaatacaaaaataagctggatgtgatgctggcacctgtagtccccaagccctgggaggctgagttgggagcagcagctgagctcaggagctcaagcctacagtgagctatgattgcaccactgcactccagtcaggttgacagagtgagaccctgtctcagagaaaaagaaaagagcatggctgtgttccaataaaactttatttataaaaacatgcacagtgtgtagttgcttgacccatggtagaatatagggagaattaaaaggaggcaacctgaagccgagtatttgttgaaatgggcgtcagtagagaggaaatgtgctggaatttttgtaaagtaaaagaaaatactggagcagtgaagaattgcctctaggtaaaggggaagttaatgaaactggcaaaaatgatgggaaaagcattgtcactaccagggagaattcattaggggaccagtggaatgctttggactccatatgcaattttagcattcattctggggactcctggtggagaattttggagggaatatgcacttatttttatcaatggcttgggttatcagtcttttctgagaaccaagagaatgtgtgcagctggcagacagaagaaatggaattagtaaccctgaaggcaagtgtttatgttgagagcttcaggcacatctcgcattcttggagtgaaccaagccatactttgctaacctgcttttgtgtttgctcattatgtaggggcagaccaaggcttactgaatagtttcttcaggaactggtcgaccacagacatccacaagcacctgccgttcatctataacttgagtagtaacacgatgtacacttacagccctgccttcaagcagtaagttctccaccctggcgaatcctgccagatctgccactaccgatccaccttccctcctggaagacataccagctgtcggcatatttaaaaactctatctatctatctatcatctatctatctatgtatctatctatctatctatctatctatctatctatcatctatctatcatctatctatctatcacctctatctaggtagatctaaatatctatttatctgtatagatagatacctatgtctatgtgtctgtgtatctagatctctatgtctatctatatagatatatatctgtctatatagttatctacctatataggcctagacatctgtttatctatctatctatctatctatctatctatctatctatctatctatccatatctatctatttagatctggatatctatctgtatacatagatctatatatctatatctatatatgtatctatatctagatctagatatctatatacattgatctatctaatctctatatctatgtagatatttatctatctatctagacctagatgtctatctatctagacctagatatctatctatctagacctagatatctgtctatctgtctaatctatcatctatcatatgtatctattcagatagatctggatatctatctataaacatcttatctatctatctatctagatctacatcactatatagatacctatatctatctatctagaactagatatctatgtatctagatatccatctagatttagatcttcatccatatagatatctatatctatctatctagatccagatatctatctatatacatagatctatatatctatatctgtatatctatctagatctatctagatatctatgtatatacatggatctatatatctctctatgtatctagatctagatctctctctatatagatctatgtatctagatctagatctctatataggcatctatccatctatgtagatctagacatctatctatatattaatacatagatgtatctatctatatacgtctttatatatgtatatacacacacagaaacacacacacacatctcgtttcctgcttgcttgttgctgtaaatgatagctagccaaggctctacgacaatgatccccaaagtgtggcccaaggaaccctgaccccacaactctttcaagtgtcttcaaagtcataactactttaaaaaaagaatttgaagatgtgatttttttccctttttgctgccattttctcatgcatctatgctgagagtttacagacactacatggcatgtgataaggtaataccctgaacacagatggagctaggaagaaccagctgtcgcctcttgggaaaatggatggcactcttctcacaatgattttttttaatatagaaatttttttaatgaaaaattatgaaatttatgttactgcataatggtttgattttttttaaagggattgataaatatgctttctaatttctcagttttaatatcgattattctaaatatggagagagagaatccacagggacatggccgagcacagtggctcacgcctgtcattccagccctttgggggccgaggtgggcggatcacttgagctcaggagtttgagaccagcctgcgcaacatgatgaaaccctgtctctacgaaaaaataaaacaaaacattagccgaatgtggtgtcgcacaccgctagtctcagctactcgggaggctgcggagggaggctcacttgaacctgggaagtggagtttgcagtgagccgagatcgtgccactgcactccagcctgggtaacagagcaagcctcagctcaggagaaaaaaaaaagaaagaatccacacggacaaagctctttgggttcctaaaagggtcaagggtgaggggaccagaggctgtgaaattcactgctccagaagatatggctataaatgaaaatagagaatctgagaatcaccttgggaatgaataattctagagtctgcattctctacagaggacacggtgtccctaaggaagagaaattgattcttgggagtgaaatcttgttattttttactgtataatcacagatgtaatgtacagaacatagatatgtcatgtgacttttgtgttcatatttcatgaggaggtgatccacgaaaaaaaagtttaaaaaggctcctggaggatggtgatgatgaacaacaaaaaagttggcaaggggaacatttagaatcctgtaaaagagaaaaaaagccaattgccttgccgcttgcattagccactgtaaaagctatttttttttgcccctgtcgttttaaggatatgatgatttgggctgctgtacttcacgtttttacaaaactgatttatttttcccgttttgggaaaaaatgtcaatggattacgattatgttttttgatatatagaaaataaaataactgcaaaaactgtgatttaaaaaatatatctttatgcaaaataactgcaaatgaaactactactactatgctgatagcagtggagtagtattattgatgatatattgattactatcttgatagtagtggtatgctagtattgctcagatattgattactgcattgatagtactagtatattattattgattatatattgattactatagtagtgatagtattttgttattattgatcacacattgattactgaattgatagtagtagtatgttactattggttatatattgattactatgctagtagtagtatattgttgactatatattgattactacattgatagtggtagattattattgattatatattgagtactatgttgataatagtagcatagtattgattacataacgattactacattgatagtaatatattgttattgatcatatattgattacatgcattgatagtagtagtgtattattattgattatatattgatgactatgttgatagtagtaatcttattatgggtcatatattgattactgcattggaagtagtagtgtattattattgattatatattggttactatgctgatagtagtagtatcatcagtaataataatcaataatggaaacccattgggacaagtccttcagaggctgtctttgaggagccccatggtaggtggatgctttctgggtgtcttttatcacatctgagtggaaatcagaatcccttctgtttccttctcagattcggttccagtgcaaaggtcgtccactttttggggtccatgaaaccttggaactacaagtacaatccacagagtggctcggtgttggagcaaggctcagcgtccagcagccagcaccaggcggcattccttcatctctggtggacggtctaccagaacaacgtgctgcccctttataaaagcgtccaagcgggggaagcacgcgcgtctcctggtcacacagtaagtgggggattcccttaaaacccgtagctgaggacgaggagaacatccttgtcaccaaggtctggcgtggtttttttttgaaatgccccttttttgtctaaatactgtatttcatggaaaagaatactgagaagcaagcacctgttaaaaaaatttttaagttttagctcaaaatagagaatgcctaatgactggagatcctgttttgatgtgtaggcctggtgcagaaataggttattgaaattagccatcctcatcagagtaagagacactcatggacaagtggttcacaatgactgattacgacgtcattcgggtcaacactttccacttgaaaccatcatttgagatagcagttggaggaagtgtctgaagaggattttgtaaagttttgattgacaccaatttgattgcaaagaatataatgacagcccctcggtgtgctaaatggtggagtatctgcagtgtgctgaatgtaggctgcatctgccttgcagaagacctcttgcaattaggactcaggaaacttcttattcctaatggcttttttcactaaagtaaaaaaaaacttgagcttttttttttttttttttttaactagagcatttgtactagagtaccagagtattttttaactagagtaaagaaaactagagttttgtttgtttgtttgttttttgagacagagtctcactctgttacccaggctggagtgcagtgacatgatctcggctcactgcaacctccgccttctgggttcaagcaattctcctgcctcagcctcccaaggagctgggattacaggtgcctaccaccacgcccagctaatttttgtgcttttagtggagacggggttttgccacgttggccaggctggtcttgaagctctgacctcaagtcatccacccgcctcagcctcccaaagtgctgggattacaggcgtgagccaccaagcccggcctttttttttttttaactagagcatttgctagtacaacagagtctgctatcagcacatgcattgcctgggaaattgaaaagaatccctattttaatttttagtatggttttttatttgggtggatctaggctgctttttaaggactgctgaaaatttctctcaccgagtgacactagcaatggacgtttatttgtattcacttcacaaacattgacttgtcacatatttcctgctgggcgttttgctaagtactggattattaagtactggattactaagtactggattactaagtactggattgcataggagggaattttaaggcttagtgtcaaacggtcctgagaaagaaaacatttaggacaattatttaatgattggcagatgggagctgggagccctggctacacagggccccacccgccccccaggacagcaggtgaattgaggagacatagggaagactcactccacgtgtgtgtttttgtgcagctttgccacagtgatgtgggggggccgtgtgcggattcagcctctggtgttggagagccgtgtgaaaattcaacacccagtgcgggcgtgccgtgtgcaaattcaccactgggttctaaccagcctgctcagggccttccggagccgacccagatagtggatgagaccctgtccctacctgaaggacgccgttcagaagatgtaagtacctgcattcctcacaggtgtgatagtcagacgctggctcgcagtgagagagcagagagagccggcttccctggctccctggggaggggagatggaggggaagggctggtctttggcttgctgtggcattcaaggctctgcatttatttttgcattacggcacaccgaatcaagctcacctgctgaaagatgtctatgccccaatccctaggacctgtgaatgtcaccttgtgtggcaaaagggcgtttgcagttgtgattaaatgagggaccctgagctggggaggtatggtcttggattctgggagtgggctcttagtcatcacaaacctcccttcaaagaagaaggtggaagtgtgaaggtcagagaaggagtgtgaagctggaagcagaggccagagagagaggggattggaagacgctgggctgctggctttgaagatggaagaggaggccacgagcgagggaatatggtggcctccagaagctggagaaggcaggaaatggattctcccctaggtccccaagaaggaaccaaccctgccgacaacttgattttaatccactggacttctggcccccagaactatcagatggtcagtctgccttggtgtaaaccacccagtttgtggctgtttcttacatagcagcctcaaaaatctgatgccacaaggagacagatgctcagtctctcgcagtttacagattctgggggagccagagctctttcaggttcaaaaagggaggcttccgtcagtgccccctcaacccaactgcctggccgtgcatcctgagaggtttcagccgaacccctgacttgaacagtggttgaagtgaagatgaattcctgccggggttcaatgttcaaatgaatgttgacctgcacagtggtgtctgctgaggccgagtctgcagcactttgtccccatcgaagaaaaatgaaaatacaccttacttgcaaaacaaataatggaggccgtcatttctccagctccaatttctaggtgaatactttggaataatatcttgtgtttaaagatttcctggggccaggcacggtgactcaacacctgtaatcctaacactttggaaggctgaggtgggaggattgcttgagcccaggagtacgagaccagccggcaacacactgagacctcatctctacaaaaaaaagtcaagaaattagccaggcatggatgtgtgcacctgtagtcccagctacttgggaggctgaggcaggaggaatgcttgagccttggaggtcaaggctgtagtgagctataatctcaccactgcactcccgcctgggtgacagagcgagacactgtctcaaagaaaaaaaaaaagaaatcttttttttttttgaggcggagtctctctctgtcacccaggctggaatgcagtagcccaatcttggctcactgcaagctctgcctcccgggttcacgccgttctcctgcctcagcctcccgagtagctgggactgcaggtgcccgccaccgcgcccggctaattttttgtatttttagtagagacggggtttcactgtgtcagccaggatggtctcgaactcctgaccttgtgatccgcctgcttcggcctcccaaagtgctgggattacaggcgtgaaccaccacgcccggcaagatttcttgttttaaatctttaccactgatcctaacaagtttctcaacagaattattttgagatcatacttagggaaggatctggggactgggctgaaggaaagtgattcttttctgtatacttcagatagctccgggagagccgtttcttgttgcttataaacaagtgacctttagattttgcacacattgctctggaagacaccacacgcttcactgtactctggcgtaaattatgctctggcaactttatgcatgaagaatgtcggagtggtgatttcacattgacccaaacacattgaaaagatgtttaggttcagatggtgaagactgaggaggtgtaaaatgcgcttttctggtttttcattcctcatggtgtgccctgagcataccatagcctgggcctggccccaggacgtgcctcatgcgagtcaagtcaagagcctctgcttgttcctgctggaatgtgaagaattccatcagtggagcccttacatgatgtgcaaaacggctgcaattgtgctgagccatgctcgtttcaggatgtctaaggaaaaatcgcatttacattaaatgtttagtaggcaaccaagtttagactgtaaaccaaagagtatccaagaatgctgtggcattcaaggctcatgcttttatgtgcattacagcaccttaaggccaataaaggggaactcccatcccctgttgatgtgtattgaaaataattgaatgctcaaactcctagcctaaaaaagaaatattatcgaatgcttcgaaaacataaatttaggaagtgtattttgccaaggttaaggacacacccgtgacacagcctcaggaggtcctgacgacatgtgcccacggtggtcggggcacagcttgcttttatacaatttagagaggatgaggtatcaatatgcgtaagaagtacattggttcagtccggcaaggcgggacaactcaaagtggggcgggggcttccaggtcataagtagatagaggcaaatggttgcatttttttttttttttagtttctgattggtctttccaaaggaggcaatcagatatgcatttatctcagtgagcagaggggggactgaatagaatgggaggcagaggccctaagcagctccgctcccagctggacttttccctgcttactgatattggggttccaagatttactttcttcacaagactctattgagtcctcagaaaacggttttcaaaccatctttctgatttccggttgcgtaattttaatcttattccgtcactgaatcttgtacattagtggttttgcaaactatggcctgaggtctctctgaataaggatcattttaaaggattgtgtttttgcagatgatcttagaagcattcttctttttctttctttttttttttttgagatggagtctcactcgatcgcccaggctgaagtgcaatggcgcgatctcagcagctcactgcaacctccaccgcccgagtccaagcaattctcctgcctcagcctcctgagtaggtggacaggcatgagccaccacacctggctaatttttgtatttttagtaaagaccgggtttcaccatgttggccaggctgttcttgaactcctggcttcaagtgatccacctgcctcagcctcccaaagttctgggattacaagtgtgagccaccatgcctggctattaaaaacattcttaacagtttattctgaaccacagtgagcactccctcattcgtaagggcagccaccctctttcagaagcaagtgtgtattctccacccttcagcccctggagggatttccacggattgtcacagcccctgaaaacaagcttcccagggcaaacagtggttttccagagactccaaaagggaaaacagtcaggacgctccagtcccagctccagcccaagttgtagccacaccaatctctgcaaaaacagaaccatttccagagtgacagcacttagcactctggtttctctaaaacagcgcccgtcatgttcaattcatattaatctcgatggaattgttgccgtggatttttcttgacataagtcacttctacttttactttggattcataattgtcgatgaggtggcaacttaaacaatagatatgtagcttcgtgtttgtccgtccgtgagccacctttcaatcagagccagtcaagccaaacctaggagagactttcccgtggagggattggggcttctgaggaaagctcatggagagaatcgtgatgacagaattgaggatcatcctgccttgatgcccaaggaggtaagcaaggacacaaaagcacgctcatttcaccccagttaggtggtgtctattatcaaaaagacaaaaaatatccactgctggtgaagatgtggagaaaggggaactcttttccactgttgatggggattaaaaataagcacagccaggatggagaagagtatgaaggttcctcaaaaaactacaaatagaactaccacatgatccagccatcaccactgggcatttatccgaaggagaggaaattagtatattgaagggacatctgccccccgtccatgtttttgcagtttattcacaacaggcaagatacagattcaacccaagtgtttgccaaaggatgaatgggtaaagaaaatgccatgtatagatataccatggaatactattcaaccataaaaaagaaggaaatccatcatttgcagcaacatggatggaaatagaggacattatggtaggtgaaataagccagaaacagaaagttaaacaccacatgttctcactcatctgtgggagctaaagaaatttaacctcacagaagtgaaaagtaaggccaggcacagtggctcactcctgtaatccctgcactttgggaggctgaggcaggatgattgcttgagatcaggagtttgagaccagcctgagcaacatagcaaaaccctgtctctgcaaaaaaatacaaaaattagctgggtgtgcggtacttgccggtggtcccagctactcgcaaggctgaggtgggaggatcgcttgaacctgggaggtcgaggctgcggtgagccgagatcacgctgctgcactccagcctgggcagcagaacaagaccctgtctcagtagaagagagtgtactagagactaggaaaggtgggggaaggagaagatagggagagatttgttaaaggatacaaaattacagctagacaagaggaatatgttgtcatgttctatagccctgtaggatgactatagccaacagtaatctatagtttcaaatagctggacggaggatattgtatgttcccaaaagaaagaaatggtacatatttgacatgagggatatgctaattaccctgaccggatcactgaatattgtaggtattgaaccatccctgtgtaccccatgaatatgtacaattattatgtgtcaatttttaaaaagtaaattttttttttttaaaaaaaagtatgttcaacagccagcagccacgagaaggtcatcagctggtttcatccacagcaagagattgctggctccaaatccccaccccatcctcaaggggcaatattgcagaaaggaggagggtgggaaaaaaatctcaagaattggagaatcgccggtttccagggcccagaacaagacccaggaggagatgaagatcacccttgcaggtagaagctgtccctgtctgggtagtgctggggacagtaggtggcccttctgctgtctgtctgagcatgagctcaaggccaagggtaagatgaggggaaatgacccccagctgggctgagcgtactttgtttagggtatttaagcagttctcaaaagtgattgcagaacctgtatctcccatctcagggactctgcccagcctcacccctccctccaccccactgtcatgcccacgcttaggcttcaaaacatcaatggaagatgatagtgcagtgcccaactgcaggcccttacatgaataaactgtacatcacagagggggcggcaagggaggggaaaacagacagatccagctcagatggaatttgatctgaaggaaagtgataaagtgaagaagggatctgtcagccctgcaagcggccccaggcacagcgtgaaggggaggcagggagaggtcatgctggcctcagacttggacgctgaaatgtttagttacagccggaggggggacgcctgcataggtcctagggaaaggaggggacacccaggcattggagacccactgtgtagacgactgcgagacatgcttaaatatttagcagaaaggaagagaaattcgaatagagagattcaggaatgggaggaagggatggaggtgaaatcaaagctgtttaaatacagatgctcttcgatttacaattggtttacatcccaacaaacccatcgtaaactgaaatatcttaagtcaaaaatgcatttagaccaggtgcagtggctcacgtctgtaatcccaacactttgggaggccaagtgttggcagatcacttgagctcaggagttcaagaccagcctggccaacacggtgaaaccctgtctctactaaaaatacaaaagttagccaggcttggtggcgtgcgcctgtaatcccagctactcgggaggccgaagcaggaaaatggcttgaacctgggaggcggaggttgcagtgagctgagatcacaccactgcactccagcctgggtgacagagcaaaactcagtcccaaaaaaagaaaaagaaatagaaatataagcataaacttaaataactggggagcgttatgttggctgactgcaacacagatacgaaaaaccctgacagaataaaaagaattctaaccaaaaaggtattttgggccgggcacggtggctcacacctgtaatcctagcatgttggtaggctgaggcaggcagttcacttgagctcaggagtttgagaccagcctggccaacacggtgaaaccctgtctctgctagaaatacaaaaattagccggaaatcgcttgaacccgggaggtggaggttgcagtgagctgagatcgtgccagtgcattccagcctgggcaacagagtgagactccgtctcaaaaaaaaaaaaaaaaaaaaaggtattttggagttcctgtgtccacataatttcatccttcgatctcaccccctattctccccacctctccatcctaaggtcggtgaatactgcgtcggggaaattgacctaaaaaaatttgttatggtctatatattctctgatgagggtatttttctaaaagcaatgaagtcttcaggcttttaaaaggaagggattggggggcgaggggagggagagcatcaggacaaatagctaatgcatgcggggcttaaaagctaggtgacgggttgataggtgcagcgaaccaccatggcacacgtatacccgtgtaacaaacctgcacatcctgcacacgtatcccagaatttaaagtaaaagcaaaacaaaacaaaactctttttaacaaaaggtatgttgattgattggagattattatattacggtcacattttccaagataatatttgataacactgaacaaggagttgaaaatttgagctgttttgtatactagttatgtgactttggataaatcaataaatatttctgaacatcttaaaaaaaaaaaaaagagggatgctgtccatacggtatctgatatatagctcaccctccgcatctatgggttccatatctgtggattcaaccaaccttggatcgaaaatattggggaaacaaaattgcatctgcactcaacatgcacagacttttttctcttgttattattccctaaacaatacgacatagcaggtatcaacatagcatgtgcattgtaataggtatggtaattaacctagagatgatttaaagtctatgggaggatgtgcattgcttatatgcaaagacagttccatcttgtatcagagacttgagcatccgtggattttggtataaccaggaggtcctggaaccaatcctccatggatatcaggagaaattccatttcattaattcgtactcccggtggtctttgaaatgagtcgtgcaacatcactgtcacctgctgtccatttagtgagttactctgggttttttatttaggggagctgaaacacagatttttaaaaaaagtttattttcataaatcgcaataatgtcataaaagctgagtgtgcgtctggggctctttagtccagtagctactttggtatatataatgatggcaaggttgacgtgttttggttttgttgttgttgttgtttttgagacagggtctcgctctgttgcccaggctggagtgcagtggcacaatctcggctcactgcagccttgacctcctggactcaagtgatcctcccacctcctcccaggtagctgggactacaggaggtgccaccacacctggctgatattttgtattttttgtagagatgggtttcaccatgtttcccaggctactcttgaattcctgggctctagcgatctgctcatcttggcctcccaaagtgttgaaattacaggcgtgggccaccgtgcctgccccagatctgtgttttttaaagtaaagctgaatattaattttttccacatacattaatgtattaaggaaaaagttgcaattagtatcttctccagcgttttgtcttctagtatttggggtagggaaatgtagttaattaaaagattacagatgtccttcagtttttttttttttaagctatcaagtttttttactctttttgtagtgcatcttattttattcataatacacctttttgttgaagtatgtcttacttttttatttatttatttatttttttgagacagagacttgctctgtcgtccaggctagagtgcactggtgcgatctcggctcactgaagcctccgcctcctgggttcaagcgattctcctgcctcagcctcccaactagctgggactacaggcatccgccactacacctggctaattttttgtatttatagtagagccgggttttcagcatgttggccaggctggtctcgaactcctgacctcaggtgatccacctgcctgagcctcccaaagtgctggcattacaggcatgagccaccacgcccggcctctactaacattagtagaaccgttgactgtgtcccatatatctatgacacagttatctgcattttctgtcaatctttctccccatacttcagtctactgacctattttctagttaactgatctctttggctatgtctaatctgttgttaaacccacattctagcttcagttattatgtttttagttcaaattaacatcagatttttagttcaaataacatcaatgtagtttcaatactaccttgaaaatttttatctttttccccatcttatttaaagtatttctcacatttaattatagtccatgtctgataaattacatatctgggtttcaggtgggtttggttttgttgtttaattttgcttgctcttgattttcactcatttggtcttttcttgttgtatgatagttaattttttaattgacagccagacatggtaaatgaaaaagaattgcaaagacaatttgtagctctgaatcatattatcataacccaaagaggatttttttttttaattcatgtgatttgatgtgatttgtccataccctgaggtagtttgcccagaccctatctggggctgagctggagggaaattgggcttcagtgtttgtgatgaccagtctatttctggttctcctctcagtgaggtcacaaaagaaagcttgtggtgtgtaccagggtccctcattggtcctgattattaatatttatggacccctcagcctcctagcactgctggcaactctactcagtttctcagcttcccagcctcttatttgccctgagtggaagtaaggtaccaaatgtgacatttacctcttctgtttgtctctggtatcttcactcttaattttgtgctgccttagtagctctctgatgcacttaaaaaaaaaaaaaattctaggccaggtgtggtggctcacacgtgtaatgccagcactttgtgaggccaaggcaggcagatcacctgaggtcaggagtttgagaccagcctggccaacatggtgagacccccatctctactaaaaatacaaaaactagctaggcatggtggcacgtgcctgtaatcccagctactcgggaggctgagacaggagaatcacttgaacctgggagggagatgttgcagtgagccgagatggtgccactgcactccagcctgggcaacagaacgagactccgtctcaaataaataaataaataaataaataaataaataaataaataaataaaattctatatacattatttgtgcagcctttttaggtatttttggcagaagacttagtgtgaaacaacagcttcaccatttgctgaaagtggaaaaaatctcatttcagttcctgagctgatacatatatatttgtatttttagcattcaccacctccagcagtaataactttcacaaatttatagcccataatgcaaaggagtgcttccttttttgctgtaaatgttatctccttggattgtgtactggaacattctgtgtctgctgtctatctgttccctgcctcgtctgcctttacgatgtcctctctcagctttcatcttcccacacagagcattttgttttaagcatctctgcatatctcagcctctttccaatgacctgagaattcttctctggcctgcctccagtttcagagtcccttctttcaaggtgaccccatcttcagtcaggcttttaggggatacatcagtagaatagttattacctaaggataaaaagaaatgcagtttgtaaaagtcacattttatattcatgcattcacaagcttgccaaaaatgttcttaagagcggactttgagattgctgcattctcatcttaaaatttctctctgcatgatatgcaagggggaagtgtctactttttactagtaaaaataatggccatatttattcataaaagttggtttatgtttcggctgttaatattacttgttaagtaagcctctgggtcttgattagaaacattagcaagggctgactgaacttctcttcctcgtttaaattcgtaagattaacacatctgcagaaggcaagctgagaacttgcatcattatttcatcctctgtaatcaaacatataaccccgagttaaatcccttccgaggaaggattatacttcatgatcggccccgtggaacttatttatgtgtttatcgttgggagaaattagatgacagaaacagattgacattttccctaatccatttccaggaatggttttttgagcacttattctttgcctgtctggctgcttcatttatccatcacaataagtgtctgtgtgacatctcactgaaagccccatgactcagagagtcatttctgcaggtccttttccttgatgggtcagtattcaaatccaggacatccctctaccagccctggttgaagaaggaaattattcatttttatgggattcatatggtttatgataatgcagttattgcattcgtcattttttcccaagactcattttggtgttttgcaaggcgcatacccaaatcccgctctctcacttgctagttctcgtatgttgggcagtatctctgtctgcagattaaactttgcagcagtaagagggaaggctcaacctgtctgcctcatagggctgtcgcgattaaaaggaatcagggctgagaagtttatgagtgtcactcagcagccagccatgagcagccactaaaaaaggagtcctgttatcatggttgtctgatatctttgacaacttataattttgtgttacaccataattcttagaacttaattttatatttggattttacatacatagctgagatctgaaagaagaagcccatattttatttaatgttaatttttaaaaatttctctccagctgtattgaggtaccactgacaaataaaaattggtgtgtatttaaggagtacaatttgatgctttgctgtatgtatacattgtgaaacaatcattgtatcaaggtaattaacattttcatcacctcgcataaatgctgttttctcctcctcctcctcctcttcctcctctttctcctcctcctcctcctgctgctgttcttggtaatgagaacacataagatctactctcatagcaaattttaagtacacaatcctatattgttaactgtggtcaccatgctgtatgttagatccccagaacttatttatcttgtgtaactaaaacttcatattcattccttcaccaacatgtcttcattctaagcaccccgcccccagcccctggcaactactgttccactctattcttctgtgagttatttaaagtgcactttcggaggctgggcatggtgactcacctgtaattccagtactttgggaggctgaggcaggcagatcacttgaggtcaggagttcaagaccagcctggccaagatggtgaaaccccatctctacgaaaaaatacacaaaaaaaattagctgggtttggtgatgcatgcctgtaatcccagctactcaagaggctgagataggagaatcacttgaacccaggaggcagaaggttcagtgagccaagatcatgccactgcactccagcctgggtgactctgtctcaaaaataaaataaaataaataaataaataaaatcaattgcactttcgtgattatgagttagaatagtcaaattaaaaaaaaggttcatgattacagtgttctcttttacatcttaaagtttcagtaaatctcactaataatgacttttgggggtgttcagtttttatagataccttttttctatttctttctgtgctcctgttcctctgccttagggcattgcacatgctgatctgctttcacgtgcatttttcagcatgttcttcttcttacttcatttccagtcgttctacatcattggcttctactcagccttcaggcttcattttagatattacttccctaggagtgtctccccctttagaccaggtgaggtctcttgataacattttctttcctagaattgataaccattttctttcctagaattgataaccattttctttcctagaatttctcatggcttgccattttgtatttgttatttgttgattttctgtcttctttgacagtaagcttcatgaaggtgcagatcatatctgtgtaggccactgtttaatcttcactacctacctctccataaacacctgtgaaatgcatacattcatgcctcgattaggagaatgaactggacattctcctaaaagggaatgctaggatcagaaatttgggagctgagtatccgagtgactgatctccaccccagctgacatcactcaaaatctctgggatcatggcctgcgggtctgcatttgaaggattacaattctctgaagttggcctggtgcaggcaagaggggctcatgttgaggctcaaccccatccacccccaagaattccacagtgtgttttcagtgaggatgtcagtgttctcttatctctgttgctcacactcattaagctaactgctttgtgacctgacctgatgggggccccagtgtttggacacaggtttgcttcttgaccctgtatttgtcaaggtaggctagctgctataacaaacagcccccaaataagtaaaagtttatttctcatttgtatcacagccagctggggtggccaaggtatcctctaccccatgcagcctttcagggatccaggatgctcctattgttgtgcaccaccttctagggcagctcttctcaagtgagactccttgggaggattaggcgctgttgctgacggcagccactgtacgtaatgcattaagtaatctcctccccatctagcatggtgttagatatggaccatccttgggagagttgagaaaagagtcacctgatttgttctctgtttggttttattttcttatggaggcccagttcagagagggtggagggatcttgtttttcacctggctggtggtagaagagaggataggaatatcttattcctctcgttgcccagcccagaggtgactcacatcacctcctcacattcactcacatcacctcctcacattcactcaatctgcttgtgggaatcacttccatggtcctgtccaggtgcaaggaggtcacaaaatgcacttagacattagcccgagaagaagaagaaacaaacacaggtattggtgagcatatcaccttgccccagtcctatcccatatcaagttgtatttgcaccatagaggcagaaaaaaatggagtgggtattttcaattaagttgcatttatttgcacgaaggtttgacttaacttgcctttgctctttctttataacagatgatagcttgtcctgaaactgagactcctgccgtgataacgtgtgacccactgtcccagccttcccctcagcctgcagacttcacagagactgaaaccatcttggtattcctcatctatatgacctacacatggccagctctcttattgcttgttattttctcacagggtctatccccattacataccagtgggggcgccataggcttttaaaaattcctcccttttttttttttttttttttttttttttgagtggtttctcccacctggaataagttgtgttataattagtctatttctctattatccaggtggataaggaatctggctgtctgttcgaacttattgtggggttttctttttcgtcattttgttattctcttccactttgcttaaaaaaattaataagaaaaagatacagcgtctatatagcatctatgtctccattaatttttttaaacttttgataggacttgcaccatgtctaaaatcaatattccatgactatggattttattttaattctttttttctctaagtttacccttatgaatctgggcttttattgccacatatcatcagaaaactggctttatggacacccccctgtttttaaactctcaaagagactatcttagtaaaatgcttctgtaggcatttggtataaacaagtcaaatctctctctgaaaatttaacttccatgaattgcataagaacttgtagcatctcctcttgtctgagacttggtggatggctcagaaaaagtgaggggagagaagctgagctatttttagcattcccagaaaagaagatcgagtacagtccatcagtttttttaaaaaagttaattatagtgccggccgcggtggctcacgcctgtaatcccagcactttgggaggccgaggcgggcggatcatgaggtcaggagatcgagaccatcctggctaacacggtgaaacccccgtctctactaaaaatacaaaaaattagctgggcgtggtggtgggcgcctgtagtcccagctactccggaggctgaggcaggagaatggcgtgaacccgggaggtggagcttgcagtgagccgagatcacgtcactgcactccagcctgggcgacagagtgagactccgtctcaaaaaaaaagttataataaagatgaggtcttgctattttgccgaggctggtctcgaactcctgggctcaggcaatcctcctgccttggcctcctaaaatgctgggattacaggcatgagccaccgcgcctggcctcaacccaataatttgattttattttaccccaggataaagagttctccatcatttaggttagggctacagttccctgcagcccaccgcagactaatgatggaatggttatgttttagcagccagcaaataaagtcgaaagtgtctcatccgaggaaaccttcgaaccaagccaggaactccctgctgaggctctcagggaccccagtctgcaggatgcactggaggtggtatccaaattcttccccttgcccaaggctcccggtgggggccatccaccgtcactgaggtcaactgcatgcacacaacagctgttaatttttcagcctcatttaacaaaaaataagaatcggcttccctcttcccctgcctctgattcttctgtcttctctctggcatttgcctggggtgatcggccgactctcttttgccatcttcaagtctgatcatcacgctttttctctctttaaaagctgttctgcagaagggatcaggagggaagttgagggactgtggaaattaatgcgtagcaatccattttctgaaatgaagagattaaaagctgaaaattggagggagtggggcatgctaatgttcgaatccaaatggggcatgcaaataatttcttctttcaggatgaaatgagagatgcatgctttctgttccttcctcttagagatgttttcatcttcaactacgttctctccattgatgcatttaatgaaagcaattgctaacgttttctcttgctctttaagcatgatctaataatgccatttggtctttaagtaacaatcaatacagctctagagctaggtttaggtctagactgaaagttggtattgaacgcatgtttagagtgtgacctactgtgttggctaaatgccttccctggacagtcacccttggagaaaatgtgaacttgtttttctcattcttacttggttactgttcaaatgcagcattttgaacttaatttctagagctgttggttgaggtccaggtttcttataaacatgtgaatgtatcccttcagcatgttccatccttgtggtcatcatttgaggctctgtgaattgaatctgtagttattagtgagtgacagggcatcagtgtgaggttgggtaagacctacgttggacagctcagccatgtggtaggtttgggatcctggatgagttcattactttttctttttaaaaattattattattattattattatttagggacagggtcttgctgtgtagcccaggctggagtgcagtggcatgatcatagctaagcagtcttcctgcctcagccttccaaggaaatggaactacaggcatgggccactgcaaccagctaattttttatttttattttttgtggagttggggtttcactatgctgtccaggctggtctcgaacacctggcctcaagtgatcctccttttttggcctctcgaaatgctgggattacaggcatgagccaccgcgcccagcctgagttcattactttgcttcagtgttcatgaggtggagactgggttgcccacctcacagaattggaaggaggggtattaaaaaggagagtggtatagggaaagccctagttagtgcttggctcataaagatgaggaagatttcggtcattgatttgctaaaccggggcactttgacctcctgtgtgtccacactgtcctctaggggaactttatttagtatcttgtataataccctaattcataacattggagcagcttgttgttttcttggatactcatctcttgttagcagaaatgtcacaatcactgtgctgttttgtcttgaaaactagtataaggttgggtgctgtaggtcctgttaattccagaaacatttcattctcaggaactgaatggatctaaatgcaagtgctcttagaggggagaaatgctgcagtatcctgaagtggactttttaatttatttgttaactcttgctatcaccttaatcaataggatggctgtctttaaataaaatataatatatgggaatgagtgtagaaggcagaatcttatatgtaaaaaccttctaaaaacactgcggcaagtaattagagaagaaagtagtatatgcctatggtgtaaaaactcaaatttatctttctatatatctatctctatacatatcatgtatctatctatctacctcttatctattttctttttttttttttttttgatggagtctcactctgtcacccagtctggagtgcagtggcgtgatctcggctcactgcaacctccgcctcccgggttcaagtgattctcctgactcagcctcccgggtagctgggactacagtcacccacgaccaagcccggctaatttttgtatttttagtagagatggggtttcaccatgttggccgggctggtctcgaactcccgacctcaagtgatccacctgcctcggcctcccaaagtgggattacaggcataaaccaccacacccggctatctatctattttctatcatctatctcatctatatatccattcatcctcacatctagataatagatacatagatatagaagagataaaacataggtagtagatagagatgatagataaatgaatgatagagtgatagatgatagataggtagataggtagagagatattttagataaatagataaatgatagagtatagaacggatggatggatggatggataaatggatagatagattgatagaaagtagataggtaggtagagatcatagatagataaataggtagatagatgatggagtgatagatgacagatgatttattgataaatagaatggatggacagatggatggatggatggatggatgagtggatagatagaacataggtagatagatgagatagatgatagataatagatggttggtagatgagatagatgataaatagatgatagatagatagatagaaagatgtgtgtgtgtctattattgttaccatctttaaatttttaagagtctttttctagttcttggtaagaagtgtttaaagcaaatgtatttgttctttttgttgactcatctgaatgccaaacaaaatgtgtgtgtgtgtgtgtgtgtgtgtgttgttacacacttgcattttcatctgttttttcacatgacccttaagaaggcaggaactctgccattgaaaaaactatctgaattattatttaaattcctttgccaagcagtccaaattcttataggctttacttacaggaggtgagttgttttttcatttaacgtagtttggttattcactgtcatacaaaacagaagttttggtgggtgagagtattaaattagtgtgtgtgtgtgtgtgtgtgtgtgcacatgcgcatgtgtgcatgtgtgtgtttaaaatggtttagtggctagaaatgaaaacaattcttcagaaaaagagaacatatacaattacattttataaaatttcaaaacacttaagcaaaaaaaattatcttctaagcatattatactaaatctagtgtatatttagctcaaaagaaaagtgctgctgggtgtggaggctcacacctgcaatcccagctcactgggaggccaaggcaagaggattgcttgagcccgggaattcaagaccacactgggcaacataatgagaccccatctgtgcaaaaaatacaaaaatcagctgggcatggtgatgtgccctgtagtcccagctactgaggaggcagatgtgggaggatctcttgagcccaggaggtcaaggctgcagtgagctgtgactgcaccactgcactccagcctggacgacagagaccctgtctcattaaaaacaaagtgctagtgattcgcaatctctttttgagaactgagatgcatctttctgcgggaccctacactggatgggttttagcagtctttccctcgataatggacagctgcaaaaaccatctcccactgactgtcttccctaggtcgacctggccgtctctgtttcccagatctccatcgaagagaaggtgaaggaattgagccccgaggaagagaggaggaagtgggaggaaggccgtatcgactacatggggaaggacgcgtttgctcgcatccaggagaagctggaccggttcctgcagtaatccggcagctggtgggcgttgtgtgtagttagacaatgtcctgttgggtggtcctgttgcgtggagatctcctctggtcctttcaaagggaaacgctgttgaaccttgtgcctctatttatgcttaatccatttgagtgcctcacacaaaaaacgtagagtatagaaatccaccttaaagcccctcgccccaacttctccaccaacgccttctgggctttcttcagaggtcacttctacccttgaagctgtcggcaaaagcgagcagtaataacattctagtagactctcgatggtggtctccgctcttgcccgaaggacctctgaagtacgctggagctgtgttgtacaggtgctgtgagacctaccctattcagaattaaacctcactgcaaatttcctcccatcacgaagctaacaacactaatatacgtatttagcacctctgaggctttgccatggagacccatttctgtagggctaaggaaacatttagacgtggtgactgactttcatttggacttggcgaagtgtatctgagaaacacctcggctgtggtctctctgctttaaatcctaacaggacttcctagagcgttgacagaaattctactcgtggacgttgggaagaaagattgtaggtggcttggggaatgtgggtggcttagaggatctaaaccgattcacttcctggttgagaagcaacgagggcttgctctaaatcgtttagaggataacaggatctagagatgctctctgcttgacaacaaaagtcagggtgcagtcggtccacccttgactgctcttggcttggtctctaccctcactacctcagttctcaataacttagtgaatcactgccctcctcaaagccatttccactcagctctttccagagaattctcagttttatgagacgggaaactttatttcacgagaaagcctcattgtcagaagtatcttcattcaatgggcacaatatgctgtgtatctcaccaggtagctgtcaggggccaccgagagtgtcgttaaaaatgggcatggttgtaataaaggaggaaagtgcgacttttgaaatgtttggaaggtttatttctcatgcacattccagggaaaagcagagagtaaattagagacgggataggaaggccgtgggagaactcgatcctagcctgtgtcagctggatgtgtttacgtggagaggcgtggccactttttaggtcacctgaagcagtttagcctttggatagaggaacctgcctgaatttatggcattagtggtggcatttttttgtgtacaagatgtgggtgatggaggggctgtttctttttccgtgtgggtggttaataatcgtcagtctcggagggcgaggctcgtaggatatttcaggtgagtcagggttggatggtcatcggctttcagaaggagaccacgggaatgttcagggaaacaatgtcagcttctctgaggaccagaattcatgttcacgggcagtgatgagttggcttatggagtgagtccagtctggaattccgccgtgcattctagcctgtatcatctcatttggacaaatgctggcacgttgaaattaaaatgttaaaaaacagccatgtggcctccttccagtgtgtgtttgcctatttcctgcgatatcaggcttatattttatattaaaccaagggtagggcctttctattttattttcggccttttctattgtattttgtttttaaaatagtaagcatcgggctgggcgtggtggctcactcctgtaatgccagcactttgggaggctgaaacaggtggatcacgtgaggccaggagttcaagaccagcctgggcaacatggtgaggccccgtctctaccaaaaacacaaaaatattagccgggcatggtggcacacgtctgcaatcccagctactggggaggctgaggcacaagagttgcttgagctggggaggcagaggttgcagagagctgagatcacaccaccatactccagccagggcgacagagtgaggatctgtctcaaaaaaataaataaataaaatataataataataataataagcattatttgagctggaattgcaaggtaaaattttaacagtaaacaataaacatactttattttatttttgatttaaaatgttttttaactgtcatgtaataattgtacatatttatggggcatgtagtaaagttgcagtacacgtcatgtctactgatcaggtcacgggaattagcatatccatcatctccaacctgtaccattttttgtgttgggaacattcagtattctccttctatatatatatttgaaactatataatatatgattttgagctgtagtcatcctatagtgctatataccagtgatccccaacctttttggcaccagggaccagtttcatggaagacaatttttccagaaaccaggctggggggatggttttgggatgattcaggtgcatgacacttattgtgcactttatttctgttatgattacattgtaacatgcaatgaaataattatacaactcagcatcatgtagaatcagtgggagccctgagcttgttttcctgcaactggacagtcccatccaggggtgacaggagacagatcatcaggcattcgattctcataaggagcacgcaacctagatcccctcacatgcacagttcacggtaaggtttgcactgctatgggaatcttacgcggccgccgatctgcaggaggcagagctcgggtggtaatgggagcgatggcgagcggctatcaatacagatgaagctttgctcactcgccgctactcacctcctgctgtgcggcccagttcctaataggccatggaccagcactggtctgcagcccaggggttggggacccctgctatagaacactagaactaccttaaaaaaaaaaaacccaaaactggatctcatagaagtaagaactagaacagaggataccagaggtcaggaagggtagggagaaggggtgatggggagagatttgttaaagggtacaaaattacagctagataggaggagtcagttccaacaataaatttaaattatcagatggatttttcagaattgctggtcacagtgaaatgcatagaactgtttacttctaactttttgcgatcttgcaggatctctttaggaaaggtacccattttctgaactttgctttgtcagtttcattcattcattcgtcatatgcttattgagtgctctctttatacccagctgtgtgacatgggacaaatcaatacaccataagtttgggaatatacacttttttccacgagaaatcctcattgtcagaagtatcttcattcaatgggcacaatatgctgtgtatctcactgggtggctgtcaggggccaccgagagtgtcgttaaaaatgggcatgttgattgacgtctcatgtctccctagaatatataaaaccaaactgtgctttggccaccttgggcacatgtcgccaggacctcccgaggccgtgtcgcaggtgtgtgtcctcaaccttggcaaaagaaactttctaaactaactgagacctgtctcagattttcagggttcacaggtacagtgctgagtacgtgggtgggggtacctcactaccatagaaaataccctagtgacaaaccggcacgtgtaccccttagacctaacataaaagttgaaattatttaaaaataaataaataaatattatgagattattatcttgtggcaagtggaaatgatgtgggaaggaaaggatttctagatctgtcgaattggcagggtggattgatgcctacagatccacaggaataagttatagtatttttgttcctcaaagccacttggtcgaatcctgccaaaacctttggctgatgcttggaagcacgaaacaggtcctagtgttaacgcgttttggggtggaactgtagtttgaagcagaaaggggtttctttctgaccaccacccttgaattaggaaaagcagagcaattctttctggtttcataggcctctgctctttagtgtacagtaccattttaaaaattatttatttatgtatctttggccgattacagtgactcacacctgtacctggtactttgggaggccaaggcgggcagatcgcctgaggtcaggagttcaagaccagcctggccaacatggtgaaaccccgtctctaccaagaatacaaaaatttgtcaggcatggttgtgcatgcctgtaatcccagctactcaggaggctgaggcaggagaatcacttgaacccaggaggtggaggttgcagtgagctgagatcacaccactgcactccagcctagacaacagagtgagactctgtctcaaaaaaaaaaaaaaaaagaaagaaaaataaaataattaaatcatctattttaattattttattattttttatttttatttttttgacacggagtctcactcttgtccaagctggagtgcagtggcccgatcaccgcttcctgcagcctccaactccagggctcaggtgatcctcccacctcagcctctcaagtaactgggattacaggcatgtgccaccacacccagctaatttttttaaactttgtagaggcagggtctcataggagtctcactatgtggcccaggctggtctccaactcctggcctcaagcattcctcctgctttggcctcccaaagtactgaggattacaggcatgaaccactgtgcctggcccccattttttttaatagatcaaatgagttgcataggtttacaaacttgatgtcttctatccctgctctatccatcatcctaagaaacaaaatgaagtttttattggcacagacaatatctgttggaagcacattcgtgcaaatccagctatacctagtatgtgacatgtactgtgcaagaatatactttacacgggattgtagcatgccttgaggatgcttgtctggattccattgcatagttgctaaatgctgatgctctgtgagtctgtcattattgcagcattcatggcccaacactcagctgcacaaaagagcttttctgtttctctttccctccctagcacactcctcttgactatcactactatgttttgattgttcaacgtgtaaaacagtccaatttattatttttttaatgtttaaactgttcctttttttttttttttttaaacgacacagggtcttactctgttgcccaggctggagtgcagtggcatgatcatatagctcactgctgtctcaacctcctgggttcaactgatcctcccatctcagcctcccaggtggctgggactacaggcaagagccaccatgtctggctcaaattgtaccagatttaccagtgggactctcctcactttagatggattcttaagtctatgaactaatcccattagtctttttaaatttttatttatttttgtttgagacagagtctcgctctgtcacccaggctggagtgcagtggcacgatctcaactcactgcaacctccacctcccgggttcaagtgattctcctgcctcagcctcccgagtagctgggattataggcgcgtgccaccacgcctggctaatttttgtgtttttagtagagacggggtttcgccatgttggtcaggctggtctccaactcctggcctcaagtgatctgcctgccttggcctcccagagtgctgggattccaggtgtgagccaccgcacctggcccccattagtctttgatcacttccttgcttcctggcaaaatgagattctccagaaccatcatagattttctcccctcacacctggggccaggcatttctccaaggtcttatttttaagaacaagccaatttttatgttctaaattgacttcacacctcctcagggaaacgcagccagtagtttaaaaacatctttgtaacaaatgaacgctaagccccacatcttctctccttatctataaaagagggattacaataccacatgctcatgggaattttctgaggataaaacgagacaataaacataaagctcttagcacagtctgtgggaacaattaagcatgaaagcatgagctgctgctctcattgtcaacatccgattgaaatcttgtttttgagacagggtcttaccgtgttgcttaggctggagtgcagcggcaccgtcagggctcacagcagtcttgacctcccaggctcaagtcatcctcttgcctcagtccccctagtacctgggacgacagacttgcaccaccatgcgcaggtaatttttttttttttttttcagtagagacagatttcgccatgttgcccaggctggtctcgaactcctggactcaagcgatctgcccacctctacctcccaaagtgctgggattacaggtgtgagccatcgtccctggccttattgagatctttagagatactgccaataacttgggttttaaaaattatattgcttgagcccaggaggtggaggctgcagtgagccaagatcacgccactgcactccagcttgggtgatatagtgagactatgtctcaaaaaaagaagaagaagaaaaaattaccattaagataaaaaatgtttatgactgtgtatgacgtttacaaatttagccagcctacgcaacagagcaagaccctgtctcaaaaaaaaaaaaacttagaaatattagtaaacatggtagacgcctgttcattaattctgcttgaacaggtggtcaaggaaaagaaatgacttgaatacagctaagggcttttattcagcagatcctcaccagacggcccctgtgcacagataattgattcactgtggcacagcaggatctgagttttgtaagatgaggagagaggggtacatgtttttgaggactggcccaaatttcacttttctggccaggcgcagtggttctcgctggtaatcccagcactttgaagggccgaggcgggtggatcacttcaggtcaggagttcgagaccaacctgacaacatggcaaaaccccatctctactaaaaatatgaaacctagccaggcgtggtggtgtgctcctgtaatcccagctatttaggaggctgaggcaggagaatcgcttgaaccttggaggcggaggttgcagtaagccgagatcgtgtcactgcactccagcctgcgcaacagagcaagactctgtttcaaaaaaaaaaacaaaaaccaaaaaacaaattacacttttcttcatcttcagctgttgcaaaacctggcatcgtgtccattggagactgtcgttgctgtggtttcaatacctctttcatggtattatgggtgcaatcccttttcagcaactctcagaacagtttattttgcaaggctttgcaatatgtcaaggttcaggggaaagtgggggtaacaaaaagggaggagaggagaaaacggaagagaaaaatataggaaaaggaggcaagagttgaagcaacataaactggggtctctctatgttttattgtagtgcaaacacaaaacattaaatttattatcttaaccattttcaagagtacagttcaggccagctgcggtggctcatgcctgtaatctcagcactttgggaggccacggtgagtggatctcttgagctcaggagatggagatgagcctgtgcaacatgatgaaacctcgtctctacaaaaaaaataccaaaatttaaaaaagggggggagtagagttaagagttcagtagagttaagtctaatcacattgctgtgcatgggtctccaaaactttttcatcttgcaaaactgaaactctgtgcctgatagcagtggggagatccgagttaccctgagttaccagtggcgaatctgtaggggtctgcggcaatttcaatacttgcctccttggaagaaagaatttgactgagggcgtaaggcagaaaaagagaccaaggcaagtttcaaagcaggagtggaagtttattttaaaaagccttagaacaggaggaaaggaaggtactcctggaagagatgcaagtgcatgcctgaaggtcaaagagagcgagagcgagggagtctaaccttgatcctgggagtttacgtgctggcctctttcttacccatgattcttcccttggggtgggctgcccacataagcagtgccctccttacccttggaaagtgagcatgtgcggtgtgtttagggattgtacgaatgccggtctgagactttcttccttttctggtggaggctcccggaaggtcatacttcatacttcaccatttcatctcttttccctggcatttgcagtcaattaacactttaatgttaatagctgtgttactggaaaggagtccagatccagaccccaagagagggtccttggagctcgtgcaggaaggaattctgagtgagttcataaagtgaaagcaagttttttaagaaagaaaaggaatacacgaatggctcttccatagacagagcagccccgaggtctcctggtttcccatttttatggttatttcttgatgatatgctaaacaaggggtggattattcattctttccctttttagaccatacagggagacttcctgacgttcccatggcatttgtaaactgtcacagcgctggtgggagtgtagcagtgaagaccaccagaggtcactcttgtcaccatcttggtttgggtgggatctcgccggtttctgtactgcaacctgttttatcaccgagggctttgtgccgacctcccgtctcatcctgtgactatgaatgcctcacacacctcctgggaatgcagcccagcaggtctcagcctcatgttacccagcccctattcaagatggagtggctctgcctccagtgcctctgatagtgtcacaggccgtgctcactcacatttggctcagaataaatctcttcaaatattttagagttttactctttatcggcatcatcttgtccaattccaatgaggagctcttgaaagctaaaaccaagaagtcttccccatgggagaagcacccccaaatcttgttctcaccaatcaggcgcattcgcggttcttcctttcctccccttctcctcctgcaccacttgctgcttcccttctcccacgaatgctctccaggacctgctgcacttctcacagtgccctaactctcggctctgcaggaaaatgacttcacaggaatttctccttgtaaagattttataacccaatggatggaccctgatgggacaaaacccaggggtgaaaaattaaaatggcaatgttactggagacgggtccctatctagattccaagagagggttcttgtgttgtacccgagcgagttagaaaaacgccacactttgagacgatttaagagtcctttattagccggcgaccgagagacggctaacgctcaaaattctctcggccccgaggaaggggcttgattaacttttagatcttggtttaggaaggggagggcggggggtctagtgaaaaccattttacagaagtaaagtaggcaaaaagttaaaaggataaatggttgcaggaaagtaaacagttccaggtgcaggggctttaagactattatagacgcgaggctttgggcgttactaatcagacgaattcccgggaactgcggatgtagctcgccacagtatcttatcagttaactgcattcttggatgtgctgggagtcagcctgcacgagttcagtccttgaggaaggggctgccagtgaaagagccaaggtggagtctggctggctctcttagctaagggagagtccattcaggtggaaagaaggctaggtgagtagaggaaaagggagagtctaaaaacaggttagtaaaaaccaggttgggcattacacttggatcttgcggcaagaaagaattcggggcgaatccatagagtaaagtgaaagcaagtttatcaagaaagtagaggaataaaagcatggccactccatagacagagcagcagcatgggctgttggttgccttttttaatggttatttcttgattagatgctaaacaggggttggattattcttgagttttctgggaaaggggtgcgcaattcccagaactgagggttcctccccttttagaccatatagggtaatctcctgacattcccatgacatttgtaaactgtcatggcgctggtgggagtgtctcttagtattctgtgctttataattagcatataatgagctgtgaggacagccagaggtcacatttgtcacctcttggttttggtgggttctggccaggttctttcatgcaagctgttttatcagtaaggtctttatgtcctgtatcttgagctgacctcctatctcatcctgtgacttagaatgccacacctcctgggaatgcagctcagcaggtctcagcctcattttacccaggccctattcaagatggagtggctctcattcgaaagcctctgacagcaagattgaaatagcttcaggagggctcatccagctcatgggctattctgaacctctctttccttccttcattactgtcttctaccccagttcgggtcatgtgacttggtgacttggcctctgtccaagaacactgagatatcttatttgtcattttgtacactggtcagtgatcttgcattcaaatggatttcttctctcagaggggagtccattggggaagtgaagggtcaaaggccagccagaattcataggatagagtcggcagagagcctggaaagcgggaatcttgttgatggctggcagaggccagtataggcattctgccttttaggaggttgcgtagagtcttgtagaagacaatggcagctgtttgggcattctttggcagtgttgtggattttgctgttgctatggtctcaatgcttgccttgaacattgtgtgccttgaacattcatgtgttgaaacttaatccccaagacaatagtattaggagatggtgcttttaggaaacaattaggggtctagactcatcaatgggataagtgtccttataaaagggaccccaggccaggcacagcaggtggctcacacctgtaatcccagcactttgggaggccaaggcagctggatcacctgaggtcaggagttcaagaccagcctggccaacatatagtgaaaccacatctctacaaaaaatacaaaaacaggcatggtagcacacacctgtaatcccagctaattgggaggctgaggcaggagaatcgcttgaatccaggaggcggaggttgcagtgaactgagattgtgccactgcactccagcttaggtgacagacagagcaagactccgcctcaaaatataaaattaaattaaattaaaaataaaataatgaataaaataaaattaaaaaggtgagccattgtgatggatggaaatcacgtaaacctggaccaattcaggcaaagatgttgatgggacatcacgggtaatagccattcctcagagactacctgccaaattgctccccagctgtcttagtcaatttaagctgccataagaaaacaccatagactacacggcttaccccaaccagcatttgtggctcacagttctggaggctgaagtccaaggtcaaggaatggcagattcagtgtcttctgaggacccacttctgttgcctggtccaggctaaactgtaaccataataggttcgttgcatgcagcatgtctgtaccccaactctcagggctgcagaagagaaagaggtttaatcaaaaagaaagaaagaaagaaaatgaaaatgaaagagacacacagaaacattccactggttacagctcagcgtttgccttatttgaacatggttagaacagttggctccctgtgagtggttgaagtatggctgctgggattggtggagatgtcgcttgttacagaagcatactcttaagttaggtgatatggtttggatgtgtgttctcacacaaatctccagtgttgaaggtggggcctggtgggagatgaccggatcatgggggcagcggtttctaatggtttagagttctcacgagatcgggttgtttaaaagtgtgtgacacctccccactctgtctcggtcctgctccaggcatggtaagacacgcttacttcccctttgccttctgccatgactgtaagtttcctgaggcctccccagccatgatctctatacagcccgcggaaccatgagccaattgaacctcctttctttctaaattatccaggctcaggtagttctttacagcagcgcaggaacagactaataccttagcttttcagtccgcccgcctacctgccaagttaggttacggttcacccacaaggactcaagtatgagagtacagagacattctcaggccagattttagtttgatttaatagttcagattcttctgcatccctgtatcttcagaaataaggatgttccctaccatttgatccagcaatcccattactgggtacctactccgaggaaaagaagttattatttgaaaaagataagatacttgcacatgcatgtttatagcagcacaattcacaattgcaaaaatgtggatccagcccaaatgcccatcaatcaatgagtggattaaaaaaactgtgatacatatatatatacacacacacacatatatgtgtatatatatatatacacacatatatgtatatatatatacacacacacccatatatatgtatatatatacacacacacacatatattcattcctttttatggctgagtagtattctatcatctatatatatatatatatatatatatacacacacacatatatgtgtatatgtgtgtgtgtgtgtgtgtgtgtgtgtatatatatatagatgatagaatactactcagccataaaaaggaatgaatgaatggcattcacagcaacctggatggaattggagaccattattctaagtgaagtaactcaggaatggaaaaccaaacattgtgtgttctcactcataagtgagagctaagctatgaggatgcaaaggtgtaagaatgacacaatggactttggggtcttgtggagaagagctggaagggggtgagggatagaagaccacacacattgggttcagtgtatactgttcaggtgatgggtgcaccaaaatctcacaaattgtcactaaagaactgactcatgtaaccaaataccacctgtttcccaaaaacctatggaaacaaaacaatttaaaaattttttaaaaagaaattaaggatgtttctttcctctgggtattaaggcacctttcaaatgagggtggtttgacctgcttcaggagagaaagatgagaggaaggtcagagagaccatcccgcttctgctgttttctccaatgccaaggggccatgttttggggcggcacgtcctgaaacccctcacaagcaacataaatgaacctggattgcttaaacaacaccatccaggcatggtgagtgtgtggggtcattcgaagagtaaggaacgtagaagagctagtgttataaaatggcgaaatcaagaacagcctgtggacagcatgcagcggtggctttatgggattactgttgtgagatgctcagggtgaacgtgggagaatccaagcctgagaccctggctcctccttggcttggatcggggagagcagaacaccttgatctactatcccaccttgtcccctgtagggaagtagaagagccatagccacgtgaggtgatgtccgtaaaagagcgagattgctgtgtgacatacagaacaaagcccaccgccacattctcccttcctgattcttcagcctgatcagaatgtggctttgttcatagactaatggctaaattggcaaaatgccccaagatacggagttgcagttgcgaaagagccacgattgctgtgaagattgtagaagctgtgatctgcaaagcacggagagcaaggcctggctcatgtcaaggactcaataaatgtcacagctgtactcattatttttaccctgaggccacatcctggcacagggagaagggtgattatccattatacgaggtctggctgtggattgggatggcagtgcattagctgtttcttatgtgcatatagagaagtctgctcaggggctgtgtctttgcaagctcatgccctctaagcagctgctttagaacaggtgaaaattggccaggcacagtggctcatgcctgtaatcccagcaatttgagaggccgaggtgggcagattgcttaagtccaggagctcgagactagcatgggcaacacgacaaaacctcctctgtataaaatatacaaaaattagatgggcgtggtggtgcacgcctgtggtcccagctatttgggaggctgaggtgggagtatcactagagcttgggaggcagaggttgcagtgagcaagattgtgccactgtactccagcctgggtgacagagccagaccctgtgtcaaaaaaaaaaaaaaaaaaaaaaaaaaaaaaaaaaaaaaaaaaaagccaagtgtgtggctcatgcctgtaatcccagcactttgcagggctgaggtgggcaaatcacctgaggtcaggagtttgagaccagcctggccaacatggtgaaaccccgtctctaccaaaaatacacacagaatattggccaggcatggtggcgcatgcctgtaatcccagctgctcgggaggctgagtgaggcaggagaattgcttgaacccgggaggtggaggttgcagtgagctgagatcaccccactccactccagcctgggcaacagagcgagactctgtctcaaaataaataaataaatagaacaagtggaaataaatgagacgtcccccatcccaaatgttttcgtcccaaatgaaaatgagcagaggccacttattcagagctagccctagtaagggagtcagacatcaccctttgcattttggcagggaccgaaagacaagtagaggaggctttatagtgtcagacctcaggatacacgtccccaaacatgactgctggcaaccagaatataccagcccaacatacccattactttgagctgaaacactgagaaccagctaatacaagaggagctctttacttgctcctcgacagctaaaaataaagtacaaatttcccctttgaaaagagaaatttaggccagacatggtggctcacgcctgtaatcccagcacttttggggactgaggcaggttgatcacctgaggtcaggagttcgagaccagcctggccaacatggtgaaaccccgtctctactaaaaatacaaaaattagctgggtgtggtggctcatgcctgtaaccccagctactcaggaggctgaggcaggagaattgcttgaacccacgaggtggaagttgcagggagccgagatcatgccactgtactccagcctgggcgacaagagtgaacaaaactccatctcaaaaaaaaaaaaaaaaagaaatttttgttttgttttgttttgtttgtttgagatggagccttgctctgtcgccaggctggagtgccgtggtccgatcttggctccctgcaacctccccctcccgggttcaagcgattctcctgcctcagcctcccgagtagcacaagcacgtgccaccacgctcagctaatttttgtatttttagtagagacggggtttcaccatgttggccaggctggtctctatctcttgacctcgtgatctgcctgcctcagcctgccaaagtgctgggattacaggcatgagtcaccccacacccagccgaaatttggtaaactcaatcaagtttatttatttatttatttatttttttaatgggtcgcgcttttggtgtcttattttcctaacccaaaacgaaaaagactttctcctctgttttcttctgcacatgttatagagatcgcacttacatttgggtctctgatccactttgagttaattttggtgcagggttttccattcacggaacatgaagttggatttctaataggtcaatatatgaaaaatttcccgcaaagtttttcttttcttttcttttttttttttttttttgagactgtcacccaggctggagtacagtggtgcaatcacagctcactgcagccttgacgtcccaggctctagagatcctcccacctcagccttccaagtagctgagaccacaggtgtgcaccaccacgcttgcctgattttatattttttgtacagacggggtcccactgtgttggccaggctcgtctcgcactcctgggcttgagtgatccttccacctcggtgtcccaaagtgctgggatgataagcatgagccactgcactcggccagtttctagtttggatatttgagtggacttcccagcccccacacagcatgctcatttcgtgtaagattgtgagagagtgcgaggagagaaagagcatgcagccagcgttggagcttcggagacatcccgggcaggagcttcccagggtctcatttgttctgtctcatggttggcacacgaaggacagtgagaggaatcttggtttcagggggcctcaaaccagacatttgaggaggtaggggaggcggttgccactccgctcattcagtgcatccaggctgtctaactggttaggccacttgcaaatgtgcaaaccttaagtaaagaaacagactctggggtcaggggggaggtttgaactgtaactagcgcgtcataaatcccagcccttatcttgaacaagagtcaaagaccggacttgaaggcatcccccaagataaaggtaggccctctgcagggcagctgtaagtcagctctcctccacccctctggctggccccctccttatccgagtcctgcttccttcctctttaaatctgcagacaatgctgcttctctgcaggtctctgcatattccctcagctcacagaccggctgcatacttggtattttcagggttaggtttgcaacacatgactggggaaatgcatgaaaaggaaatgatgcaagaattcaccgcggacacctttaggtgagaaggagatgtgacaaaaagtctctgcctggccaaaccgtagccaggctcctgaagcccctcccaggcccggtggtgcgtttccttatagaattagatttcagcaaagtaccggctaagtcagtttggcgagaagccaccattcttgatatcatgttcctcgtcgtccaccacccctggttgatgtttaacccccttggctggctttaacaagccaggttggtttagccaggacccgcttcacctctgatgtttccttttagtgctttgccatctgtacacccgctgcctgcccccgtggctgtacattcccacttgcccttgctgtgttcatattggaagctgagcccagcctctcctgcactgtgaaccgccattgcagtggtccctgtacttcacacgataagcctggataatgtcttcgttatctttttggtgatgctttcccaagtacgaggttcgtgcaaaagtaataactgcaattaccaacctagtatcactgaatagttttttctttaacaaaggttttgctcccggacgaatgaacgagtgctggctgcttgttcttggggctcaacaatgaggtgcagacagactggggagaaggggatttatttctccaacgggttacagggagaaggtcagattaactcaccaggtcagctcaaagtgacaagttttttccagggtttctatgcattttaagctctatgcccacgtgtaggattgcacctacgagcgggagtatttcattcggttcctgtctaatctttaactagggtctggggtctgggaagttttctctagacgcttaatcttcagtgagccctggtatgacgtgtttaacttgtgcatcatcagaattataataaagcgttagtggaaaaactggttgctccggctgctaatggaagcctggcctgccacagtttgactcaaagggaacctaactctcaaggagccataatcccagcactttgggaggccaaagtggaggattgcttgtgcccaggtgttggagaccagcctgggcgacataggagaccccatctctatacataaaagaaaaattagtcgggcatggtggcttgcgtctcttgcctcagctactctggaggttaaggctggaggatcgcttaagcctgggagttggaggctgcagtgagctgtgattgtaccacagcaccccagcctgggcaacagagcggaaccctgtctccaaaaacaaaacaaaacaaaataaaaaacaaaagcaaagagccatacaagaaagttttaaagaatgtattttttaaaagccccagtgaggttttctgcagaaatcctgggtgcttctaagccagccagaacctctacctttaaagcatgtctgctcatgtcataggtcttacaggtatggaggaaagttgaggtttttaaatttaaaaaaatataaaaaagaagatgaacacttctgaatcttcttttttttccttttgagcatgttctctgggtggggaatgtgctatggtttctgaaaacaaagaagaaaacatgtcatccttctgttccaggttctcacgatggtctaagggaatgtgatttttttttttttttttttttaatggatagcatgatagtggcatggggtgacgtggaggccaaggacagagggtgaggtattcagcctggagatgacctttaacctcaaggctttcttccttttaaaatgtttgcagattgtttgttttttgtttttgtttttgtgtttttttgagacacagtcttgctcttgtcgcccaggctggagtggcatgatctcggctcactgcaacctccgcctcctggttcaagtgattctcctgcctctgcctcccaagtagctgggactacaggtgtgcaccaccacacccagctaatttttgtatttttagtagagacagggtttcaccatgttagccaggctggtcttgaactcctggcctcaagtaatccacccgctctggcctcccaaagtgctgggattactggcgtgagacactgtgcccagtcaaacatttgcttttttgacaataatttattgggtttttttttttttttttttttttttttttgaggtagagtcttgctctgtcacccaggctggagtgcaatggtgccatctcagcttactgcaaccttcacctcccaggttcaagcaattctcccacttcagccttctgagtagctgggattataggcgcccgccaccatgctcggctaatttttgtattttcagtagagacggggtttcaccatgttggccactgtggaactcctggcctcaggtgatccgcccaccttggtctcccaaaatgctgggattacaggcataagccactgtgcctggccaattgtatatttcaaaataactagaagagtatatttagaaatgttcccaacacaaataaatgataaatatttgaggtaacggatagcccagttacccagattggatgcctacacattgtatgcttgtatcaaaaatatcacaccaatcccatagatctgtgcagttctgatatattcataaaagttaaaagttttaaaaattgcctggcacagtggctcaaacctgtaatcctagcactttaggaggccaaatgcgaggactgcttgaagccaggagtttgagaccagctagggcagcatagtgagaccccatctctatgaaaaatacaaaaattagctgggtgtgttggtgtgcgcttgtggtcccaagggagcttgggaggctgaggtgggaggattgcttgagcccaggaatttgagaacagcctgggcaacatagcaaaacccagtctctacacaaattttagaaaattagctggaagtggtgacacatgcctgtggtcccacctagttgggaggctgaggtgggaggattgcttgagcccaggtagttgagactgcaatgagctgtgatggtgccactgcactttagcctgggcaacagagcaagaccctgtctcaaaacaaaacaaaagaaacaaacaaaaaaccctcagaaccaactgttcagataacaaaaaatgactttatgattacattaggcccacccaaataatccagaatcacctccccatattaagacacttaatttcatgaaatctgagaagtctgttttgccatgcagtgtgatatggtttggccgtgtccccatccaaatctatcttgaattcctaagtgttgtgggagggacccggtgggaggtaattaaatcatggaggcaggtctttctcatgctgttctcgtgacagtgaataagtctcacgtctttctcatgctgttctcgtgatagtgaataagtctttcgtgatatgctgatctcgtgatagtgaataagtctttctcatgctgttctcgtgacagtgaataagtctcacgagatctgatgattttgcgcaagctcttttctctttgcctgccaccatccttgtaagatatgacttgcccccccttgccttccaccatgattgaggcttccccagccatgtggaactgtaagtccattaaacttctttcttttgtatattgcccaggcttgggtatgtctttatcagcagtgtgaaaatagactaatatacaaggtgacattatacaaggtggttaagggttgactggtgtttcttcccccacaattcatatgtggaagatctatcccctctccatctgtgaatgtgaccttatttggaaatgcagtgtttacagatgtcattagtttagatgaggtcatcctgcaggaggataggctgtaatcccatgactggtgtctttatgaaaagaggaaatttggacacagacacacacagaggagaacaccatgaaaccatggggcagagactggagtgatacaaccaaaaacccaggagcacctggagttgccaaggtctggaagaggcaggaaggatcctcccctatagcctcctgagggagtacagccctgagacaccttgatctcagcctcctggactccaggactgggtaaggataagtatctgttgtttaagcccctggtttgtggtaacttgttatagcagccacagaaaactaattcagacatattcatagactccagggattctgatgtctgtatcttgaacagcatgagggatcattattaagccattggcagggctcggttctaattgtggccatggattgcctttggtctgttggacacgtccttttctctggaacagccatggcaactccatgtgattagattaggatgggattctagggtggagatcccattccaaccatgggtggacatttaatccaggaacggccaagtccttcagccataatgattggtaccaagatgggtgatatcgtttggctgtgtctccacccaaatctcatcttgaattgtagttccataatgtcctaaacattagaaacggtaaatgttagctaacatggcaaaagggactttgcggctataatgagttaagaatcctgagatgagatgatcctggattatcctgatgggttctaagtaatcacaagagtccttataagagggaggtaggagtgtcaaagtcagagaaggagatgtgaagagggaagcagaggtcagagagagagagagagagactggaggatactgtgctgctggctttgaagatggaggaagaagccataagccaaggaataccacagcctctagaagagggaaatctcaaggaaatggattttcttttggaacctccagaaggaaccagcctgctgacaccttgatttttcgacttctgattaccagaactataagaaaaattgtgttattttaagcaattaagtttgtgacattttgttacagcaccaatagcaaactcatacactcctttaatggtcttttaacctcaggtcctctctctctctctttcttctcctcctctttcccttctccttcttctttttctctcaatctctctctctctcattctctttctctccatctgttctctccagaagggcagatgaactttttatttacatgggggctcttgagtccataagagagaagtcagaagctgccaggtctcctaagtctagggcaggaaggatagtatcagcatcacttctgcggcattctgttggtctatgcaaatcagaggctcatcctagatccaaggggaggaaaaaggctccaacttgtagctgggctcatttggaaggtaatgggaggacttggcagctgtaagacatgtaccacatctagacttcaacctacagaaaagtccaaagatacaccaacagcagcccaagttagtcaactgaagctggctcaaggctgccccctttaggtggagactaaccagctccctgacatccttcagttaactgcaccttcctcctttttgctgcctggaatgtctacatgctgcctggagctatggcagccatcttgtgaccatgaggcaaaccctatgtgcaagagcaggaagctggaaagaacctgtcagccctggattgcttcctctgtgacccccattacctgggagagaacacatctttctcttgtttaaggcgttcttattcccagtcgccctctctcccctgtataaccctaaaagcacaggagtacacttgtgactgtgacttaagtttttcagaacgggggagtttggattgtttagtcctctctccatgaatagtgaatagcaatgccaggtgagttccttcaaagctggggggtgaaggggtggaggtggaaaagtaggattgaggatgggaaataaaaacaaacaaatgacaccatccagggagatttgtcacattttattcagtatttctgctgcactgccagcctagggatgcacttgattcccaagaaatgcaactgtcctattcgcagagccgtccacaggtacctaccccctggactgcagcaactttattaccttaactagcacagaacagaggttgatttaaactccttacactcacttctcagatcaatgaatgggcaaagaaacacctcatggctctgggaaggcatgctgagacccgtttttgcaagtcctgaggaatggaagaatatagctgccaggtatcccaagtctagggcagggagggtagtatcggcatcactttcactgcattctgttggtcaacgcaagtcagaggctcagcccagatccaagggcagggaagaggctccatcgtgtagttgggctcacttggaaggtaatgggaggagttggtggctgctttaagacacataccacatctagatttcaacctccagaaaagtccaaagatgcactcacaggagcccgttagtcaactgaagctggttcatggctctcttcttcaggtggagactaaccaactccctgacctccttcggttaagtgctccttcctttttcctgctgcctggaatgtctatgtgccatctggagctatggcagccttcttgcaaccatgaggcaaactctatgtgcaagagcaggtagctagaaagagcctgccagccctgggcttatatcctgcttcccagggagcttaaagatagcaaaacccacagccattttcatcaaatgccaggaaattcttaggctgggattgttgggattgtttgaatggttgagcgtgaaagacttgttataatgggcttgttgaatacggtgaaagatgagatggcttttagctgcctccactccccgtgtcccatgctccatagatgtttctttttttttttttttttaatcattttttggttatgccaggtgtctcctgtgtgtccctccagatccctctccagccctagaaacctgagctctataaatgttgcctctctccactcatcttctctttggcttcaggttgagttcagccaacagatgcccctgtaggatttggacacagggagccaggggagaggggcatcagctgcctggttagcagggctgtgatgattcttctacctatgactctcagtgctgttgcctcttcctctggatcttggaagcttccatgctgaggtctgaaggtggctccctgcctcccactgatgtccttagaatcccatcctcacctaatacctggtattgaacactgcctttcttagatgtcatttaggctctcgtttcaattcccagtatgcttcctgcaaagacctcgatagatggactgaggggaatagtgcaaggtcctcccatccccagtattgggatctaggggcagggggtcccagctgtgcagtaggttaggactacacttccatcatcaaagccacagagggaagaggtgaggatgaaacacactagaattgacttagaaaacacactggccaaatcttagctatttgaggaatgtagggagaaaagccaccttctctctctatgtctgaaggttcccatggctgtctctttgcccaaggggcaaactttccatcagggcatcttctgtgcctctgaggatcattttccaattataggcaatggtagtacgtgtttcagtgcagaatgagatagagttgtttaatttgacaataaagcgatgcgtcaaaaacctcagtcaacacagtaagtgttttcttgttttcctgctgaccaacctaattctggtttcatacagggcagccaggtgcccacctaaaagactgcacttctcaacttccagttgtttctatggataatggttggaagcagaaattgggttggggcttccagataatcccccctcacagggactgcttcaagagaaagggatgccctttggttctttctcctttccactgcctggaatgtgatgtctgacactgtggcagccatactggcataatgaggccaactctctgccatgctaagagtggcagagctgggaattgaaaagagcctgctagccttgggttgcttccccttgatcggctcattacttggaagagaacacacccttctcttattattttctttaaggcatttttttttttttttttttaaggcagggtcttactctgtctcccagcccggagtgcagtagtgcaatcttagctcattgcagttttgacctcccaggctcaaataatcctcccgcctcagcctcctaagtagctgagactacagctgtgcgccacgacatctagctaattatttgttttttgtagagatgaggtctcactgtgttgctcaggctgggtaggtgtctaactcctaggctcaagtgatcctcccaccttagcctcccaaagtgctgggattacaggtgtgagtcaccgtgcctggctttgtttaaggcattctttttccgcagcatctgttaccagcagcctgaagccatttctataacaatatcaggaagacacatggacagagaccctaatgtatgaaaaatgcatcaattatttgagattaatgagtcctcataaacagagactgagaggctctaactttcctccgctatgtgagagtaggaacagacactcctccctgtccttttgtaaggctgttatgtcatctaggtgatgaaattgcaacaatgctttaagacggaggggtgaaaacatcgggcattggcacaatgacgaaccctgagatttagaagaggaagaggaggcatcagtgggtgcctactgggacagtcttatttcacaaatcaggaaagggaaaccctacatgggcgcagtggctcgtgcctgtaatcccagcactttgggaggctgaggcaggtggatgacttgaggtcaggagtgcgagaccagcctgggcaacatggtgaaaccctgtctctactaaaactacaaaaattagctaggcatggtggcaggtgcctggtgcctgtaatcctgggtactcaggaggctgaggcaggaaaatcgcttgaacccgggaggcggaggttgcagtgagcagagatcgtgccattgcattccagcctgagggacagagcgacactctgtctcaaaaaagaaagaaagaaagaaagaaagtggggacccactctcagtccagggcatgttccttgcaaaaagggaagctgaagatagaaccaagcttggagaattttgtttgcaacgcagtcaggctctcctggatcctctctcacagtcctggcattcagggggtgccatccccatcctcgtggcatgaacagaacgggaaatgtccgcagcacggctgcagccacggcttccacaggatgttgctcatggaaaactgctggggcacaggactcagggtctgccgatgctccgacaccgcggcacctacccttgctatcacggcgtggtacaggggctcggagtcgggggtcaggggccgtgcctcggaggggtccctggagaggtcaaagagcaaagggggtctgtgatgggtcacgccctccccggagcatgggcagacgcctcggccgtagcaggcccccgctccctcggggtggaactgcggggtcgtgtaatgaaccttccagacgcttccacctggatgcagacaagaagggagtcagggtggcagaaatccacgcaggtgtgaacgcagaacgcaggtgtcggccctgtggtatcagcatgaacctccctattcagtgaaaaggaggagggacacgaggcagtccacacaatcacagccttcagcttgcaaagtcagagcatgtgtgtgtgcgcgcgtgcgcccatgtgtgtccgtttgtgtctctgcattgcatgccccaggcaaagggactcattgcagagcgctcactgtggctgctttcagaaatcagaatcatagaggttccttaattcttcccctttcccctgtgttgaaactgttcagcgtcgatctactacctttctacacagaaacaaccatgatattttaaacagcatgattgggtacttatctatctatcgctacctatttatctatttatctatcaatccatccatttatcttacccatcgatctcatctatctaccattatctatttatctatcgatcatctatctacctacctatcatctatctctgtttatctacctttcatccatctatctgtccatccatctattcatccatccatgaactgattctactttttatctatctatctatctatcatctatcttatctatccatcatctatcttatatatctatcatctatcttatctatccatcaatcatgtatcttatctatcatctatcctacatatctatatatttatccatccatcatgtatcttaaatatctatccatcatctatccattatctatcatctatccatccatcatctatcttatctatccattatctatcttatctatccatcatccatctcatctatctatctatccatcatctatccattatgtctctatcatctctctctctctctctctcccccccccatcatctatctataatctactcatcggtttatctatctctatttctatagctatctgtccatccacccatccatccatccatccattcatccatccatccatccatccatccacatatccacacatcctattggctgtttctctggacaaccctggctgtgggcagcaggtactcactgtccttctggtgccagcgtgctgcgtgaagatgctgcccacagtaatgaaacaggaactcatgtgccgagcgtgcctcagctccctgcagcaagggtaccaggctgtggccatcaatcaccctgatttcatgaagagaacacagagcagagtcagaccacgggttcccaggcagccttttgcacctgggaacacatctcccagaatgcaaggctccccagcaaatggagcagagatgagctgtctctccagtcgctgttcagattacaggttgctgagcaggatacatgtggttatttcaagacacagtgtctctaagtgttggggtcatttgttatgcagcactgcataagcagagtgcacacacacacacacacacacaccccaacacacagcactgtcaccttggaggtcaacacaaagccttcaaattccagctggacagcccacattcctaggttggcttttcttacttttttttttttatgaggcagagtcttgctctgtcacccaggctgcagtgcagtggcacaatctcagctcattgcaacctctgcctcctggtcaagtgattctcatgcctcagccccctgagtagctgggactacaggcacaagccaccacactcggccaatttttgtattttttgtagagatggggtttcaccacgttggccaggctggtctcgaattcctgacctaaggggatccgcccatctagcctcccaaagtgctaggattatcggcatgagccattgcatccgacctgtccttactttttaatcataacagaccccaagacacatggccacatgggtaaaggagatggtggcgcatgcctgtaatcccagctactcgggaggctgagacaggagaattgcttgaacccaggaggcggaggctgcagtgagccgagatcatgccattgcactccagcctgggcaagagtgtgagactctgtctcaaaaaaaaaaaaaaaaaaaagcttatttatgtaaccaaataccacctgttccccaaaatcctattgaaataaaaaaaaaaaactaaaaacaattaaaaaaaatcagggaacaggcagccttatctccacgtacctgtcctggggcacctcgccacccaccagctggaccacagtagggaacacgtccatcaggctcgtgggctctccaatcactcggccggccgggagcacccccggccagtggaagatcccgggcacgcggatcccaccttcccatcctcccatgcccttcccacctgtaagtagaagacatcgttaggattttgccggaaactgcccagtctgtacacacatctggatgtatttgtgcataggtatgtgaatacgcacagccacccggatgcacacatgcacactggggcagcctcagcttcccaaaaacagccacagcaatatttccagaatcatgctactccctggcctcttgaatatcggtgggtcgctgtggctgattcaactgttctagtcgatctatgctacctttatttagaataaaataatgtattaaaatattcattaaatttaataatttaaaaatgtttgttaactatcaataatttttaaaatatgtattattatgcatcaatattaattgatgcatttaaaatattaaaatagtaataaatttattaaatatttaaaaattaagactataataaaataaattttaattttatctgaattatttatttatacctctctgtattctactaaaatgtaaaccctttaaaggaaggggatgtgactttttatctgcctgtcctgctcatctaggtagaacttgtactacagtaggtgctcaatgcattctttttgaaatgagcaaactcattttcagttcaacttgttctgggaccctcagtggtggcagatatttggtcgaatgcatatgtgtccccgatgtccacaactcacctttgtaaattccgttccatccccctaactggctgtgtccatctcttgcctctaaatgtcctccatggtcagaggtgaaatacgtgaatgttgagttctttaaaccattgtcttcgatggcattaagaaccttacctttacagaaaatggaaagtttcaggaccaagaaaacaaagcagcatccactagttcaatgcgcttcttcctttctgcaggagacacctcttgccaggaagtcataagaagagaccacacttactcggaggccgtggttacaatgtgatcccaaagtgtaagacatagctaatcactgtgataccacaggactgtttacaatgcaaaccaacaataaaattcgaagccccccaaccgactgatggactctcccttcagccaaggccattccaaagttaacctgaaaaactaggtcaggccgggcctggcggctcacacctgtaatctcagcactttgggagcctgaggtgggtggatcacctgaggccaggagttcaagaccagcctggccattatggtgaaacctcatctctaccaaaaacacaaaaattaggcaggtgtggggggtgcacgcctgtaatcccagctacttgggaggctgaggcaggagaatcgcttgaacccaggaggcagaggttgcagtgaggtgagattacactactgcactccagcgagggtgacagagtgagactgtttcaaaaaaaacccaaaagagggccaggtgtggtggctcacgcctgtaatcccagcactttcggaggctgaggcgggtggattacgaggtcaggagattgagaccatcctggctaacaccgtgaagccccgtctctactaaaaacacaaaaaattagccaggcatggtggcgggagactgtagtcccagctacttgggaggctgaggcaggagaatggtgtgaacccaggaggcggagcttgcagtgagccgagatcgcaccactgcactccagcctgggcgacagggtgagactccatctcaaaaaaaaaaaaaaaagaaaaaaaaaaccaaaagaaacaaaaaacaaaaacaaggtcaggccatgttggaaagtagtgggggcggggggagtggtggacatgcgtcatgataccctcctccctttggaattcaggcacaactgaccagcattcacattgaaacagagacctatgactgagagaaggccaggcacagtggctcatgcctgtcatcccagcactttgggaggccgaggcaggaagatccattgagctcaggagttcaagaccagcctgggcaacatggtgaaaccctgtctctacaaaaaatacaaaaattagccaggtatggtggcacatgcttgtatgtagtcctagctactcgggaggccgaagtgggaggattgcctgagcctgggaggtcaaggctgcaatgagtcaagatcacaccatgcactccagcctgggcaacagagtgagaccctgtttaaaaaagaaaaaaaagactgatagaacagactctttaagtctgataagaaacatttaccatgtattctctctgaagcctgctacctggaggcttctttggcattatgaaaccttggcctccacaaccccttatcataacccagacattcccttctattgattctcagataataactcaaccacctgccaatcagaaaatctgtgaatccgcctttgacctggaagcccccctttcagtggtcttgcctttctgcactgaaccaaggtacgtcttacacgtgctgattgatgccgtatgtctccctaaatgtataaagctgagctgcatgccgaccaccttgagtacatgttctcaggacctcctgagggctgtgtcacaggccacttgtcactcatatttggctcagaataaatctctccaaatattttacggagtttgactctttcggtcgaccccaagataccaccaatacaaaacacagaatgaacacacaacgccaagaggttgccagtgagcacgcttttttaaacatagtgccgtgtgtgtgtgtcacataataaagacactggggagagggaaatggtgagactcagtgatgacagaaccctatgtaggaggaagcagggctgtaactagcatctatgggcattggcgtattggaggctgatggctcagcagcgcagaggacgccctgcaaaccaagcagttgctttatccctggaggccactggtcattgaaagcactgaaagtcaaaatgatataaaccacaaggtcatctgtagctctgaaaatgcagactttgaagcctgctgtaaactgaaaagtatctgaggcgggtctcaatccatttagaaagtttattttgccaaggttaagaatgacacagcctcaggaggccctgatgacatgtgcccaccgtggctggggcaaagcttggttttgtatactttagggagacatgagacatccatcgctacatgtaagatgtacattggttgagctggaaaggtggaacaactggaagtggggaatttaaacatattctcattggtaactgattgaaagagttatcaatagaaaggaatgtctgggttatgataaggagttgtggagaccaagcttttatcatgcagatgaagcctctaggtggcaggcttcagagaaaatagattgtaaatgtttcttatcagagttaaggtctgtgtggatgttcatgctgcggggggtagaatgaggcaagcccaaccccctcttcccgttatggcatgaaccagtctctcaggttaaattttagggtgccctggcaaaggagggaatccattcagatggttgtggggggccttcgaatttatttttggtttacactgtgaaccaatcccgccctatcactatgcttgtctcgggagatatgttcagattctgcaaggattttaatatctacactctcttaagaatctgcagcctcgttggtcctctccagggtttcttcaaggccatagaaggaaggtgacctctctgcattgtccgaactttattgctttagtttctgtaacttctaatgaggctgttaagtcattggctgtgtagaaggttgacaatatagtttggatgtgtgtccccgcccaaatctcatgtggaattgtcatcctcagaatcggcggtggggcctggggggaggtgactgaatgatggggacagagttctcatgaatggttgagcaccatcccccgcttggtgctgcggagggagtagcttctcacgagatctggttgtttaaaagtgtgcggctcttcctctcctctcttggtccttctcctgccacaagacgcctgctcccccttcgccttccaccatgagcaaaagctccccgaggtctccccagaagcagatgctgccatgcttcctgtgcagcctgcagaaccgtgagccaatccaacctcttttctttataaattacccagtctcaggtatttctttgcaagaatggactaatacagttgattttgtgcaaaattagactaagtaatcagaaatactgaaggaccaaataaatgatatgagagaagtttttctccctattcttcgtcttttatttctttttttttttggagacagggtcttgctatgtggcccaggctggagttcagtggtgcaataattatagctcattgcagcctcagcctcctgggctcaaatgatcttcccacctcagcctctggagtagctgggaccacaggtgcacaccaccatggctaattttttaaattttttgtagagatggggggggggggcgtctcactatgttgcccaggctggtcttgaactcctggtctcaagccatctccctgccttagcctcccaaaatgctgggattaaaggcatgagccaccttgccccacctgaaaatgcagacttttaagactgtgaactctatcacgatgcttgtctcaggagacacattcagattctgcaagaattttaatgtctatgctcttttaagaatctgcagcctcactggtcctctccagggtttcttgaaggccatagaaggaagacagcgtgtctgcattgtcctgaacattaactttatcgcttcactttcggtaacttctgatgatgacatgaagtcactggctgtgtagaaggttgattttgtgcagaattagaccaagtaattgggaatactgaagaagcaaataaatgatatgggagtgtgttctgcccccattctttgtactattattattattaaagagacagggtctcactctgttgcccagcctggagtacagcagtgcaatctcagttcactgcagccttgacttcccaggctcaagcgatcctcctgcctcagcctcccgagtacctgggactacaggcgtgtaccattatgcctggctaagcatttatttttgtagagatggggtctcactatgttgtgcaagctggttttgaattcctgacctcaagtgatctgtccatctgggcctcccaaagtgctaagagtaactcttattctttttctttttttttgagacggagtcttgatctttcacccaggctggagcacagtggtgcgatctcaactcactgcaacctctgcctcccgtgttaaagcgattcttgtaccttaacctcccgagtagctgggactacaggtgtgcaccaccacaccgggttagtttttgtatttttagtagagacagggtttcaccatgttgcccaggctggtctcaaactcctgacctcaggtgatccgcccgccttggcctcccaaagtgctgggattacaggcgtgagccaccgcccttattctttattgcaagttggttcatattcagatggccagtctgttacgccctatgttcaaacctgaggccgagggtggagtgaggctccatggtaccttgacttacctatgagccagtccatctcctccacattatcaccatataagccatgctgacttttccccaggaatgcactcgtggtcacaaggggaatgtgcacatgcagcaaagaaaggaagaggagaaatggcccatgcttgtgtctgaaagaagaaaacttccttgagaatacacagaatatacagtacaccaaagggacccctgcacccatacgttcactccagcactattcacaagagccaaggcaggggatcaccttctgagttcatcagtgggtgaacacagaaagaataaatggtgggccaggcgtggtggctcatgcttgtaatcccaacactttgggaggctgaggcgggaggatcacttgaggccaggagttcaaggccagcctgggcaacacggtgaaatgccatctctaccaaaaatagaaaaattagctgggcgtggtggcttgagtctgtggtcccagctacttgggaggccgaggtgggaggacggcttgagcccgggaggtggagcttgcagtcagccatgatcataccactgcactccagcatgggtgacagagccagaccctgtctcaaaaaaaaaaaaaaaaaaaaagaatatattgtatatgtccacaatggaatactattcagccataaaaaagaatggaggctgggcacagtggctcaagcctgtaatcccagcacttcgggaggctgagcctggcagctcagttgaggtcaggatttcaagaccagcctggccaacatggtgaaatggtgaaaccccatctctactaaaaataaaaaaattaacagggtggggtggcaggtgcctgtaatctcggccactcaagaggctgaggcacgagaattgcctgagccttggagacagaggttgcagtgagccatgatcacaccactgctctccagcatgggtgacagagccaacgctgtctcagaaaaaaaggttatatctggtatatgtacgtgatggaatactattcagccatcaaaaagaatgaaatcctgtcatttgcagcaatacagatgaaacaggaggtcactatgttaactaaaataagccaggcacagaatgaccaatactgcatgttgtcactcatatgggagagctaaaaaaaaatcgatcacatgaagatagagaatagaatgatagagaccagaggctgggaagggtgaaggacaaagagaagtggtttaaagagtacaaacatacagtaagcttaaaggagtacattcaacgtctgatagcagagtagggtgaccaaagctaacaaaatgtattgtactcaggagatggacactgtaagtatgctgtttgatcgttattcagtgtatacatgtaacaaaatttcacacataccccatacatttgtacaaattaaaaagtaagggccaggcacggtggctcacgcttataatcccagcactttggaaggcagaggtgggaggatggcttgagcccaggaattcaagaccagcttgggccatatagtgagacattgtctcaaaaaaaaaaaaaaaaaaaaatgagacattagaaaaaggccaggcacagtggctcacttctgtaatcttagccctttgggaggccaagatgggaggattgtttgagcccaggagtttgagaccagcctgggcaacatagtgagaccccatctctacaaagaatgcaaaaaaaaaagtttaaaaaactgtcaataaaaatgtacagaatccaatggcgtgtatgtcaatgctattcgagccatcacatgacatccacttcgagactctcatatgggaaacccagccacatgaaaaggttggcttctgcaaagccgtctcctccgagggttggtgtctgagatcccaaagattataaggggactctcagatgctctgagcagttaccgtgtcttttttttaaattaaactttatttttatttttttagcgacagagtctcactctgtcacccaggctgaagtacagtggtgtgatcattgcttactgcagcctcgacatccgaggctgaagcgaacctcccaccttagcctcctgagtagctggcattgcaggcacacaccactatgcccggctaatgattttatttattgtagaacctgtcttcctatgttgcccaagctagtctaaagcacctgggctaaaagatcctcccatcttggcctcccgaagtgctaggatgacaggcatgagccatcgcgtccggccccatctcctctttaagatgcgatggttgcttacctttcaatataggaaacagcttcctttagcataagactcgctgttttctccagaaccatgggttgctccgtgacgtcatggtttctcatcaggatacagttccagcgtcgcacaaacccgaaggaggagtaccaagagatgaaaaacaggcagcccacgccggccatgccggtgactgctctcgcggagacagagaagaaaccgcaggtctggccggcagccagggtgagaatccccagcgccaggaactgggtgtaaccccagagctgcgccctcagggcggcgtccacttcggggggcctgcctgggtcacagtcgtttgtgagcgtgaagggcatgccgtagaaatagtcaaatccgtggttcagggggtggtggcagtgatccccgcgggatgcacaattcacaccctggtgccattttcctaaaagaaacgcaaatgttcaacagagacccgctttgaagcagccctgtctgctgcaaagaacctcggaatcattccgcgtcggcaggaaaagaaaagtctgcaaagagcaaaactggaaatggaaaggcaatgaatggattggatacctgtgtttaaatgaacgcattctgatccgtgaagactaacgaatgcatccatgtcagaacccttggcaagtgattaaaggtttaagactttcggccgggcgcggtggctcacgcctgtaatcccagccctttgggaggccgaggcgggcggatcacgaggtcaggaaatcgagaccatcctggctaacacggtgaaaccccgtccctactaaaaaaatacaatacaggtggcgggcgcctgtagtcccagctactcgggaggctgaggcaggagaatggcgtgaacctgggaggcggagcttacagtgagccgagatcatgccactgcactccagcctgggcgacagagccagactccgtctcaaaaaacaaaaatgaaaataaaagtaaaaattaaaaaaagtgagagagaaagaaagaataaatccaccctcagagtaggagacacacagacttctacagtataaagcactggccctgtaatcccagcactctgggaggccaaggtaggtggatcacttgaggtcaggagttcgagaccagcctggccaacatgctgaaaccctggctctactaaaaatgcaaaaaaaattagccaggcatggtggcacatgtctgtggtcccagctactcaggaggctgaagcaggagaatcgcttgaacccaggaggtggaggctgcagtgagttgcaatcgtgccactgcactccagtgtaggggacagagcaacactccatctcaaaaaaataaaaataaataataaataaaagaagaaaaaactttaaaaaaattcaaaataaaaataaagtggcaggaaacttgaaaaggaggaacaatggttgtcctttagaaaaccacagcttcggacaagttagggtgttgcggctcctgtgaatgggacagtggctttgagtgtgagaaaagcacagaggggaactggggaccctgcacagagatcccaccaccaggtcggggcgggtggcctcaccactgcgctcccacgttctcatgtgtatgacggggacagcacctctaaacacacaggctgggtaaggaatgaaggaggtaaccagcagactgcctggtgcttggcggcataaaccaacatctccctcctttcctctccgtgcagaaaggagtttaaggggcaggcctgagctagtgccccttacaaaggctggcttgtaagattccccgtggctggtgtttgagatctggatttccaatggagaagtcacaccattaaaataataagctgactgtgcctaaactatatgcaaaagcaacgtggttcatgctaaacacctcctttggttctgggagtctggaattcgggtgggtgccaggcagtgagtgcctgcaggaccagcccccaacagaaacccctgggcactgattctcccgggagcttccctaatagacagcattccttgcgtgttgttgaaactcatttctggaggaatatggtgcatcctgtgtgatcccactgggggaggattcttgggagcttgtgtctggtttgccctgggcttcattccgtgtaattcccatcactgattctgcctcacctcctttgactgtcataaatcacccatgagcacaactgcatgccaaatcctcctagcaacttcctgaacttaagggtgctcttggagacccctgacatgctgtctgttataaagagggtgttctgcccctgccggggtttattgtctaaaggaaggcagtgtttgttaactctggggcttttgagatggtgagtggccatgtagagaaggataatgtctgaagaaggtcgtgataaatggggacaagctgaagactgataggtccagagaagaaaagagggcaatctcctaggattttgaatttaagaagaaaaaaaaactcatgaaaaactggggacaatccaataggcatgagatggaccaggcaccaacttctgattcagaggacacaggattgttttcctttgcaggaaaacgggatctttttttttttttttattctttgagacagagtctcgctttgtcacctagactggagtgcagtggtgtgatctcggctccctgcaacctccgcttcccgggttcaagcgattctcctgcctcagcctcctaagtagctgggactacaggcgtgcgccaccacgcctggcctgggatcttttttatcacgaatattcccaaccaccgtataatgtgaggctcccacatatccacacctatgaggccggttgcatagccatgctgctgcaagattcttgcaaaagtggtttcgttctcagggagtccacctgagcctgcgttccactgaagggcccggtatccattgctggcgtccatgcctgtggggcagagaagacaggaagaatttactttcctttctctagaggagcacttctcaaccagagggatttggtgtctgagatctggatttgtgcacccgagccaggctgctattatctatcatccatctatcatgtatggagctatcaattatctacccatctatcgtctgtcatctatctacctacctacatacctacctacctaccgacctatcacactattctcgaaataataagcatggccaatgtctggagatgtttgtggtgtcacagctcagaaagggtggtgtgtggtgctactcgtatcgggtgcgtggagccgagtgatgctgctcaagaccctacatacagtgcacagaacagccccaccacagagaatcatctagccccaaatgtccctcatgccaaaacagagacaccccaccttaggatgacagacgccatgtgatctatcatatgtctatctatctgtttacctagctatcacctgtcacctgtctatctcaatatggatccatcatctatcatctatatctatccatctatctatgtatctattatctgtcattatcattaatcatctagctatcaatcagctatcattatctatcatctgtctatcacttatctttctatcatcattatctatcatctatcattatctatcaatcatctcttatctagctatctagctatcaatcatctatcacgtcatgatcaatcatctatcattatgtatcatcatcatctagatatctagctatcaatcatccattatctatcattatcatccatctagcatgtatctagctgtcaatttatctatctatctatctatcatctatcatctatctatatcacaatgattctcaacttggggaaactttgctctctctaagagacacttggtcttgtgatcagtcatactggctcggaataaacctctttaaaatattccacagaccttggtttttctgttcacatcctaatgatcacaacttttatgtgtatgcacacaatacaatattccttacataaatacaaggaagacgatgaattgcaggtgatctttgtaccattgcccctgtatcttcaccatcagtactcaactgttacagatgacagaatgagtgcacacagatgtacccatttctccatcatctccgtgacaccaacctgatctgaaggaatgtctccctgtgaggaatgcagctcggcttggggtgcagagcggggcggccgccaggtgctgagtgagcctcacaccttcctctgcaagctggtcaatattcggcgttctgagcaaagcacacaaatgtcattgttggaagggagacatgcatttggcttaagcagatccctgctctgaaaggcacaggaatagctgcaaggacttcaccggatttcagaattagttgcattatggtctcctgcagcggtagattgaccccatcctaagtttggtgttgatgttgagatggatgacatctctctctctctctctctctctcacacacacacacacacacaaagtatatgagacaatttatgactcatataacgaggctttctggggagagcagggcaggccttccaagctcatgtgaaataaggaagcaaggaaaggagatttatgttttcaattgtggtgagggtgtggggccgagatgagggttcccatgcaagggtgggggcgtttatggtctgaatctgccatcagcaccaaaggagacagtccctgtgctttcttatctgcttgtccagatggggaacacagacagaagaggcttaaaagctttcatcatcagatatcaaaaaactgtgagggccgggcacggtggctcacgcccgtaatctcaactctttgggaggcctaggcgggcagatcacttgaggtcaggagttcaagacaaacctagccaacatggtaaaaccccgtctctactaaaaaaaatacaaaaattagtcaggcaaggtggtgcacacctgtaatcccagctactcgggaggctgagacaggagaatcgcttgagcccaggaggcggaggttgcagtaagccgagattgcaccactgcactccagcctgggtgaaagaacagagtgagaccgtgtctcaaaaaaaaaaaaaaaaaaaaaaaaaaaaagaaagaaaagaaaagaaagaaagaaagaaagaaagaaaaggagccaaaagaggtatccacatagaatggaatctatggaatatgactcagccactgcaaggcgtgaggcacggtactgtgaaagcctcctgacataaaagaccacaggttacataattccatctgtatgaaatgtccctaacaggggaatctatagagatggaaagtatattagtggctgccagaggctgagggttagggtgctgagagagttggaggagtgttagctggggctgccataacaaagtcctacacacctggccgcttcaacaccagatattggttgggcacggtggttcacgcctgtcatcccagcactttggggggctaaggtgggtggatcacttgaggccaggagttcgagacaagccttggcaacatagtgaaaacctgtctctacaaaaaatacaaaaattagctgggcgtggtggcatgtgcctgtagtctcagctactcaggaggctgaggtgagagcctaggagatggaggttgcagtgagctgtgatcatgccactgcattccagcctgggcaacagagtgagaccctgtctcaaaaaacaaaacaaaataaaacagaaaaacaaacccagtagacatttattctctcacatttctgggagctggaagtctgagatcaagcatgggcagggctggttcctcctgaggccaccaccctgggctcgtagacaccatcttctccctgtgtcctcaggtggtcattgctctgtgtgtgtctgtgtcctcatctcctcttcttataaggaccccagtcctattggatcagggcccaccctagtgacctcattttacctgaatcacgtctctaaagactcagtctccaaatagagtcacagtctgaggtcctgggggtcaggacttcgacgtaggcgtttaggggacacagattcgctcctcgctggaggtgatggctaaggggatgcagagtttctttgggggtatgcaaatgctctaacatggtttgtggtgacagatgcacagctccatgaatagaataaaagtccctgaactgtacactgtaaacagatgaaccgcatgttctgtgaattacaaccaggcctgctcagggtgttcgaaaggggatccctggacagggggcagattgattgattgattgacttagagacagggtcttgctctgtggcccaggctagaatgcagtggcgcaacctcagctcaccataacctccacctcccgggctcaagccatcctccactctcagcttcctgagtagctgggactacaggcatgcgccaccacacctggctaattttttgtatgtttcatagagacagggttttgccatgttgcccaagctggtctcaaactcctgggctcaagtgatccaccttccttggcctcccaaaatgctgggatgacaggcgggagccaccgtgcccggcccacacagggcagactgctgcaggtgctgcaatgttcactgcaaagaagggaggccctgctctgcggggaccgctcctgaggttggcagctattgaaaagcagatgcagcctgcattctggggcggtccttctaggagaaaagcccaccaaatggaataaggagctttctcaccttttctcctgttgcagaaagcacgtgagcaccactcaagcgctctgctggtaaggttggcatagaggctactactctgtgtttgcacatgccactgcagtgggctgaatgggggtctgcgaaccgatctgtccacgtgctgaccccccaaacctgtgtgtgagaccttgcttagaaaaactgtctttggagttgttattaggtatcccgagatgagatcatcctggtttagagagggccccagatgcaatggccagtgtccttctgagagacagaggaggagacacagacacaggggagaaggccgcatggggacggaggcacaaactggagtgatgtggccacaaagccagagatgcctggagcccccaggagctgggagaggcaggaagggtcctcccctacagcctctcagggagctctgttggtgtcttaatctcctcttttagtaatccatatcagattagggctcaccctaaggacctcagtttaacttaattacctcttcaaagaccccatctctgaaaacggtcacaccctgaagtaccggcggttagggcttcaacctacaaatttggaggaggccagaatttggcccacaacagacgttgtttgcaaacgtcatcaacagaagatgagatctttacagcgggcaggccttgctgcaatggccggtgtccttataggatgaggagattaggacacagacgcagaggagaaggccccgtggagacggaggcagagactggagtgatgtggccacaagctcagggacacctggagcccccaggagctgggaaagtccggaaggatcctcccatagggcccccagagggagcccggccctgcccacacctggatttaagatttctggtctccagacctgggagaacaaatttccgttgttttaagctacccattttgtggtagtaatacattcaccccctcaccgcagttccgcatggtttaaaagggcctttttacctgttggtagttttttgttgagttctgaggccctaaggagtttcctaatttctccaggcagattttaaatgcaccattccgtcaaactcacataacatcatcaccaatagcaacaaccaactgtacctcagtgtattgttcccgtagcaaccgagatccccagtgcctagatcatccgccatgatcagtaggatatttggtttaaaggcatttgcagttttaggttcacacgtcttcagaagcaagcataaaaacagtagcaccggcaaagagtccctggagagaaaagcgaaacacagaaatgactatctacaatttggcaagggaagtaggcatttcaaggcagctcgctgggaaggcgaaggtcttaccactaaattaagacgttcagctttatgggaggttattgtcttggcctgaattcctgcactggtgtccctgggccaaaccgagggtcagactgctatttcttgtgacccaatagcgagatgcagatgaattgggaaagaagagagtttttaattctgtaaccagttacaggaggaaggcctggaaattctctcccaaccaactcaaaattacaaagctttccagagcttatataccttcaaagctatatgtctaagtgtaagtgtgcatttatctaaagacataagtgattaacttcttctaatctgtaattaagatctgagtcctgaagaccttcctctggagcctcggtgaattgacttaatctagatgggtccaggtgctggggtgattacccttatcttgtctcctgctaaatcacagagttctggggagttcctttagtccccaacaaagcttgtttgtggaggtctggggagtttcttcagacccacaataaaacttgtttaatcctaaatgggtcctgttaagaattccttcgttatcttgtcatgcttcaaaggcccaggagaggcctgggcagaactcttggtgtgcttttgttacatcccagcctgtgcataaaggcgctggttgtttcagcttttagtatgtaacttcacactcagtcagtgctgaaacagttgttacggaggcctgcattagtgagacctggcctgccacactagaccatacaggtcagaacaaactggaatggagtcacttgtgttaactgccacatcgtcaagctgaacagggaaacaggtcagttttccaaaaaacagaagatttgagtaagcaagaagaagatgtgtagttcatctgagctaacaaagtctcccgtgctttaaccctgtaagaaaagtaactttgaaacaaccaatctgctttattattcttttttttcttttttttgagatggggtcttgctgtgctgcccaggctgtagtggcatgatggtggcttacagcaacctctgcctgattctgaggtgggaggattgattcaagcagtccttgaactgcagtggataggtggtgtcttagtgttgggggatcgtggctgtgctctccggggaggacgcgaacgaggggtgtgtctcagggtgtgtgaggggacacggctctactggggggcaggggaggaataaggccatggggagggatccggtgtggccagcagggcaatggccgcggaaggggacaggacggggcgtgtcttggagggtggcgagaggcacggcagtgctgctgaggcaggagaatagggtctggaggcagggaacctaaggctttccatgccgacttcctagaagtaaattgaaaggaaaatcctaactttccttttttttttaattttaatttttattattattttttgagatggagtttcactcttgtcgcccaggctgcagttcaatggcatgatccgggctcactgcaacctccacctccagggttcaagcgattctcctgtctcagcctcctgagtagctgggatcacaggtgcctgccaccacgcccggctaatttttttgtaattttagtagaggcccggcctaatttttgtatttttagtagagacgggatttcaccatattggccatgctggtctcaaactcctgacctcaggtgatccacccgtctcggcctcccaaagtgctgggattacaggcatgagccacctcgcctggcgggaaaatcctaactttccatgcctaagtaacaaaaggaccgaaggcttccctttgaccttttctattgggtagatagtagactggctgtctgcaaccaatcggactgatttcgggtctagtcttcgtgtgcaactttgtgacttcaccctagtctctgattagttgggttttgcaaccaatcagatgtttgcacaggagtgtgacctttgtaacttcaccctttggttggctgctgcctgcaaccaatcagactgatcgcgggccaccacttcagttacatgaggtgagcatgaagtggccaatgggaaacttctagggggtatttggacccaagaagattatgtacccgggcccttgagccgctgcttggtcggctcccacactgtgacgtgtccttttgttttcaataaatccctgctttccttcttttgttgcttcattctttctttgctgggcgttttgtccaattctttgttcaaaacgccaagaacctggacaacttgcagtcacgaccctctaccggtggcactggggcgcaaatgaagctgggaatgcaggacccggcgcatctgaggaagtgcagcggggcatggcggtgctagagggtggggacatggaggcggcacaaggccaaggcgccgggggatggccagagggaagtaacggccgcgcttgtggtggagatggggacgggacagagaagtcttggggggtgaccggggtaggcacggcggtgctggggggagggcgcccaatgaagcccacgggggggaaaggggcgtgtcttaccgagcgtgttgggggagtcacagccgtgcttgggaggatggggtctgggggaaggacggggcgcgtcttagtgggatgagggggagggcacagccgtgctgggaaggcaaagggccggggggcgggatggagcatgtcatggtggggccgaagaggcggggggcgggaaggggccttcttagaaatcgggagggcgtcacagctgtgctcgggaggacggggcgttggggagggacagggagcgtcttagtggacccggggaacacggccgtgctggaaggcatcgagctggggggttgggggcgggacggggtgcctcttaggaagtggggcgggcaaggctacgcttcgggggatggagccttggggcgggacggggcgcgtcttagtggggcagagcggggggcgcggttcggggcgggtcttagggagcctttgaaggccgaatccgggcagcggtgtagctgggcgtggaaggcggaggacccagcagggcgtgaccggcccagtttccgctccctccgggtcccggccagccttcctccgccctcccttcccttcctcctttgttctctttccctgcccttccgccttcccttcagttcggtctcctccacccgcccttcgtcccctcagtcgccccccatccctgggctctgctgtctggcgtctttcccgggcacagaacgcgcctccagctacattttggagactacaaggcgccggacacaaccacgccctttacaggggcccaggctcgcccggggcgcccctcgccgtgctcgcgaccccctccccaggcccccaccctaggccttagtatgggccgcgtcccggggtcccaggcacctggcggcgggcgcggcgcgtcccctccgcgcggcggatcgcatggccgagcgctggcccagagcgcaggaccttgccctgcgcactccgcgcccgggcgccgctagtgccaaggcttccgccctctcagctgcgggatctgggccgggcgcccgcccctccttcatccgcgtcatctcctggctctcgggacctccgggacctgcgcgtggaaacaggttttcccaggtcgtcacacgggaaggcctgggctaaggagctgattaaacccagttacgattgaccgggcgcggtggctcccgcctggaatcccagcagtttgggaggccaagacgagtgggtcacctgaggtcaggagttcgagaccagcctggccaacctggtgaaaccccgtctctactaaaaatacaaaaattagctgggtgtggtagttcacgtctgtagtcccagctattcgggaggctgaagcaggagagttgcttgaacccgggaggtggaggttgcagtgagctgagatcgcgccactgcaactccagcctgggcgacagagtgacactccgtctcaaaaaataaataaataaaaataaaaaataaacccagttaggcttgagcacagggagccccttttctttttgtcaggaagggtcttaggacctacccagagcaatcaagttgcgatttcagtttctcaaagcttggtgtttgaaatgtctgttccggatgctggacttgtactctaagtctgggacggggaatgctagatgggccctttttttttgcttttattactattattattattattttgagatagggactcactctgtcgcccaggctggagtgcagtggtgcgatctcggctcagtgcaacctccgtctcctgggttcaagcgattctcctgcctcagcctcccgagtagctgggactacaggcgcgtgccaccacgcccggctaattccaattgctatttttatctttgtttctttcatcagactgctgttgaaattactccttttgattaatcactgtgccctggacccctccccatcttttctgtgactcatccttttgtttttgaatgatgctattttgctcattaccctctcacgtaatgctttttttgtatctttggctctccctttgttgtttgtttgttttgtttttaactcttttgacctctagaaagatcaaggctgagagttgaggctgcagtgagcctttgtttttgtctaactctcttgacctccagtcgctgattctctcaagccccttcatgtcttacctcatcccctcacatcccctcacaatgcaagatctggtcaaagtataaattcatattttgtaggaaatgctagcttacaaaacaatatcacatccctacctccagcccaggtgacccactttccctcaaagggggttgcttaggtcctcttccactggtcagggacaaaatgattccatagtcttcaagattaacagtactttctttttccaaggctgaggctgtcaagggtgaggctgtcaccgcctcccaaggaagtggaactaccggtgtgcaccaccacccctgacacatttttgttaatttatttttttgctagagactaggtcccactatgttgcctaagctggtctcaaactcttgcctcaagcagtcctcctgctttggcctcccaaagtactgggattacaggtgagccactgtgcctgaccagccacaagactctatgttgggtgtgtaggtgggaagcatatccaggtcctcctcaccattattctgcctccaacatttatgccatttttttttcctttgcaactcagttctctatgcttaccaaatggaatcagtaaggtaggggaggcggggtggaagtttgtgttgaaaacatagattcagaagcccctccttaaattcactgagttaggattttcataaatgagggagctgccccacactcccctgggatgagatgatgggggtgcttgttcaagacaatacagtcaggagccctactccctaaatttattcaattggaatctcccaaaatggtgctgggaattctatttagaaaaaagaccattcacttttaattggcaaatttagttcatttacatttattacgctggccatctgtctggagctagctcttgagcactgtttattgcttctctctttgccctgttactctgaaatagcttttatcagacaggcttggtggctcacacctgtaatcccagcactttgggagactgagggggaaggattgcttgaaaccaggagtttgagaacagcctgcgaaacacagagagaccctgtctctacaaaaaaatttttttaagttagccgggcatggtggtgtgcctgtagtcccagctatttgggaggctgaggtgggagagtcatctgagtgcaggaatttgaggttgcagtgagctgattgcaccgttgcactccagactgggtgacagagcaagaccctgtctctaaaaaaatttaaaaaagaacttttttatctttgagggcttcccaactgggattccttgctgagcctctgtcatgcagatggagaaggccaggccgaggcctggaaggaggggggcaggagacagcccagaagcagttctgcaaggaggtttagcaggggtggcgcggagatttgatccttggaagaaatcctatgctgctgggagttgagattcctgagaactagagagaaaagaactttgggtgcccttaggtaaattatgtaaacacactgagctgtcttgggtgcccaggatttggaaatggggcctgggggcagtaggagctggtgctccagaagtcatatttgcgggaggttgtggggatggaaagggtgggtaagccctgaccctgagggtctcacatgactttcagcacatggagcctccatggggactttggcttcaaagccatcaagctcaagagtgtgggcaagtgtggagacagaggtgactctccccagtggatgctgaagaacttaaaggtgactctgtgggccgggaacatcgggcacagctgacccaaagtgctggtcttgttccataagccatggctatggggaaagccataggggttaactggttcttcctgccatccctccctccctttcttcctttttctttttgcttctttgctttccttccttcctgccattttttccttcctttctttttagagatgaggtctcgccctgtcgcccagtggcacgatcacagctcagtgtagccttggacactttgggaggccaaaggctcaagtgatcctcccgcctcagcctcccaagtaggtgggactataggcacgtgtcaccacacctaattatttaaatgttatgcggaggcagggtctcgctatgtcaccccagctggtctgaaactcctggcctcaagccatcttagtgccctaaagtgctgggactacagatgtgagtcaccgcacctggcctactatttctttcttgacccaagagaattggctggagatggatttgactttttggtctgtatgcacagcctgaattcttggaggctgatgtggattggataatttgaggacatgttcttgaggcggtgacaaggtggggcattgctcgtcacatacctaggcttggaagagtgggaggagggacctgttgcttgaatctggagacagaaagagctattggaaagacctccttactcccaggggagaatgtgctggggactgaattgtgttgccttcaaactcacaggaataaggtttttattcatcctttaaaatgaggtcacaagagtgggccctattccaataggagtggggtccttataagaagaggagattagggccgggtgcagtgactcacgcctgtaatctcagcactttgggaggccaaggtgggcggatcacttgaggtcgggagttctagaccagcctgggcaacatggtgaaaacccacctctactaaataatacaaaaattagccgggcatggtggtgcacgcctgtagtcccacctactcgggaggctgagacaggggaatcacttgaacctgtggcagaggttgcagtgagctgagatcacgccattgcactccagcctgggcaacagagcaagaccccatctcaaaaaaaaacaaaaaacaaaaaacaagaatcagagataggacacagacaggcacagagggatgaccgtgtgaagacatgggaagaaggcagcagctgtgaaccgagaaacaggttctccccagacacagcttccgtcacgccgtggtcttggacatccagcctctagaactgcaagaaagaaatattcttgatgatacccagtttatggtattttcattctagcagcccagacaattaaggcgcagcctgattatgcaatgaccttgcagctcagagctggggcgaacacttcctgcacagcgcggcttccacagccagagtttgcccaaatcacctggggcattggagacaaaggaaaaccacttgaaaacagttccaacgggaagcacggctcatccttgtggccgtaaacgataaacaaacactataaatgggcaccacagacaaagccacatcagtgccagtttttatctttggggcctatctcctgttcatgtgcaaacctgtaggtcacagagacacctttgctgggacttgtgctgttttgggctacagggcagcctcttccagactgagctggggtccattgacagactcctccccgactgcaggagatactttgcctctccagtttggtgtctgagtgatcattcaacggtgcattattaatgtttgtttgtttatttatttatttttgatgagacagtcttgctctgtcacccaggctggggtgcagtggtacgacctcagctcactgcaacctctgcctcccggcttcaagcaattcttctgcctcagcctcctgagtagctggcattataggcgtgtgccaccacacctggctgctgctgctgcttttttttttttttttttttttgatagagacagggtttcaccatgttggtcgggctggtctcgaactcctgacctcaagtgatctgcctgcctctgtctcccaaagtgccgggattacaggcgtgagccactgcgcctggccagtgtttattgttcatttctactttctcttgccttttcctttgtttttcacagggggaaactattcatccttatgcaaatagatatcttaacatgacactgaagtttgtttcatttttttgttttctttcttttttgagacagggtcttgctctgttgcccaggctggggtgcagtggtacaatcatagctcagtacagcctccaactccggtgctcaaatgatcctcctgccttagcctcctgagaagctagaactacaggcgtgtgccaccatgcaggctaattttttttttatttttgttttgtagagctagagtttcatcatgttgcccaggttggttttgatcacgggagtgatcctcctgtggtggcctcctaaagtgctgggatgacaaccaccatggccagctggtttgtttcaatttgagtgacaaaatttaggaatcggggctccagcttttcactgcagacatttattgtgggtcatcttccctaaggcaccagcagagggggaacgggccacagcagggctgcagccacggtctccagatgttgcccagcctgtccagctgcagaggaactgggctgagtgtccgctggtgttcccacaccgcctgctggactcgttccatcacctgatagaacacgggctctgaggctggtgtgaggatgtgggtctcagaagggtctcttgagaggtcaaagagcaaaggtggatcgtggtggactactttttccccaaagcacgggcagacctttcttccatagcaggcaccggctccctctggctggaacacaggcgtcacaaagtggactttccacattgttcctcctggtggaaagataatcattacagagttggcatagagaaatagggtgccttgctggagaatggcatcttcatagggctaaaaggtaggcctaacccaagcgtccatcgatggatggacagataaacaaaacatggtacatcttacatggcatactctgcagctatgagaaggaatgacacaatgacacaggctgcaacatcaacgaactttcaaaatactacgctcagagaaagaagttacaaaagagcacacattgcatgattccattcacattgaatgtcaaggatagggaaacacataatgacaggaagtagagtagtggtttccagggtctgcagggtgtgaaatggagagtgactgctgataggaacagtgtctgcttttggcgtgatgaaaatgttctggagctacatagacgtggaggttgcacaacactgtgaaagcacgaagtgcctgtgaattgcactcagtcagttttttcttttcttttcttttcttttctttttttttttttttatttgagacagagtcttgctctgtcgcccaggctagagtgcagtggtgcaacctccgcctcctgggttcaagtgattctcctgcctcagcctcacaagtagctgggattacaggagtgcgcctgtaattgttcacaaagaagatgaagtcgtgttaaggtcaggtgattaaaacatttggaagcacatctagatgcataaaatagactacaaaaggctgggcgtggtggctcacacctgcaatttcagcattttgggaggccaagatgggtggattgcttgagcccaggagttgcctgggcaacatactgagaccttgtttcaacttaataaagaaaaattggagaccaggcgtggtggctcatgcctgtcatcccagcactttgggaggccgaggagggtggatcacttgaggccaggggttcaagaacagcttgcccaacatggtgaaaccccatctctactaaaaatacaagaaattagccaggtgtagtggtgggcacctgtaatcccagctactcaggaggctgaggcaggagaatcacttgaacccgggagactgcagttgcactccagcctgagcgacaaagactagtctcaaaaaaataattacaaaaaaataagaaaaaaaagagactagaaaagtcttgaacacatgtgtgtgcaagcatgtgtgcgtgcgtgtgtgtatgcatgcacatacgtgtgtgtgatgatgataaaagttgcacttcatatagtgcagggaagaaagaatgaaatatagcccatacatggtgctgaaactataggtaacgactccccatcgttttaagacgattggcaggtgatctcagaaggcatgtcgctggaatgagagggacacatattgacaaaaactaaatttaaaaagctcgtggagaaaaacggaagtgcggagacatggagatggactctggaatgcagctccatccctagcctgttctagggcatggtgctttcctgcacagagggactctttccctaagggtgttaggaaggggctcccctactcactgtcccgttgatgccacctggctgcgtgcagaaacctctcacaataatgcatcaggaactcgtggtctgagtgttgggctgtccccaggagcaagggcagaaggtcttggccgtcaatcactctgcaggaaggaacatggcatggctcagggttggaacagggactctggacatttgtccctccagcatccaccagtcccagccccaggtggtgcactctccttatgttgtatcagtggagggaaagtctgggtgtgaacgcagatggatggaaggcatgtgtgtgcattagcacgcttagaagaagaatgcagcagctgcccacgttagtcaccaccaaacgtcacctttggctaaaaagtaattaattggccaggcacagtggctcgtgcgtgtaatcccagcactttgggaggtcgaggcgggtggatcacctgaggtcaggaattcgggatcagcctggccaacatggtgaaaccccgtctcaactaaaaacacaaaaattagccaggtgtgctggtgtgtgcctgtaatcccagctactcgggaggctgaggcaggaggatcgcttgaacccaggaggcggaggttgcagtgagcctagatcgcaccactgcactccagcctgggcaactgagtgagactcagtctcaaaaaaaaaaaaagaagaaaaaaaagctgaaagagccagcacccaaaggctggaatgtaacaaaagcccactaagagttctacccaggcctttcctggaccttgaagcgcgataaaataatgaagggattcttaacaggacccatttaggattaaacaagttttattggggatctgaaggaactccccagacctccacaaacaagttttattggggggtctaaaagaactccccaaacctccatgatttagcaggagacaagataagggtaatcaccccagcacctggaaccatctagattaagtcaacttactgaggctccagaggaaggtcctcaggactcagaccttagttctagatgaaaggaagttgaatcacttatgtctttagatggatgcacgcttacatgtggacatacagcttagaaggtatagaagctctggaaaactttgtaattttgagttggtctagtgatcatttccagccttctccccgtatctggttacagaaataaaactcctttctttcctcgttcatttgcatctcgttattgggccatgagaataagcagcccgaccctcggtttggtcggggaacaatttcagggacgccttactgcaaagccaaagtgacatgttcatttgccataagtgttgctgtgtctgtgcaaagctgaattgtttctttgggttgttctgtacctgtcctggggcacctcgccgcccgccagccggaccacggtggggaacacgtccatcagactcgtgggctcgccaatcactcggccggccgggagcaccccgggccagcggaagatcccgggcacgcggatcccaccttcccatcctcccatgcccttcccacctgggtttgaacagaaacaaaagaaagtggttaaaaaccagaaatagatgctcagcctggctgatttaacttttctgcttgtttcacttgtttgaagtttctctctccctgagtctctcaatttctctctctctctctctctgttttagtgacattaaaacattcaatctcatgtagttcccctgtagaggtttgattttatattttttattaaccttgttattggttagtgtgcattggattaagttaggtccttcactacaaatgactcttgttcttagaagacacagacacagaggagaaggccatgtggagacggaggcaaagactggagtgatgtggccacaagcccagggactcctggaacccccaggcgctgggagcagcaggaaggatcctcccctagagcctcaagaagaaagtggatacaactataacgtattgaacagtgaccccaaaacatgttcatgtcatatctcccagagcctataaatgagactttatttggaaatagggggtttgcagatataatcaagttaaggaccttgagataatcctggattagggtggccctaaatgcaatgacagatgtccttctaagagacagaagaggagacacggacacagagaagaaggtcacgtggagacagaggcagagactggagtgatgcggccacaagcccagggatgcctggagcccccggtaactgggagaggcaggaaggagcctcccctagagcatccagaaagaagtggattcaattgcaatggattgcactttagtcctcctgaaacatatatccacaccctgatccccagattctgtgaatgggaccttattttaaaaaggggtccttgtagatgcaattaagtatctcaagatcgtcgcggagaaggatggactctaagtccaatgacagcattctaagagacagaagaggagacacagacacagaggagaaggccacatagagacggaggcagagactggagtgatgtggccacaagctcagggacacctggggcccccaggagttggcagaggcagggaggagcctcccctagagcttctggcgggaacatttccctgagacacgttgatctcaaactcctggtctccagggctgggacaggataaattcctgttgtttaaagctccgccagtttataatactgacattcttgatggcacagagaaccagattgggtagaggatacattaacgtcaatggcaatgagataaagaaggtttctgaggagtcaggccttcaatgtgaagttgttgtgggaaggcattagtggatgtagttggcatttatatatcccgttttacatatgtactagactgatggatccatctacttcaaagcaaatatacatcataggtatatttgccaatattagcctaaaaaggctctttcaaggactgaaaaataaagctctctaagcagggagaagacaaaatgtgtaagcacaacagtgtgaagtcatgtacacggggcagcacattttagcatctttgtggtacacgaaagaatggcgtgtttggaaacaatggaatacaggtttgaatataatgtggccagctaggtgtctacccttctaccttttttttttttttttttttttttgagacagagtcttactctgtcacccaggcgagagtgcagtggcacaatctcagctgactgcaaccttcacctcccaggttcaagcaattctcctgcctcagcctcctcagctgggattacaggcgtgcaccaccacgcctggctaatttttgtatttttagtagagatgaggtttcaccatgttggccaggctggtctcaaactcctgacctcaagtgatctgcctgcctcggtctcccaaagtgctgggattacaggtgagagccactgcgcctggccttatccttcttggatgcattgtctgaaggtaaaattcaaacctgagtccacacaatggaatatattcagccatggaaaggaatgaaacatttccacaacacagatgaacctcagaggcatcatgctaagtaaaaacaaaaaaactccacatattgcatgatttcatttacataaatgtctagagtaggaaaatatacaatgatacaaaataattttgtggccaggcatggtggctcacgcctggaatcccagcactttgggaggcccagctgggaggactgcttgagttcaggagtttcagaccagcctgggcaacataacaagaccctatctttacaaaagataattttaaaaattaaataataaacaaatcaaaaataagtttttgggtgatggatgttagcacgggggaaaagggagtgactgctatgagtagaggatttttttgtgaggtgatgaaatgttctgaaataaacagtggtggaccacatgtggtggctcatgcctgctgtcatcccagcaccttgggatgccaacgtgggaggatcacttgaggtgaggagtttgagaccagcctgggcaacatggcaaaaccccatctctacaaaaatacaaaaattagccaggagtggttgcatgcacctgtagtcccagctacttatgatcgctgagacaggaggatcacttgagcccaggaggcaaaggttgcggtgagccaagatcgtaccactgtactccagcctgggagatagagccagactgtctcaataaaaataaataaaaataataacaataaattttacgaatgaaaatagtgattgtaaaacaaaaataaaattctaaggacccccaaccatctgaatggacttcctcctcacccagagctctttaaaaacttaacctgagaggctgtttcaggccgtgacaggaagcgggagtcgaacatgcctcatgattcctctctggcattaacatccacacagcctttaggtctgataagaagcatgttacaacctcttgtctctgaagcctagtacctgaaggcttcctctgcaaataagaacttgggtgtccacaatctttttttttttttttttttttttttgagatggagtttcgctttgtcgcccaggctggagtacagtggcacagtcttggctcactgcaacctccgcctcccaggttcaacggattctcctgcctcagcctcccaagtagctgggattacaggcacgcaccaccacacccagctaatttttgtatttttagtagagacagagtttcaccatgttggccaggctggtctcgaactcctaacctcaagtgatccacccgccttggcctcccaaagcgttgggattacaagtgtgagccactgtgcctggcctccacaatcctttatcttaacccagacattcctttctgttgatcccaggtctttagagaaacaacgaattgtcaaccaggaaatgtttaaatctacctgtaggctggaagccccgtggctttgagttgtcccacctttctggaccaaaccaatgtgtctcttaaatgtatttgattgctgtctcatgcctccctaaaatgtataaaaccaagctgcgccttgaccatcttgggcacacgttctcgggacctcctgagggctgtgtcacaggccatggtcactcctatttggctcagaataaacctcttcaaatgttttacagagtttagctcttttcatcgacatgatgatggttacacaactctgataatctactaaaaattccttaattgtgcacaaaaacgtggcaggccacgtctcactaacacaggcctccgtaacaactgtttcagcactgacgagtggtgaagttaaatagcaaaagctgaaacaaccagcgcctgtatacaaaggccgggatgtcacaaaagccccccaggagttctgcccaggcctctcctgggccttgaagcgtgacaagataaccaaggaattcttagcaggacccttttaggattaaacaagttttattagaggtctgaaacaactccccagacctccgcgatttagcaggagacaaggtaagggtaatcagccctggcacctggacccatttatttatttgtttatttatttattttattatttttgttgttgagatggagactctctctattgcttaggctggagtgcagtggcgcgatctcagctcactgcaacctccgcctcccaggttcaagcgattcttctgcctcagcctcctgagtagctgggactacaggcgtgtgccaccatgcccggctaatttttgtatttttagtagaggcgaggtttcaccatgttggccaggttggcctcaaattcctgacttcaggtgatccacgcacctcggcttcccaaagtgctgggattacaggcatgaaccaccgtgcccggccacctggacccatttagattaagtcaatttacttagtctccagaggagggtctccgggactcagaccttagttacagattagaagaagttcatcactaatgtctttagatgagtgcacacttacacgcagacatacagcttagaaatagaagctctggagaactttgtaattttgagttggtctggcaacaatttccagacctccctgtaaccggttacagaaataaactccctcctctcccagttcatctgcatctcatttttgaaccaccagaataagcagcctgaccctcagtttggtccaggaacaaaaattcaaactggagtatgtcaaattaccacttttgccctggataggaaaaatcactgtccctgagcaataatattgaccctcctggaatagattgccctgctgggaattgcagggaagagataaacttgcaagatgaagatctgggagcatctcagtcttacctttataaattccattccagccaccatactgggtgtttccaagttgattctctagggaaccgccgtgatccgacgtaaaataaatgagggtgctgttgctcaaaccctccacgtccaaagtgtcaaggatccgtcctgcaaagaacagatgtttttggggccgtcgaaatggaaaaatatcagaaatgcagctctgaagtgtatgctttagcattcgggggctagccacaagaatgaagccttagttttaacgcataatggaagtcagctgttggataattttgatatcctttgttggagattgatgtatgactttatatgcaccccatcctttggtcagaattttaggcaacgtacaaggacaaaatatcaaaaacttaaaagtgcagcatgcaggctgggcacagtggctcacacttgtaatcccagcactttaggaggccgaggcaggaggatcatttggggtcaggagttgtagaccagcctggccaacatgatgaaactacatctctactaaaaatacaaaaattagccgggcgtggtggcacatgcttgtagtaccagctacttgggaggctgaggcaggagaatagcttaaacccgggaagtggagattgctgtgagctgagatcacgccactgcgctccagcctgggtgacagagtgagactcggtctcaaaaaaaaaaaaaaaaaaaaaaaaaaaaaagtgaggcatgtgaatattcctgagaagaaagcatagactgaaaatgcagaccagtcctcaaaagtgaccctgagcttcttgcagccacacacaagggaactcatgtcattaatgtcactcacagttggccgggcacagtggctcatgcctgaaatctcagcaatttgagaggctgaggtgggaggctctttgagcctatgagtttgagaccagcctgaacaacacagcaagaacttgtctctacaaataataaaaaaattagccgggtgtggtagtgcacacctgtggtcccaggtacttgggaggctgaggtgggaggattgcttgagcctgggaaggcagggtgcagtgagccacggttgcaccactgcactccagcctgggtaagagtgagaccctgtcggccaggcgcagtggctcatccctgtaatcccagcactttgggaggctgaggcgggcggatcacaaggtcagcagttcgagaccagcctggccaacatggtgaaaccccatctctactaaaagtacaaaaattagccaggcatggtggcgggtgcctgtaaacccagctactccggaggctgaggcaggagaattgcttgaacccgggaggcggaggttgcagtgagctgagaccgtgccattgcactccagcctgggcaacagagtgagactcggtctcaaaaaaaaaacaaaaaaaacaaaaaaaaaaaaacaaaacaaaaagtgagaccctgccacacacacacacacaattaactttttctccttccatgcctagcttgttgaggaaacaattttttttttttaaatacgtcgttcacccaaatctctgatggcaattattctgaggatcctgggattcgcagcccaccaccacctaaaccctgcggttcctaagttcttttttgggaggcagggatgtgctgtgcccatatacaggtgctcacccagccctgactcactcaagcaatattccccttccatcctgttctaaacccaggaaatataatgagggaatgaggcaagacaatccggccccacaggagtttatattcccctgggggaaatggaaaatcaacctacctaacacatggtcacgaagagaagcaatggtgatgctgtgttaggaaaaaaagaagaaagaagacagaaagaagaaagaagaagaagaggaagaagtggaagaggaagaagaaggaggaggaggaggaggaatatgaagaagaagaataagaagaagaagaagaagaagagggggaggaggagaaaggaggaagaggaggaggaaaacaaaggcaaaacaaaaaaggaccacaggagaatgggggagaagatgattggggaggagctactttaggggtgcgtcagggcaggctctgaagaggagccagtgaagcctgaggaagcattccaggagggaacagcaggtgtggaagccctgacaggggacaaatgtgaaagatactgtgtggcgtccacgtggccagaatgcagcaggtggggaggacaagggggttgggtagaggtcagactaggatctgggcagcagcaggtcatggggcttttgtaggtgataggaggaaatttagtcctattttcagtgcagtggagccactagccactctacagcggagaggaattttatctgctctttcttttgtttgtctaccacatggcaataggacgtagacatctttggggccaaaattctgtatgccacttgggaattcagacgtggaaatctctgaggtcattattctctctaacacatggggattaagacgtggacatctttggagtcattattctgtctagcacatggggattaggatgtggacatctttggggccattattctgtctcccacatggggattagaaagtggctatctttggggccatttttatgtctaccacatcaagattaggacgtggatgtctctgcagccattattctgtctagggagtggacagctttctgccacatgggattaagatgtggacatctttggccgaatcgcattgcctcccgtgcatgtgttatggaattcaccctctgctaatgcagtgaagatctgtgctataatattttgcactcttaaaatccaatcgcactgcaatcgctattctgcatcttctgtctttaaccttctcattctttgtttcctttcctgcttctattgctggaagggaagcagcccattttccctggaagtgcacttacctaccatccagtccatctcctctacgttgtccccatacagcccgtggagactcttcccgaggaagttctccatagtgataagagggatgtgaacgtgtagaaaggaaacaaagaggaggaaaggcccatgcttattcctaaaaataaatacgaagcaattaaggtgacttttttggtaaaacagagattgaagtcctgtagatactaaatacggatctcacttgtcacatcattactcaaatgtcttctcaactctgctcaccaaaaagaaacactcaaaactcttcttcaacggaaaattaattcttatatttaacaatcttccttttttttttttttttttttttttggctattttaaagacagggccttgctctgttacccaggctggagtgcagtgacatgatctcagctcactgcagcctcaatctcccaggctcaagtgatcctcccacctcagcctcccaagtagctggggccacaggcatgtgctaacaggcccagctaatttttttttttttttttttttttttttgtagagacagggtctcactatgtttactaggctggtcttgaactcctcggctcaagtgacctgcccctgcccatctcggccttccaaagtgttgggattacaggcgtgagccaccatgcctttctggtctgttacctctctctgtttttcattttgagacggattgtggctctgtcgcccaggcgggggtgcagtggcacgatctcagctcactgcaacctctgcctcccaggttcaagcaattctcctgcctcagcctcccaagtagctgggatcacaggcatgcaccacaacacacgtcttgtttaagactctttaacatcatgacttttcccttcccttctgaaatctatttaaaaatccacactgggccaggcgtggtggctcacacctgcaatcccagcattttgggaggctgaggcaggagcattgcttcagcctaggagttcaagaccagcatgggaaacatagcaagaccccatctctactaaaaatacaaaaattagcgggatgtggtgacatgcacctgtactcccaactgctcaggagggtggggtgggaggattgcttgaccctgggaggaggaggttgcggtgagctgagattgcgccactgcacttcagcctggacaaccggattgaaatcctgtctcaaaataaataaataaataaataaaaacccacactgatctaatgcatcttttcccccccgaatattataatgttctaactctactgcttaatgcaaagttaaaagaactgtaggttactgacatgacttttattttgttcaattatttcaatatctatttttaacctcaagctttagcttatagaataagtggtgccacacattccattttctttataattgctatcacgtagtgaggattaggacataaaatagttataaaaaacacactttacaaatgaggcatattgggttattcatattatttccattgtcctccttgaaagcagtgttttagcttctccctcccttcacccggccttcatggtctaatctagatccttgaagcctaagagcaatggtgaaggtgttagccttaattagaacacgtcaggctgggcatggtgtctcatgcctgtaatctcagcactttgggaggctgaggcaggaggatcacttgagcccaggagttcgagaccagcctgggcaacatagccagatcctgtcacatttaaaatcaaaaagaacacaacagtcttaccctgctttaatttgcaagctaattgtcaatgtcctttctgtcatacattaggtattgccatgaagaactctctaagaggctggatgcagtggctcacgcctgtaatcccagcactttgggaagccaaggcgggtagatcacttgaggtcaggagttcaagaccagcctggccaacatggcaaaacccatctctattaaaaatataaaagttatctgagcatggtggtgcatgcctgtaatcccagctacttgggaggctgaggtacaggaattgcttgaactcaggagcggaggtcgcagtgagccaagattgcaccactgcagtccggcctgggccatagctcgagactctgtctcaaaaaaaaaaagaaaaaaattatctaagaatgttgtaggagatgatgacaacctcattgtcaccaggtaaggtgacttttgatggtgttaccatctttactagaatgcccttggggagcatgaaaatagctgtgtagtactgagaactagtttcatcccatttctcctggtcccacacaggaattttccttgccataaaattgaccgcaggctgaattctgccaaaagacatctgacttctgaagatagacttttttttaagtttataattgattataaagcccttcaggtgatgcaggttacttaaatagtgtctgtggtgatccgaggatgctaatggaataagactgaccccagagtagtagcaaattccagctgacctgtaacaatttctttttgagacaaggccttgctctgtcgcccaggctcccttcatagcctcactacatagcctcaacctcctgggctcaagtgatcctcctgcctcagcctcccaagtagctgggcctacaagtccatgccaccacagccagctaatttttaaaatttttgtggaaatggggtcttgctgtgttgtccaggctggtctctaactcctggcctcaaattatcctcttgcctcagtctcccgagtagctgggataacaggtgtgtaccactatgcccagctcagctgtaacaatgttttaatggacacaaggcaagtcacagggctccactgaccctcatctatgccccattcttaccaaaaaattgtccttctaggtcatggctatcccattcttcaaacgtcaattaaagaaaacgactttttttttttgagacaggttctccctgtgtcacccaggctggagtgcagtgatgtgacctcacctccctgcaacctccacctcccaggttcaagggattctcccacctcagcctcccgagtagctgggattacaggcatgcacctgtaaagccccacattgggctaatttttgtatttttagtagagacggggtttcaccatgttggccaggctggtctcgaactcctgacctcaggcgatcctcccacctcagcctccaaaagcactgggattacaggaatgagccaccatgcctgactgaagaagactatttaggatgcgttttcattccaaagctgagtgcttggaggaagctgacccttttctgctgaccttttgagaaaggacgcaacctcctgcagaataaggggtgtcgttctttggaagcacatgggctgctccgtgatggtgtggtttctcatcagaaagcaatcggcatggacaatcagagcacccacaaaataggagcttgcgaggaggaggacggccgaaagggctgaccagatgaccggcatccacgagacgggtatcaggtgtgtgagcttccctgctaccagtgtgagggcaaccaaggccaggacttggaagaggaagttgagtttttgttccaggttgacacgcttctctgagagttcccagcgggcgcaatcacccatcaaggagaaaggcattccgtagaaatggtcaaagccatgatggagagggtggtggcaatgatcactggctgactcacagttgagacccagatgccattttcctgagaggcaaaaaggatgttgatgtgacaagcatctgagcataactggacatgtcgatattgactgtttgtcacattcctgatactctgttagacactggggggccaggagattgcaaagaagtgtgggcagcattagctgttatttgcaccacaatctggcctcatcgtttcaggggaatgaggaccccatgtgtcagctttaaccaaaatattagttacccgtgacaggtggaacaaattactgtaaaactgttcacttaatacaacagaaatctatcctctcccagtcctagagaccaggagtctgagatcaaagtgtctccaggccacactcaaattggaggctctaggggaggatccttcctgcctctcccagctcctgagggctccaggcctccctgggcttgtggccgcatcactccagtctccatctccatgtttccatggcgttgtcctctgtgtgtgtctgcgacctaatctcttgtctcataaggacagcagtcatcgcagtagggcccactgtagagacctcatctttacttgattatatctgcaatgactctattgtgagctggatcctggcctgcctcaaattcatgagttgaagccctaacacccaggacctcagaatgtgactgtgtttggagacagggtgttcaaaggataattaatgtaaaatgaggtcattagtttgggcactgatatggtttggctgtgtcctcatgcaaatctcaccttgaattgtaataatccctatgtgtcaagagtggagccaggtggagataattgaatcatggaggtggtttcccctacactgttctcatggtagtgaatgagtctcacaagatctgatggttttataaatgggagttcccctgcacatgccctcttgcctgccgccatgaaagacatgcctttgcttctcctttgccttccaccatgattgtgaggcctccccagccatgtgaaactggaagtccattaaacctcttttctttataaattacccagtcttgggtatgtctttattagcagcgtgagaacagactaatacaggccttaatctgatagaacttgtgtcctataagaagaggatagtaggacacagacacacacatactctctccagaggctctaggggaggatccttcctgcctctcccagctcctggtggctccagctatcccttggcttgtggtcgcctcactttaatcacactgctttctcctctctgtggcccaatcttcctctacctccatgttaaacgaagccttgtccttgcacagtgggcccagctggataattcaggatcatcttctcacctcaagattgttcacttaatcacatttacaaagactctttttgcatataagctaatatttgctagattcagaggttagggcctgacatctctgggaccattatttagtctattgcaccttgttttgcagtgcaatgatgaaggccggaaagcaccatgtgatatcagcagcatgggcaaaagacttctggactttggaattgttctctctttgagaaaccactatcatagtggccatggttgaagtgggtggtgggttttgcaaggcacacctttcaaattcagtcaaaggaatatagtctttgcttccatgtagccactactatggtgttgacaaagagatgtcaaccaccccaatgctgtctgccatctggaaaacctcatgatttcccaatggatatcccttaaggatagactcttctgtcttagaaaaattatagttggccaggcatggtggttcacaactataatcccagcactttgggaggccgaggtgagaggattccttgtgcccaggattgctggagaccagcctgggtagcatgggaagaccccatctctacaaaaaaaaaaaaaaaaaaaaagaaaaaaaagaaaaaattaaccgggcatggtggtgcaagcctgtagtaccaactgcttgggagactaaggtgggaggatcacttgagtctgggaggtcgagactgcagtgagctgtgactgcaccattgccctctagcctgagtaacagagtgagtaccctgtttaaaaaaaaaaaaaaagtctattggaaaaaatacacctttgtttgacagcgatgactgaatctccccagaatttgttttttttttttttttggtaaaaaattaaacaaagaacattttataatttttaatttttagaaatatagtttattgaattttatactcattgtatccactagtcatgttgtttgttatcaataaatggaactgttgataacaatcattactataacacaataatgataatggcaacttggtctcctctcaaggaactgttgtcattaattttatttttcatccaatacatgacatgtttgttgacttgtagaaaaataaccatgttagttatggaagctgacagggaggtactaaatctagtaaagacattttcatacacaccaaggggaaaaataggtagcattacagaaatttttgatgcaagaatatattttttcttatttttttttatcatggcctacgagaacattgtttgagatgccaaatatttcattaagttgatgttccttttctttctttctttttctttttcgtagagacagggtttcgccatgctgcccaggctggtctcaaagtcctggcctcaagcgatccacccaccttggcctcccaaagtgctgggattacaggcatgagccaccgcgcctgaccagagtcacttttgtaagggcactaatcccacacatgaggctccaccttcacgacctcatcacttcccaaaggcttcacctcctgccaccatcacctggggggtaagggtttcaacataggaattttagggggacacaaacatttagatggcagcactaaactagccaagttgatccataaaccaaccagaaaagagctgaaggtgttcagtctaagacattcatgtctaagacaaaaagtccatgtgaagggtgggagaggatcccacagaacaaagaagcaattatgtgttgtgcaatggagcttggaacatatgccataggcatgagcacattttatttattttttaatttatttttatgtatttttttgtagacgtggggtcttgctatgttgcccaggcgggtttcaaacttctgggctcaagcaatccttccgcctcggcctctcaaagtactgggattataggcatgagccaccttgcctgagctggtatttcttgagtatctactttgcagaaaacaacctggaaaggaacatggttcctagatacatgcagctttctgtctagtgggaaatcccacagcacctcacccactttcctttccaaactctttagctgaatgtcccttccatataaaagtcatgtgcttaccacttttaaaaacgtacataccaatgagtccagtggcatagcctttctctttcagtatttttgcaaaagttgtctcatttgttggaagacctccagatgctccggtccactgaagaacacggtaaccaatgctggaaaccatccctttgagcaattattaagagaaagaattactgttccacattttttttcctgtttgttatttattatttattcaaaaatagaacacttggtaaaaatctctcttacttaaaattaaattgaaaatggacttcctatatgactttgcctagtggattgcatttttggcagcaaagtaaatgattaatttattgaaaaccttagcgagaagatggactttcctgttatgtgcaggttataagcaatataattcagtgaaaaaggactaaaaatttaaatggttttttgtttgttaattaatttatttaaagatggggtcttgttctgtcgtccaggctggaatgcagtggtgtaatcaatgtccactgcagtctcaaccacctgggctcaaacgatcctcccacctcagctacctgagtagctgggactacaggtgtgcaccaccacacctggctaatttttaaattttttgcagagacagggtctcactctgtcacccaggcttgagtgcagtggcatgactatagatcactgcagccttgaactcctgggctcaactgatcctcccacttcagtctctcaagtagctgggactataggggctcatcaccatgcctagctaatatttttaattttttggcagagacggggtctcactatgttgcccaggctggtcttgaactcctagactcaagtaaatcctcccacctcagcctcctaaagtgttgggattagaaacatgagccattgtgcctgaactaaaaatgattttataatttcatcaaactcttgatataatctaaaggttctcaaagttgtctgcccattggaatcgtgtggggagcttcaaaatattctgacgcctggttatcaccccaggggtgctaattttcattggtcttgggtggaacttgggctttgggatggtgggaatatcctctggatgattctaacgtactgacaaggttggtagccactgataaaattttattctgctctccagacattccaaatctctacccaagggtttttttgtttgtttgtttgttttgggacagagtcttgctctgtcacccaggctggagtgcagtggcgccatctcggctcactgcaatctccgcctcccgggttcaagcaattatactgcctcagccttccaagtagctgggattacaggcactcatcatcacgcccagctaatttttgtattttcagtagagacggagtttccccatgttggtcaggctggtcttgaactcctgacctcaggtgatctgcctgcctcagcctctcaaagtgctgggattataggcatgagccaccgtgcccagcctctacccaagtgctttaaaatgtaggtgttatgtattattattattaaggttttatcattcagctatggcaaggccaacagatcaggagatgactgtcattggagagatagtttattactcacagtttctgatagtttattactcacagttcaagaggacgcaggggtgagccatgctgtgtgactatatggggaagctccagggttggtcaggaggcagagggagtgaggggaaagcatggaaaaagcctttcttatttattgtttttcttttttggaaagtaatgggcaaggtagggtaagccggcttaagactggccaggttgtacaatttccgtgggctttcatctgcaggggctgtccctagaaagctggtacctgattctggggggattagggcaaggagagagtagccccatatatgaaaatctcataaaagtgatggttgggggtgtgggctctggactgtttggtttatgcatgaaaggtgcactcccaggtgacttgtttgctatctctaagaattggctagccctgggagggccagtcctgccaaggtcagcaaagccctaagatgtcaaagcatcagaatataaaagctgcctgggcacggtggctcatgcctgtaatcccagcactctgggaggtcaaggagcggggatcttttgagcccagcatttcaagaccagcatgggcaagatagagagaacaccccccagtctctatttaaataaaaaataaaaaaaccaaaatgtaagaactagaaactgtgacgaatacaccaggctgcaccctagtgcagttgtaaagagagactgacctgatcgcacagggtatctgcccgtgaggaaggcggctctgcttggggtgcacaaagatgcggcagagatgtgttgggtcagcttcacgccgtcctctgcaaggcggtcaatattcggagtcctatggagggacaaattaacagctttacttgttaaaattagacaggcttttcataagcatagctacatgctacttcatagaaggtctgctggtcatcgctgagtgcttcaagatgttctcaggaatgacccaaaggtaatgtcaaagatttctaatgtcttctgaactttcgaggaaacatcaactcatttaaataggaatgagtggctggacgcggtggctcatgcctgtaatcccagcactttggaaagccacagcgggaggatcgtttagggccaggagttcaagaccagccgggccaacatggcgagaccctgtctctacaaaaaaatctacaaaaatagaaaaattagccaggattggtggtgcatgtctgtagaaccagctacttgggagactgaggaaggaggattgcttgagctcaggagtttgaagctgcagtgagctgtgattgcaacactgcacttcaacctgggtgacagagagacaacctgtctctaaaataaataaatgaatgagtagatagagtgactaagtttccacaaggcactgttggtactgagagaccgacctcagagggaatgcagaactgagagcccagggcaccttctctggagctcacagtgttcatgggaaggtttgacttcatggacgccaacacactgtaagtactacatgagggtggaaggctggaattcggacaggaggacggactagctctagctcttgacagatggacacgccatattttggcattaggagggtgtggacttgtctgtctgaagcagagcttttcagcaggggaggattgaaatcccgcataagtgctgggcttggctagatggatagggttgggagtgagacagagatcaatattggtcttctgcttacaggcaacgacactgatttctcctgtatgtttgtttatttgtttgtattttgagactgagtctcactctgtcacccaggctggagtgcagtggcactatttgagtctcactacaacctccccctcccgggttcaagtgattctcctgcctcagcctcccaagtagctgggattacaggtgcccgccaccatgcccagctaatttttgtatttttagtagagacgggggtttcaccatgttggccaggctggtctcgaactcctgacctccaagtgatcagcctgccttggcctcccaaagtgctgggattacaggcgtgagccaccacggccagcctactttttgaaacagggtctctgtcgcccagagtgcagtggtctgatcacagctcactgcaaccttaaactcctgggctcaagtgatcctcccacacctcaccctcttgaataactaggattacaggtgcatgccatcatgcctggctaattttttttttaatttaaaaattaatgtgccaggcgtggtggctcacgcctgtaatctcagcactttgggaggctgaggcaggcagatcacgaggtcaggagattgagaccatcctggctaacatgatgaaaccccgtctctattaaaaatacaaaaaattagcggggtgtggtggtgggcgcctgtagtccaagctacttgggaggctgaggcaggagaatggcgtggacccgggagacggagctggcagtgagccaagatcatgccactgcactccagcctgggtgacagagcgagactccgtctcaaaaaaaaaaaattaatgtttatattttctagagacaggatttcactatgtttcccaggctggtcttgaactcctggccttaagtgatcctcctgcctcagcctcccaaagggctggtattacagtcatgcccggctgatagcatttctaaagcattgtccattatgtactgggtggataaaaatcatatttaaaaaatgaaatgaggccaggcacagtggctcacacctgtagtcccagcactttgggaggctgaagcgggtgaatcacttgaggccaggagttcgagaccagcctggccaatatggcaaaaccctgtctctactaaaaatagaaaaattatccaggcatggtggcgggcgcctgtaatcccagctactctggagagtaaggcaggagaatcactggaatcgcagaggcggaggttgcagtgagccgagatcgcaccactgcactccagcctgggcaacacagtgagattctgtctcaaaaaaaaaaaaaaaaagaaaagaaatgaggccaggtatggtggtttacatctgcaataccagcactttgggaggctgaggtgtgtggatcacttgagcccagaagttcgagacgaggctgggcaacacggcaaaaccccacctctacaagaaacttacaaattacccaagcatgatggtgggcacctgcagtcccagaattactcgggaggctgaggcaggaggatcacttgaacctgggaggtcaaggctgcagtgagctgtgattgtaccagtgcagtccagcctggaccacagagcaagactttgtctcagagaaaaataaaaaataaaaataaataaataaaaataaaaatgaaatgagcagtcatatgtaggatggattgaggtgaggttagtgctggcatgggaagaaagtaacattagggagagttagaaaacgcagaagtgcagaactcttgaagtgtgaactgccaagatcaagggttatatgcattttcagtggcttctctttcttctggtgtctgcattgggggcaccaggtgagtaattctctgtcccttgcctcatggtgttgttgccatagcagccaatgtccccaatgccaaggtcgtccgccatcagaagaaggatgttcggtcgggaggcggaaatgtcgctggaagctgatggtgccaaacttagcagtacagcgagcatcgctggcagccagctcctgaaacacaaactgtcagagactgcgtcatgctcctgtccatctcatttgcagaacttgtgtatgggggaagttggcatcactattttaagaggtattgatattatcatcacatttcagaatagctttgaggacatctcttaggcatttgattgtttttctctggttacaattaactgataccgttgatggctttatttggccttgaagttttttgggttttttttgatgctgtaaagtctgttgttaagtgattaaactcatgattaacagaaagccttggtggggtgcagtggctctctcctgtaatctcagtattttgtgaggctgcagcgggtggattgctttaccacaggagttcaagaccagcctgcgcaacatggtgaaaactcatctctacaagaaatacacagcttagctgggcgtggtggcacgtgcctgtagtcccaactcctgggaaggctgaggtgggaggatcgcttgagcctgggaggttgaggctgcagcgagctgagatcgcaccactgcagggcaacagagcaaggctgtctcaaaactacaacagcaacaagaaaaagcaaaaacagccagaaagcctgccttagtcatggtttcttggatggatcgggtccccagaacagctattgccccttctccattccctcttcttcattgttcttccttaagcaaactgtgttgaacatagggaatggaggctggggttagggtttggaccacccagcagagcaaggaagagacacaagcttggggcaaggtgagaacacagtgagctgctacttctgagtctatgaaaaccctctgttcattgtagcacacagatgaaaatacccaggactgacttctttagcccactggtatctgatgagaagtgggtttggaggtgaaggaggttccagcctggaggagaaagccctggtagttgcgtaccatgagggaacatttccgcaggggttggtgacatacagcctgccactatcattgctgcctctttcatcgatgccaccctgggaatgcacatggacagcagggccatagtgtcccaatccccagtgggatgcagtaaagatgtaatctgagtctccaaggtttgtagtaggggaaaccctgattttccctggaaaaccagacacctggccgatggtagcggttgatgcccacctgatttgcagagaatgaaatacaattccttctgaggctgcctggggcaacatcaaatcaagggagcctggagcacatctattaatcacgggtctcatgcttcattctccagatgcaggataaatcactatcagtgcattctgagaaagcaccatcaagagatccagaagcggtcaggcgtggtggctcatgcccattatctgagcacgttgggaggccaaggtgggagcattgcctgagcccaggtgtttaagaccagcttgagcaacatggtgagaccctgtctctatataagaaaggaaaaaaaataaagaagggaaggaaggaagaaagagagagagaaagaaagaaagaaagaaagaaagagaaagaaagaaagaaaagaggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtggcaggcgcctgtagtcccagctactcgggaggctgaggcaggagaatggtgtgaacccgggaggcggagcttgcagtgagccgagatcgcgccactgcactccagcctgggcgacagagtgagactccgtctcaaaaaaaaaaaaaaaaaaaaaaaaaagaagagaaagaagggaaggaaggaagagaaagaaagaaagaaagaaaggagactactaatgagtgcatataattgtatcttaccaagaatggtgcagatgtaacatgttgtctctctctctacttcctgtaagacataaagatgtccacaatcacattgacagcagaaattgacctgattataaataaaacagtaagtaagtaattaggggaactttgattcccgttcatgatatcaatagcaaaaatatcttaaaacaatgatcaaaatctataaaggaatgctcttcccgagtgaaaaggcttcaaaaatgtttaatactatgttaagaatgtaaaacgtgtttcaatacacagccagatggtcttcagagaaagaggaagaaagtggtcatagggtctccatcccctttatcagctttcatagcccatgagtgatcacaaagtgatgagagaatcccagtgtccggaagcagattattttgtcttctgcttcccgagcccagggcaggggtgattcctaatgtccagaaatgcagagagagagtcctgatttggaagggggaagcggggaaagatcaaagcttggatgatacacaaaagaatctgagtagagggtatgaagatcagaaatacaatgagaggctgcgcgtggtggctcatgcctggaatcccagcactttgggaggcggaagtgggaggatttgcttgagcccaggaggtccagacttgaaaacagaactgggagtgtcagtgtgaaggaaaaaggcctagaggactctgcaggcactgagtgctgcatgaaggagagacgcattcgccttcattgctaggggtaggtgctgccgggagagggggcgaccattgcccacacttggaaatgttctgtccacagagggaaacgggcgacccccaaagcacagaggggcggcccctcagtctcgccgagaagtgagggagagcccagggtgtagagcaggaaaggaatgagatggaagataacaattagagttgcaggcagcaagaggtcaccttcagggtactgcagtggtctgaccccatgtggcttgtgcatgggactgaggacgaagctctgatttttctttttatcttgcccaaattcctatctaaggggtctggagagtcatgccctacaaaccaaaaattctcatcagaagggtttcatttaactatatattgtgacttactttccaatctgactctggcataacatgagaccaataagaaaatcaaaatattttacccaaaaacatgtttctttgccatatcttgaaatggccctgcaaagctgtcctttgtggggaaaaatttgcatctgtaaagatgtaaagaatctctattcacatagatattcacatctttttctaccggacccttccaatcctgaaaagattgactaagactctagcaccttttaaaagtctgaataggaaacaattgtcatctattgtctctaagggcagccgctacaagacttcaaaataaccttggtctccacaatcttttctcttaacctgaagatttcttttctagggatcccagggttttttttttttttttttaatctttcttttttatttttttgagacggagtcttgctctgttgcccaggctggagtgcaatggcgcgatcttggctcactgcaagctccgcctcccgggttcaagtgattctcctgcctcagcctcctaggatcccaggtctttagatgaactcaaccaattgtcaaccaggaaatgtttaaatctatgtataagctggaagccccctgactttgagttgttccacctttctggaccaaaccaatgtgtatcttaaatgtatttgattgacacctcatgcctccctaaaatgtataaaacaagctgcaccctgaccaccttgggcacacgttcttgggtcctcctgagggctgtgtcatgggccatggtcactcttatttggctcagaataaatctcttcaaatattctacagagttcgcttcttttcgttgacaggacatgggcatgcatagaagataaagagacaggagcatgcagatgtgttgggtttctgcctctgagtaaccaggggagtgacctggccacttttagaagggccgagcggccagtgagtgaggacacactggagccagcaggcactgagagcctagaagtggccgtggtgtctgtccaggtgaaacctgaccaaggatagacacagctggtgtgggagcggggagggcagagaggaggggtgggcaaggtccgcagggctgcgaaaccccagggtgtgagtgggagagaagcgattggttgagggatttcccctcaacgccttttcggggatgctgggaggggtgtttgctcctagcaggattcaggcacaaaaccagtcttctgagaaagacaatgagctttgtgaaaggaaaataaatctcaaggcccgcaagtcaataagctaaagggaaaagtcaagcggggaactgcttagggcctctgcctcccattctagtcaaagtcccccctttgctcactgagatagatgcgtatctgattgcctcctttggaaaggctcatcagaaactcaaaagaaggcaactgttcctctctcacctatctgtgacctggaagccccctccctgcttacagtcttcctgcctttgcttcaagttttccggcctttccagaccgaatcaatgcacttcttacattattgatggatgtctaacactgaattgctacatctccaataattttctgtctgtcgaagagaaaaagaccttagatatcatttgtgctttgtttagaacacagaaggaagggataaggtgtacgccgtgctcgtgaggtttttttgtttatttgttcgtttgttttaccctagagagcacacacaattctcatattctaaaagtaatagcaaaagacgcaattacgtttcaccaacctaatagcatcttcaccgggaaagagattgatttaaaattgtacatggagagaaaaccaaaatgagcattttaataccctcagcattgctttctgacctacaatgacatgctgccaatggtcagaaaacggaataaaagcaaaatactgtacaaatgtaatgagaaaaccccaaaccaccacaaactaggggaagatggtttttgcagcaatcctgcccagcagtggtttatctctgggtgtggagatttaggaaaagtgctctttttctaatttttcttttcttttcctttttttttttttttttttttttttgagatagggtctggctgtttcacccaggctggagagcaatggtgcgaccatagttcactgcagcctcaaattcttgggctcaagcgatcctcctacctcagcctcccaagtagctgaaactacaggcacatgccactatgcctggctattgatttttttttttttaagtagaggtggggtttcctcttttgctcaggctggtctcaaactcctgggctcaagcaatccacccgcctcgacctcccaaagtgctgggattacagacgtgagccaccgtgcccgacctaatttttctttctcccgcaatgttatgtatttataagtaaaaatatgaatattttttcttggagaaaaacgttaaataaataaagagatggtgataacagccttgaatgagtttaattttggaaactgtgacattgaggtgacccagagcatggggcctgcccaaggcctctcctgcagattagaaaacagatcccccttctccaggaaagagctgcattcctaggcctgtaagtcacgggtacgtttctgctttatcaaaacaaactgggcaattattcagagacagaaaagggaacggggagctctttgttcaccacgctattcatgcctggtcacggagcccaaatccagcacaaatgaacattcacaggactcacctctgctcctgggctccttcctgaatccccgatcaagaagaggaaggttctctcccaaaggaagcaagcgtgaaggcagagagcacttgcacaaggctttgagctgggaatgattaacttcgagtttgtttttcccaagtcagaagatcagagagagttaggacagacagagcagactccccccacatcgcagcatgggggaatctcaaagccacgcccacgtctaccaaaccagtggtcagtttccttaggtttttattttgttttattttttgtagagacggggttttgccatgtggcctaggctggtctcaaagtcctgagctccagtgatctgccctccttggcctcccgaagtgctgggattacagatgtgagtcaccgtattctgccagtgtccttaggtttttaagtgattgcctgtgctgttacacagggtgctggctataatatgatcatatccaacctggcatggtggctcatgcctgtaatcccagcgctttgggaggacgaggcaggaagattgcttgaggccaggagtttcagagcagcctgggcagcaaagtgagatgctgtctcttcaaaaataaaaaatattaggctgggcagtgtggcttatgcccataatcctagcacttggggaggttgaggcaggaagatcgcttgagcccaggacttcgagaccagcccgggcatcatagcaagaccctgtctctataaataataaaacaattagccaggcatggtggcatgtgtctctactgccagctactcaggaggctgaggtggaaagattgtttgagcctgggaggttgaagctgcagtttcactccagcctgagtgacagagcaagaccctgcctcaaaaaaaaatgttttaaagaagttatttgttgagtggtaaatgaagtaaataagaaataataaagataagataaaaataaaaaagaaaacatttcttaaagtaaataaacaaacaaacaaaagaagtaaaaaggccaggcgcagtggctcatgcctgtaattccagcactttgggaggacgaggtgggccgatcacttgaacccaagagctcgagactagcctggccaacatggtgaaaccctgtctctgctaaaaatagaaaaattagccaggcatggtgtcacatgcctgtaatcccagctactcgggaggctgaggcaagaaaattgcttgaaccccggagtcggaggttacagtgaggcaagatcgcagcattgtactccagcctcagcaacggagagagactctgtctcaaaaattatagtaataataataataaacataagataaaaagaaaaaaaataagcaaaaaaaaaagtaaaaaaaggattattttcaagcaatgcttggtttaaaaacatagaaaagacgggctgggcacggtggctcacgcctgtaatcccagcgctttgggaggctgaggtgggctgatcacctgaggtcaggtgtttgagactagcctggccaacatggcaaaaccccgtctgtactaaaaatacaaaaattagctggatgtggtggcgtgcacctgtaatcccagctacttgggaggctgagataggagaatcgcttgaacccgggagacggagcttgcagtgagccgagactgtgccgctgcactccagcctgggcggcagagtgagactccgtctcaaaaaagaaaagacaagacaagaccaagagggcaggaagcagtttctgaggcactgcatgatcattgctgggaagttactctgtagaatggaaccctacgcaatggtccctattattcaaccatccttgacctacaaggacggggtttcatagagttccacctgctgtctcttcgcaacttcatatgcagccacatgctgggtctgtgagaagtcacatagcctacctgatctcacttcctccttatgtgggggtggaaaccaccctacttctgggatgaggagctgacacgctggcacactccagcctgactcatttttacaagtggacggttttggtggcatgtctcaaaacgagtattaggaggggtgtcagaaatgttttcttttcctgccacaggtgtgtgccctaatggtaattgctttcactttgtgatttttggcaacaaatcttaagtcatttcctcgtagggggcctaaaggaatattttcacctatattttaatttatatattcataattattatatataatatagtataacttttgtacatcatacatagtataaatgtatcacataaaatatgtaaataaggctgggtgtggtggctcacgcctataatcccagcacttagggaggccgaggtgggaggattgcttgagcccaggagttcaagttaagtctgagcaacaaagtgagagcctatctctagaaaaaaaaaacaaaacaataaaatatataaatataatatataaatatataataaagcataatttttctttattaaaatatgcatgcttttctttacaaaaataatatatactttaaaatatatatgtacatatatgtatagatacataaaacatgtacatatacgtacacatctacatataaatacatgttataatatgcacgtataaatataaacatataacatataaacatgtacctatagacatctacatacatgtttatgtgttcatatatgtatgcttatatgtatataatgtatacatgtacatgcatgtatatatacatacatatatgtatacataacatatatacctataaaacatgtacgtatatacatgtaacgttaatatatgtactttttaaagtaaaaatgtttatgtgtgtatgtatagtacatatatacatataaaacaagtacatatatgcatataacatatatatgtacatgatttttcaaggaaaaagcatattatgggctgcttctgacttgcctggggaacatgactggttgtgtttgttttatcgggctggttatattggtgtctaaatataggaccctcaaacatgtttgaacagtcatatgacgtacggttagatatcaagtctgtggcctacctctgaactgatgtatttatgtatttagtgacacaataaaagcagatttttcttttccaaagaactctgcactttaacccttggaatgttaaacattttggtccagatttaatttttactactgaataaaactttctacttttttattctaaagacacaaggtatctttagaaagagacaagaggctgggcgcggtggctcacacttgtaatcccagctggcacactctggcctttgggaggccgagatgggaagatcacttgaggccaggagtttgagaccagcctggacaacacggcaagatcctgtctgaatttaaaataaaacaaaataataaaatatagaatacagtaaaatataatacaatgcaatagaaataaagataaaagaagcagacgaggaaacacccatgcaagactgacaatatagcctttgattctcttccggggagaaggaatcccagccctcctttcccgccctgagcttcagccccgggctgcgagcctgtgttcaacgcttcgcctgggccctgttcccaaacccagtttcgcttttcacctccggtgtctcttcgatgttcagtgcacgtgccttcagcatctctaagataagaatctagtgtggatgcaatgtctcccatttggtgcatcttccctcgttgctttttttttacgcattacgtttggaaatctcccatgtaaaatctgtacttgagattttcactgatgattattattattttttgaaagcaaattacttttaaaacattgacagggacttgtttgaaaagacgcagtttagcataaaagaatatcccctggagcgtctctgcacgtgcaaaagccggcctgtaagaagaagccccaggaaggccagttacctgacatgcagctgtgtaagggcgacactggctggatgtagcggggaggctgctccttggaagaaacgtcttcttcctgccaaaacagacacgcactggctgtctcggcggcactgaacggctggctcacgcatgtgcgtagctgattcactctgaaaagcaaaaacaggaattccgcagaaaccaagttaggttgtcccagaaacagatcaggcaagtccccaaggaatgtactgctgggtctttcaggcgtccacaaaagaccttctgttctatttgcagaacctcactctcgcggaaggagcccagacatctggtgctgaacgcggggtttttcaatggcaggaaggtggaatcccttcgggcttttgatgtaggcagagtgcatttcccaaagtggaaaagtggttttcttaaaactcatcttgaatcatcactccgtagcccttcaatttcacgcctttttctttccttttgctatttgcctcaaacataaaaagaagacaggaaacaattcaggttacagttgcaactatgactgtgtgtacacagccgcaactattaccatatgtatatagctgctcacctatgtgactctgtcactatcacttccgtttagctctgtgcaccaatgtgttttctcatctatttgccagggagcgcatttcttttttcatattgaagcagagcatacattgcaggcaacgttaggtgtaaaacgaatcacttcaaggactttttttttttttcaaataagagctgtctgcacacttctacgtgttgaatcacaaaaatattcatcctaatgcatttatagtctctatagcctgaacattgcagagttttgatttgagactcccgcttgccaaataagccctcttataaatctgcagctgcctacattcttcatgagtttaacacatcagaaagaacaaagcataggctcgacgggctgaggaacacctaccgctctaggccaagtctactaggttatgttgctcttgagggaaggctgtcaacactcatgcagttattttttgcacaagttgaacatcaaggagataaaaccgggatccaaattggaactcccaggttggctgaacttcagcctgactttctatgttctgggatgaggcatggttacgccactaccctactattgacctctgaggaggatgattctttattgtaggggccgtcctgtacattgtacaatgttgaaaagaatccctgggctccactccctagaagcaggtagtgatcaccacctcctccccagttgtgacaaccggaaatatctccagccgtggcacaatgtctcccgggggggcagaatcactccggttgaaaacactggtgttaaggacgtactttgcaggtgactggagaacacttaattacgatcatgctgggtgagccatttcaatttgtttctcatactcccacgtccttcagagctggtagcagaatcaagctccacacctgaaactcttagcacgaacgttatacaacagtacttgtcagctgcatttccaatactagcatcccaaaagagatactctcttagcatcaagtaaagtcatttactctttttttgttttttgttttttttttgagacaggggttcgctctgttacccagactgcagtgcagtggcacaatcactgtcactgcagcctcgacctcctgactcaaatgatcctcccacctcagccccctgaatagctgggaccacaagcacacgccaccacaggtggatcgctttttttttttttgtaaaaatggggtcttgctatgttgccccctctaatcgctaactcctggcctcaagcaatcctcctgcttcagcctcccagaatgctgggattacaggtatgagccactgtgcccatcctaacaatacatattctttagcaaagttcagatccccaccgtcatcctaaccttgtcttctgcacggagctttcgtctctgaacaaggcggacgttcgctttcccttgactccaagttgaactacgaactaaagtggtctcattgtcatcttgggcaccatatgctagaagaagcaagacaaatacaagacaacaacaacaacaagaacaacaacaatgtagcctgtgaggttagaagcaacatggaatcagtcatgttcgatttctctcattatttataattctgtaaaggtggtttcatccatctttcccaaacaaccacttcatattccactctagctggaatttatttatcctgggctatggtttaaagtgtcactgtaaagggtgacataaggagccactccttttgggcagaattccttctctacctcaaattccttctctacctggccaccattttccatattccttgcacaggtaatacttgaaaatattcagacataacttaacattttcatatgggttgcatacaagaagacaatctggaaatccatgtttctaaactagttgcttcagctttgacattatgaagaaaaagaaacgcccatgggggtaaaatggatggtttgtccacatgagaaaatgtcttatatacggtgatgtatttttaagaaaatctatgaaaagctatttttatctcaactatcatcatctactttgaacagaacctgacttaacaaaaagttaggtgggtgcagtggctcgtgcctgtaatcccagaactttgggaggctgatgtgagaagattgcttgagcctaggagttcgaaaccagccttggaacatagtgagacctggtctctaataatttttttttttaataaaaatgttgctgttactattgtgtctcataagtatcaaatcttttctaatctctttggactcctaatccctcacccattctgaagatgtgcatgtcagcatgcatctaattttaaatagcaaaacatttcttatgttgcacttatattgcatgtcataaatcaagagaagtcggtgaagagctacaaaaataccattggatagaagggataagttctagtatttgatagtacagtagggaaattatagtgaacaatgatttgtccagcctatgaccctgtctcaaaagttaaaatgaaaacaaaacaaaataatgatttgttttatgtttcaaaacagctagaaaagaattgtaatgctccaaacaccaagaaagtatgaatgtttgatgtgatggataccccaaattccctgattggatcatgacacattgtttgaatgtttcaaaagattacctataccccccaaatatgtacacagccaggcatggtggtgcacacctgtagtcccagctacccatgaggccgaggcaggaggatcgcttaagactaaaaggtcgaggccacagtgagctgtgattgtgccactgcactttagcctggacaaaagagtgaggccctttctcatgaaaaaaatgtacaatgatgatatattaattttaaaaaatgagatgagatttttcccttgacccccttcatgggccggaactggagtggctcatttcactcagcctgcagtccatggatgactaagtgttaacagcccagcaaagggtcagagtgacagccttctgcacctgccctttttgacacccgagttcttgtttggcatccaggtggtcacagaaatggattgaagggtagtgtatgcggaggattttactgggcgatggatgtggctctcagatggatgtgctctcagcagaatggggagttggaaaggggacggcgtgggaagaaggtgatctttccctgaagcccagccatctctgactgggctcccatctgaagctgcaccatctgaagttagcttctatttgtagtctcccttgctcagccacttgtatacccgacgctcagcagcttgcatccctgactgcttgcatcagctgcttgtgttgctctgccagcagaagtctggtttttatgggcacaggacagggggcagggcaggccaaaagggcaatcatttgggttgaaatatgggttcagctgttttcacttaggactaaggttccaggcttgggggtgaagtttagccaggagcccagttgttctgtaccattttccccctctggagaggcacatctaactgcccttagaaaatggatgacgaccagtctgagctacttcctgctgaaagagggcgttgtttggggaaaatggcagttagattcctcccagaggtctcccaagagtccccggcaaaggcgagccatcatccgaggctccggctgcctgcccatttggagccttgatggcctctaggtgaaagaataaacaagctttacaaggttaagtaggcatggatcaaacatgtgtattatacaaagaaagaatgtagtgcaaaacatctcagaaacaagaaataaaacaacactgtaccccaagctgcctcaccctggtgaaagaaattaaacctcgtatgggagcagttaaactttatgagccagagaagtgctctcgccacatctgtcggagttaacaggtgaatcttaggaattctgaggcttatgggcttgccggcgggcagtaaagtttctgcctctttcttgtgtctaaaagaccaaggtggtcgttttcaggatgtcctctaaagtactatctggtcccagggtctgtttctgagtataaactggaggtggaaaattgtgttggttgcccattctgaagacagggaattaggcttccctcaattctctttctcctttcagtgataacctggggtatgagggagagaggaagtgggcatcctcctttcctcttctatcttttcatccccaagtcccagcaaccttgacaggtgccacccatgggtgccaatgtggcttgcacccatgaagccgggggagcctagagaataggaatgattcacactcacctatgcctctacctcccctgctgttgacaacctttgagttccttggcaggtgccacccatggctatcaatgcagcttccacctgtgaagcagggaagacccagagaatgggaattatctgcactcacctatgcctctacctcccctaccatcaacaacctttgagtttcctgggcctcatttatgccatggagtatggcctccttccgtaaagcaggggtttaatggacaggaatttgtcctgcctatttacactgtgcctgttgcctggctcagatctggttttcctttctagtgcctcgacctgcagcttggaatcgagtttgagaccaaaaaaaaaaaaaaaaaaaaagtatttcaggggctgcatagatttatttagattaagtcccaaacaggccttgccaaatttacagctaacagcctgcagacaatgcccctctgtcgtttccccatcataagcagagtgctgacgtagacagagaactctcttacttggaaaagaagaaaaacaacttaaagtgcatggtggcgggggaagctggggaaagagcctcttgctctgtggaaatgggttcctttaaccactgcatccctcccccggttcagaccagctagactttcatgaagggaaacagagccaacattcctttttcctgaagaaaagagagaggaagcagggtctcagaaaagagacagatccaacaattccgcattttaacccaccctttgttgtatcccagacgagcctccagatgagataggattgttcccttgaccccctttgtgggcaggaactggagtggcttgtttcactcagcctgccattcctggacagctaagtgttaatagcccagtgaagggtcagggtgacagcctcctgcacctgcccttcttgacacctgcattctttttcagcatccaggaaaaatctggtcacacgagcagattgaaaggtagtgtatgtggaagattttattggcaatggatgtggctgccagcggaatagggggttggaaaggggatggtgtgggaagatggttagctttccctgaagtccagctgtctctggccgggctgttctcagaagctgcactgtctgaagttagccatgtctatctgtagtctccaatgctcagccacttgtatcccagccttcagcagcttgtatccccaaccacttgtgttgctctgccagctgaagtctggtttttatggacacaggatagcaggtggggcaggccaaaatggcaactatttgggtggaaaaacgagatcagctgttttcacttaggtccgaggttccaggcttgagggtggagtttagccaggggcccagccattctgtaccaaatagacatgaaatgaagtagaaaaaggttaaacaaactgagagagagagaaaagtgcccaaactctatgagtggcaacttcaagaaatcaagtaaagggtcccattaggacaataaggaaggaacctacaaatcagcatgactaaatgctgcttctaaggtccaacactgaatttatacccgctcgggtccacaaagaatagaagaggagacataaatggtaagataaaaggtgaaatcttcttccttggtctgtgctttttatctcatctctagcctatcccgtctttattttatctttatcaaagtggggcatctcctaaggcatgtttgtgagaaacaagaaagaaaaaactctcgtggagagagttagtataatcccagcactttgggaggctgaggtgggagggttgcttaagtccaggagttggagaccagcctggacaacatggcaaaacctggtctctactaaaaatacaaaaattagccaggtgtggtggctcacacctgtaatcccagctatgcaggaggctgagacaggagaatctcagagcctgggagtctgatgctgcagtgagacaagattgtgccactgcactccagcctgggtgagagaatgagatactgtcaaaaaaaaaaaaaaaaaaaaaagaaagaaagaaagaaaaaaagaaaaacatccaaaaaacctgtgagtcagaatttctacaggttggctctgtaccagaattgcctcagacagtttttcacattgtgggtttcaatcctcctttccagcttgtctgaaccatggcatttaggtttggactccatgcagtattgtttttttaaaaatctgtctagttgaatgtgcccaaccacaactgtgaatgcgtcacagcattcagctctaatttagctttttcttgctaaatatgtataaatatatgtataattctgcaaaagagcacttttctcagaattatacacatatttatacatatgcaaatgcacacacatatacatatacaaacatatatacatatactatacacacatgcataaatatatacacatttgcacacaaacatttataaagatacacttatatataccatacacacatatacacatacatatatacacatgcacacacacatacgtatgcatccacacatatacacatgtatacatacacacgctgtacacttatacatatgtatagacatgcacccacatacacatatatgcatgcatataccatacacatatgcataaatatttacacattcatacacacatagatatacacatatttatatgtgatacacacatgtatacacatagatatacatatacatataaacaccatatgtatacatacacacatccacatactatgcacatatacacatatacacatcatatatgtacatttacacatttacataccagacatatacacatatatgcatatatacacacataatgcacatatatgcatatacatatatgtacacatatatacctgtatacatacaccatacatatacccatactaatttatatgtatattttaaaatttttttgtagaaatggggtcttgatatggtgccaaggctgttcttgaactcctgtccttaaatgatcctcttgcctaggccttccaaagtgctgggattacaggtgtcagccactgcactcagtccccttactcatatataatgcacatgctatacacatacgcaaaaacatacacattcacacaagcacatagatatacacatatctgtcatacacatatatacacacatatctgccatacgcatatatacacacatatatgccatacacatatatacacacatatatgccatacacatatatacacacctatgcatataaatatacatacacacatatacatacatcatgcatacacacatatacatatataaaaacctataccatacacatatatctaaacatgtacctattaagaggcacacacatacatatatgcacatacaagtaccatatacatacatataaacatatatatactatacacacatagacacatgcatatatatgcgtatatatacaagtaacacacatgtacatatgtacacacaccatacacatatacatatacacatgcactcacatatatgtatgtgcatgcatatacatatacacataatgaatgtatatgcacatatcacacacatatacctatacatacatgcacgtatacatatacatgcatgtatatataccatatacataaatatacacacatgcatattgacatacacatagacatgtacatatacacatatgcatatatatacacatataaacacatattcttcagtaggcttgagaaatgcagttagagagacttaatttagctagcagcactggacggcctccaaaaaatatttagagttgcctggagtcttatttttaatttagtttttgtttaaaagcaatcaactttattgatcaatacttcacatacaataaaagtatcagttttaagcacacagttcaataagtttcaactaatgtatacacccaagtcactaccgccacaaatgaggtgtagaacatttttgtcaccccaaaatgttccttcatgctccttggcagttaaaactctttcaccccatctcccaatccctcactttctggcagctgctgatcattttttcatcattacagattacagttgacccttgaacaacaggtctgaactgcatgtgcccacttatacaagaattttcttccactctgccatccctgagacagcaagaccaagccctccttttcctcctcctcagcctcctcaacttgaagacaaggatgaaaacctttatgatgatctacttccacttagtgaacagtaaatatattttctcttccttatgatttccttccttcttccttcctctttcttttctttcgttctttctttctttcttttctccttctttcttttctttcttttttttttttgaaggtcttgctctgtcatccaggctggagtgcagtggtgcaatcatggctcactgcatcctcaacctcctggactcaagcaatcctctcacctcaacctccagagtaggtgggactacaggcacatgccactatgcctggctaatttttctattttttgtagagacagggtctcactgtgttgcccaggctggtctcaacttcctggcctcaaacaatcctcccaccctggcctcccaaagtgttgggatgacaggcgcgagccactgaccccggccatgattttcttcatagcattttttccctctagctactctactgtaagaatacagtatataatacacagagcatacaaaatatgcggtatattggctgtttatgctgttagtgaggcttctggtcaactgcaggctattagacgttaagttatgggggagtcaaaagctatgtgctgactacacccctaacccctgagtttttaagggtcaactgtaggtatacctgtcctagaagttcacatacatggagtcacattaagtatataaaatatttattttacgtctggcttctttcggtcaccaaactatttttaggattcattcatcctgttgcatgccttatcagtgtgttcctttttatagctaagtactagcagattctatagatatcaatccatccgttcttccccaactgatagaaacttgtattgtttccagtttgggggcaattataaataacactgctataaacattttttgtgtgtatggacacattttccaattctcttggataagtacctaagagtgaagtttttgagtcacatggagagttgtatgtttaacttttttgtttttgttttttggagacaggtcgtctcactctgtcacccaggctaaagtgcagtggtgtgatctcggctcactgcaacttccgcctcttgggtgcaagtgattctcatgactcagcctcccgagtagctgagattacaggcgtgcaccaccacacccggctaattttttgtgtttttagtagagatagggtttcaccatgttggccaggctggtctcaaactcctggcttcaagtgatccttctgcctcagcctcccaaagtgctgagaccacaggtgtgatccaccacgtctggcctattcaacagctgggcatggtggctcatgcctgtaatcccaggaatttgggaggctgaggcaggcagatcacttgaggtcaggagttcaagagcagcctgggcaacgtagtgagaccacgtctctactaaaagtacaaaaattagctgggcatggtggtgcacgcctgtaattccagctacttgggaggctgaggcatgagaaacactggaacccaggaggtggaggctgcagttgagctgagatcatgccactgaactccagcctgggcaacagaggaagactctgtttcaaaataaataaataaataaataaataaataaataaataaataactgagctgttcattttcttattattgaattgtaagaattctttatatagtccagaaatcagatgtatgtttggcacaaatatgaacggataatatattgtaacaatttgttgctttccttttcatttccttaacactattgttcaacgagcaggagtttttaatttcaatgaagttcaatataccatttaaaaaaaatagtgtgtgcttttgatgtccttttaggtaatctttgcctgcccctaaggctgaaactcctaagttttcttctaaaaattgtaaagatttacgtttacagttaggtctgtaatacattttgagtgttttgtttttttttttaatagcatgagagaaaggtcaaatttcacatcagttgttctggcactttatttgtttggaaaaccattttctgcctttttgcttaccttggcgacaatgtggaaaaattcataaatgagcgtgtcattcttgaattctcctttctgctccattgacccgtaactatgctaatccgagaccatacttgtttggaatcttttccccccttcttttcacatgtgtttatggaatcttacattttctttcttatatttttctttcttcttttgagacagagttttgctctgtcacccaggctggagtgcagtgccacaatcttggctcactgcaacctccacctcccaggttcaagcaattctcctgcctcaacctcccgagtagctgggactacaggtgcacaccaccacgtccagctttgagtacagaaagtggtggtggctacataaccctgtgaatgtgtttaatgccactgatttgtaaacctcagtgttccttcagaataaattgatcatgaatttattccttcagaataaattgatcatgaatttattccttcagaataaattgacattgatcatggtcaacatgataaatattaagctatgtatattttaccacaataaagaaaatccaaccaaaacaaaaaacggtccagaaaagactgaaggatgctaaagagacataactaaatgtaacataggatctttgattagattctggacctttcaaggacatttttgaggacatcaatgaaacttgaatgaagtctgtggattagacagtaattttgggtgatcatttttttgttttctttttagtttttgtagagatggtgtctcactctgttacccaggctggtctcaaactcctgggcttaagtgatctacttgcctcagcctcccaaagtgctgggattacagatgtcagccactgtgcctggcctgggagactgttaatttgttggttttggtgagtgttctgtgtttatgtacattgaatatcctaatctgtagtttatagggtttggctgtgtccccacccaaatctcaccttgaattgtaataatccccacatgtgaagggtggggccaggtggagataattgaatcatgggggtggtttcccccatactgttcttgtggtagtgaataaatctcgtgagatctgatggttttataaatgggaattcccctgcacaagctctgctgcctgccaccatgtaagatgtgactttcttcctcattcaccatccaccatgattgtgaagcctccccagccatgtggaactgtgagtccattaaatctctttcctttattaattacccagtcttgggtatgtctttatcagaggcatgacaactgattaatacagtaaattggtaccagatagtgggacacttctgtaaagatacccaaaaatgtggaagcaactttggaactggataacaggcagaagttggaacagtttggagggcccagaagaagacagcagaatgtgggaaagtttggaacttcctagagacgtgttgaatggctttgaccaaaattctgatagtgataagaacaatgaagtccaggctgacatggtctcagaaggagatgggaaatggtttgggaactggaataaaggtgactcttgctatgttttagtaaagaaactggtagcattttgtccagaaatctgtggaactttgaacttgagagatgtgatttagagtatctggtagaagaaatttctaagcggcaaagcattgaaggggaagcacagcataaaaatttgtaaaatttgcaacccaacaagaaaagaaagctccattttctggggagaaattcaagctggctgcagaaatttgcataagtaatgagcagccagatgttaatcaccaagacaataaggaaaatgtctccaggacatttcagagactttcacagcagcccctcccatcacaggccctgaggcctaggaggaaaaagtggtttccagggccaggtccagggcacccctgctgtgtgcagccttggaacttggtgcccttcgtcccagcccctccagccatggctaaaagggaccaaggtacagctcaggccattgcttcagagggtggaagccccaagccttggcaggttccatgtggtattgaacctgcaggtgcacagaagtcaagaattgaggtttgggaacctctgcctagattttagaagatgtatggaaatgcctggatgtccaggcagaagtttgctgcaggggcagggccctcatagagaacctttgctagggcagtgtggaagggaaatgtgtgtttggagcccccacacagagtccacactggagcactgtctagtgtagctgtgagaaggggtccgccatcctccaggcccaagaatggtagattcaccgactgcttgcactatgtgcctggaaaagccacagacgttcaattccagcctatgaaagccactgggagggaggctgtaccctgcaaagccacaggagtggagctgcctaagaccatgggaacccccctctcgcatcagtgcaccctggatgtgagacatggagtcaaaggagatcattttggagctttcagatttgaccacccctctggattacaaatatgcatgggggctgtagccccttcatttcggccaatttctcccatttggaatgggtgtatttacccaatgcctgtatcctcaatgtatctgggaagtaactaacttgcttttgattttacaggctcataggtggaagggacttgccttgtctcagatgagactttggactgtgaacttttgagttaatgctgaaatgagttaagactttgggggactgttgggaaggcacgatgggttttgaaatgtgaggatgtgagatttgggaggtgtcagaggaggaatgatatggtttggctgtgtccccacccaaatctcattctgaattttaataattcccatgtgtcaaggatgaggccatgtggagataactgaatcatggaggcagtatgtcctatactgttctcatggtagtgaataagtctcatgagatctgatggttttattcaggggagttctgctgcacaagccctctttcatgacaccatgtaagatgtgactttcctcctcattcaccttccaccatgtctgtgaggcctcaccagccatgtggaactgtgagtccactaaacctctttcctttagaaattctcaggtgtgtctttattagcagcatgagaacagactaatacagtagtaaatacaccctgaacaattacactataataggacatcttcttttcaagttattctcaaagggcttagaaatgttagcaatcggggaaaatctatgtaaagtgcatatgggaggcctgggtactgttcttttcccacttttattcaaatttgaacttatagtatgacaattttttaaaataaatgtattctggttcaaagtgcccagtatgatcagtcgtagtccatagtgaacagctttcatcacgcttccccaaatattttgaaaacccctttcaggctagacacagtggctcatgcctgtaatctcagcactttgggaggttgaggcaagaggatcacttgagcctgggagttcaggaccagcctgggcaacatagtaagacccccaactctatgaaaaggaaaaaatattttaaaggggaaaagaaaactccttttgtaatttgatagtttcctatctgggctttattctagaccgactgaatttggcattctgcaggaaatgttccagaaaccttcagtcctgagaagcctctcagttaattctgatgaaaattaaattttgagaacccctggccaggcataaagtgtggatcccatgagtaaggtatgtggagatgaaaactaagaagtggtcttgtcacacaagaatacaatctttaattcacatcatcaatgctgtattttcttttgtttcctttattattattattattagagacagggtctcattctgtcacccaggctggaatgcagtggcacgatcatagctcactgcagtctcgacctctctgggtgcaggtgatcctcccatctcagcctcaatgttgtatttgagagctgatttttacagtgagcttaacattttgaagtgtagtgctctgattaattagaaacacagattttcagaccttatcttcactttttaatttttttgagacaggatcttgctctattgcccaggctggagtgcagtggtacaatcatggctcactgcagcctcaacctcctgggctccagtgatcctcccacctcagcctcctgagcagctggaactacaggcatgcatcaccatgcctggctaattttgtgtgtgtgtatttttgccagagaggcagtttcattatgttgtccaggctggtctcaaactgctgtcaagcgatctgcctgccttggcctccaaaagtgttgggatcacaggcgtgagccactgcacccagcttggagtgcattctctcccagttcggcagggccacattccctctggagactctaggggactaggcttccttgcctatttcagcttctggtgcttgccggcaatacttggcattccttggtgtgtagacgcatcactgcaatcaccctttccattttctcataagtggtttccctctgtgcatgcctgtgttcctccttttctttttccttatttgtttatttatattgaagctatgcatgaatgtttctctccttcctagaaggacaccagtcattgcctttagggcccaccctactgcagtaccccttcagctcaagagcctattcccaaatgaaatcacactcacgtatacatgagggttaggactttaatgtgtcttttgtcgggggacacacttcaacccacaccagatggataaagcagaggctttgtgtaggtagaagcagaaatgatgcaattcccattttaggggatgggttcctgtaaatcctgcctgctcagaagggcaaatgtagaaccaacagcagccatggtgacacctggtagacgcggaggccttttggctatcaaccagacctatatgcaagcagtttagttgtccctaaaagactcccccagtttaacgaggaggcatttggaagcaggagaggagagaacttaggcgtgtcttatcaataggattccactgcacccacaaactggtgaagcaaggagagaaagctacagatggaaattacttatactatgatgcagtggtaaacatttgactcaacttagcagaacaaaacccaaatggaaataatgatggtggacacagtgaggtgctcctgtgtaacactgatgcttcttggccagcactgtcctgatcttgccaggagatgccagcagagtgaggttgcgctgccccttggctgggagggagtgcaagacgcatctcaaattcagaagcgttgacaccgggagctctgtggttattttcttccatgctgtggattatcttcactcttttgatagtgtcctttgatgcaaaggattttcaatattggtgaagtccaattactctgtattttttcttttattgcttatacttttggtgtcacattgagaaactattaccaaatctaagacctatctatctggatatctatctggaaagccctttccagagaaacagaaccaataggaaggatagatagatagatagatagataacagatggatagatatatggagggatagatagagtgatagctagatggagggtggatagatggatggatagattgatagatacatagatagatggatataagagagatagatagagtgatagattttggtaaagtctaattactctattttttttttttttgtactggaaggaccagtacattaatataagtcatgacttttggggtatttttttgtggtattttttagagaccagccttgctctgttatcccagctggggtgcagtggagtggttataggtcactgcagccttcacctcctggtctcaagggattctcctgcctcagtctcctgagtagctgggaccaccatgcccaacaaattttttttttttgagacagggtctggctctgtcgcccaggctggagtgcaatggtgtgaggctcactgccacctccgcctcccaggttcaagcgattcttctgcctcagcctcccaagtagctgaaattacccgcacatgccaccacacctggctaatttttgtatttttaggagagacgaggtttcgccttgttggccaggctgctcttgaactcgtgacctcaggtgatccacctgcctcggcttcccaaagtgctgggattacaggcgtgagccaccacacccagcctgtgtttgtttttttgtagagatgggggtctcagtatgtggccacggctggtcttgagctcctggcccaaagtgatcctcccacttcagcctcccaaagtgctgggatgacagatgtgagccactacgaccagacctcattctggtatcattctttgcctcacttcctccagtatgggatcccaaactgcagaggctatggagttagagtgacgatggcagaacttagagaatcagtgcccagctagggcgcttcccagctgtgtgacctcggataggttactcaatctctctgttgttgttgttgttgttgttcttcttcttcttcttttcttctcctccttctccttcttttcaaatttaagaacttctctgtctctctgttcttcttcttcttcttctttttttttttaatgttttgagatagggtcttggtttgttacccaggctgcagtgcagtggtgctatctcagctcactataaccaccccctcccaggttcaagcaattctcctgcctcagcctcctgagtagctgggattacagtcgtctgccatcacacccagataaattttgtatttttagtagagacagggtttcaccatgttggccagactggtctcaaactcctgatctcatgtgatccacccaccttgacctcccaaagtgctaggattacaggtgtgccgtcaacctctctgtttctcgatttcctcctgggcaggatggtattggagtgcccactggtgagatcactgtggggactacacctaacaccctttgaataaggtgagcgggacacacagaaacactgaggactgatggttattcttggtagctcatgatccagcccctccctgtcactccgtacgtactccctggattgagtgtctcacaacaaagacattttctgccgcactgaaatcagatcatggtgtgttttgcctttgagtcattttggactccaaggtaacatgtaagtgtgtgtctatgtaactttccagaaattctttctagaataagctctgctttggactctattttccccctcagggcttccactggatcttccagtccaggaatgtatctgaccttcccaatacattgatgggctttagtactttattttactattttatattttatgtttttttttaaattttattattattatactttaagttttagggtacatatgcagaacgtgcaggtttgttacatatgtatacatgtgccatgttggtgtgctgcacccattaactcgtcatttagcattaggtatatctcctaatgctatccctcccccctccccctaccccaccacaggccccggtgtgtgatgttccccttcctgtgtccatgtgttctcattgttcaattcccacctatgagtgagaacatgtggtgtttggttttttgtccttgggatagtttgctgagaatgatggtttccagtttcatccatgtccctaaggacaatgtcacagtaacctacatgtccactgaaggcctggaagtagtcatctatcttggtccttcatggatttttttgtttgtttgtttttatttccttcaactatttatttatttatttatttttgagacggagtctcactctgtcgcccaggctggagcgcagtggtgcgatcttggctcactgcaaccttcgcctcccaggttcaagcaattctcctgcctcagcctcctgagttgctgggattacaggcaactgccaccacacctggctaatttttttgtatttttagcagagatgggatattgccatgttgaccaacctactctcgaactcctgacctcaagtaatccacccacctctgcctcccaaattgctgggattacaggcatgaggcacggcactcggcctccttcaacgtttattttcagttctggggtacatgtgcaggatgtgcaggtttgttacataggtaaacgtgtgccatggtgatttactgcacggatcattccatcagccaggtattaagcctagtatccattaggtattcttcctgatgctctccatcctcccatccccacttccaacaggccctagtgtgtgttgttccccctgacttgttcattgttctcatccatcagctcccacttacaagtgagaacacgtggtctttggttttctgttcctgcattactttcctaaggataatggcttccaacttcattcatgtccctgcaaagacatgatttcgttcctttttatggctgcatagtattccatggtgtatatgtaccacattttctttatccaatctatcattgatgacatgtaggttgattccatgtctttgctattgtgaatagtgctgcaatgaacatatgtgggtgtgtatgtttataataaaatgatttatattcctttaggtatatacccagtaatgagattgcttggtcaaatgttatttctgccttgaggtttttgaggaattgccacactgccttccacaatggttgaactaatttacacacctatcaacagtgtagaagtgttactttttcttcacaacctcatcgacacctgttgatttctgtctttttaatatgagtcattctgattgacatgagatggccctttgttttgtttgtttgttgcttttgtttctgtagatacagggtctcagtatgttgccctatctttcacagagacagactggtcttgaactcttgggcacaagtgatcctcctgcctgtttctcaaggtgttggaattacaggcaagagccaccatgcctggcctccactctggctcttttgtcttgaagaaagagtaaatatttctggcttcctctaaagctggaatcagctctttaactgaactagaatactcatataggcacttttcactaaaattatttattgtaagaaataagaaaactagttgaattcctctaagctcctatttatggtctaaaatgtcattgagaatattgttatgttgttgggaatataatcattaaggattattcttggctgggtgcagtggctcacacctgtaatcccagcactttgggaggccaaggtgggcggatcacctgaggttgggagttcgagaccagcctcgccaacatggggaaaccccgtctcaaaaaaaaaaaaaaaattagccaggcgtggtggcacatgcctgtagtcccagctacttgggaggctaaggcaggagaatcgcttgaacctgggaggcagaggttgcagtgagccgagattgctccattgcactccagcctgggcaacaagagcaaaactccatctcaaaaaaaaaaaaaaaaaaaagaattattcttatgtctgcagtctgcatagtttgcatgttatttattgaaaaggcaaatgcaagtatatataagtctaacagtgtcctaaaaagatgctcatttttttgtaacttttaactggagttatttttcactaaatttctcatatatgcatcttgtcgtactactcttacccaaaacaaccccactctcccccaaccacagttaccacacacataataagactttaaccaggctgggtgcagtggctcacacctgtaatcccagcacttttggaggccgaggcgggtggatcacgaggtcagaagattgagaccagcttggctaacatggtgaaaccctctctctactaaaaatacaaaaaattagccgggcttggtggcacacacctgtagttccagctacttgggaggctgaggcaggagaattgcttgaacccgagaggcggaggttgcagtgagctgagatcatgccactgcactccagcctgggcgacagagtgagactccgtctcaaaaaaaaaaaaaaaaaaaaaaaaaagactttaatcaatggtgaaaacaaatgagaatgtcttgtgagaaaagtgcttcatgaggaatgtctaagctaatctcgcatgaagcacgtctcgatacttccacatataaatgcaggtaataacgttcacccacctcagaggagagtgttgaggttgaggctttatgatgcactgcttgtaagatgcatttagacccaaaggtggaagctgtactgtaaagtctgcagtcatatttcaaatgctgaaattcaccctgttagaattctcttccctcttcacttccttttaagcccaactgtagctcttggttaacttttctaaaaaaaattatcttcatggaaagcatattcaattttatagaattcccttcattccatatgtatgagtgtcagttgaaaggctgagataaattattcctttcttaaataactatgtaatagctgtcatggtaggttatgtttaatataaaaataattggtagactagagcagtgtccagcctcggcacttaatagatatttaattataataatgacaagagcaactaaggactacggcaggatcttggaattgtagaatcagtgtctgcaaatgcaggagctggggaatcaacttattgtaagtaaggaaaatacgttaagtttcctgtaattgcagttgggcatacttaaaattttaggtaaacaatggggttgagagtgaagagttgagtagttgttttatctagttttttttgttttttgtttttaacatgtttccaggtttttatctaaatgggctaatacagtacatactgttctgtgtggcttctcatgacatccatgaatattttgcctatatcaatagttgattcctagttattttcgagttgacttctattggattctggctgtcccggagtggattttccactcacctgtgagtggatgaacactttgggtgtcaaatcatattttccgtagtggattttatagccatcggtggcattcctatttaagactagtgatgctaatttcaggaagagaagagaaccaaatagacatatccaagaccacagaggtagattgttttgtggttgaattaggaagtctacacaagtaagtgtgaatacccaaaggcttgtattttatttttaattctctaagagggtatttgttataatatctgaaggggattatgcatctcatagcattgcaatgaataaatgaatattgtattttcttcactttttaaaaaatccaatgttgacttacattgtataatatacaaatttttgccactttatagagcagacttccttatgttacatttactttcatactgggtatattttattttactttattttttattggtagcgtctttctgagtaaaaaacaaataatgaattggtaagatgtatctcattcaatgtaagaacctaatggttagaaaagaaaaagaaaggtttttagttacttacttatagtttttctatactgctgagtatttttctttctactttataataataacattccaagaattattgaatatcagaccatttgtgggaagtttgggaatgtgtgtaaatttctttagaaatctttaaaaattacttctatgtgtaggtgagaaaccgcataagaaagcagaaatctagtaacaagtttcttccagcggtgaatgagtaaaataaaacacataaggcactgctaagttttaattatttaactattttaattaaaaaaataagatactatcagctaaggatagcatagcttatattccaaatcaataactctttgaatgagaaagccagaattttgattcattaatatacaatgcagcatttggtgtcatccaagaagatacttttcataagttccccctattctagttgcaagtaccgtttggtgtctttattcttttctttgagagagggtctcactctgtcgtccagcctggagtgcaccagtgtgactgtagctttctgtagcctcgacctctggggctcaaatgatcctcctgcctcagcctcccaagtagctgagactacaggtgcacaccaccatgcctggctatttttattttattttgttttatttcttagtagagacaaggtctccctatgttgcttaggctggtctcaagctcctgggctcaagcaatcctcctgcctaggccttccaaagtgctgagaatacaggtgtgagccaccatgctggccctcttattctagttttaccataactagttctagtctataaattcccattattttagctttgtttcactgtgaggaggcggtcattctgttcccttggaaacccttggccatgtctggagacatttttgttgtcacattggtggggcgtgggtggtcctggaacctggtgaatgaagctcagggacgctgctcaacaccctacggtgcccagggctgcctgtgtcctccagaaaaaaaaaataagctcttttcttccattccctatacccctgaaaaacgcgcagtcctacacggaacccacagcgaattttcaccaagcacgtggccaccaagtcatccagctccaaatgtcagctggaccaaggtggaaaaagcctggtccagtgcattttacccagatcttcaaagctcctctcacccttgtgtctcccccatccgtgtggagctttacttctgtatagatcctcaggaatcgcctctgctcttgctgcctttacagactccctctctaggtttgtgtcctgagccaagaaaggaagaagaaattccagtgaaaagtgtgacaaattacatttctccacgttaaaggattcaaccaactgttgaatcctgatgaattttgtctgggttgtgattatgtcttagactttcttgtctaaactctactatcatcaagataacttggtgaaaattcactgcaggtttcattcaggacagcacagtttgcaggtgtatagagaatggaagaaaagagcttatttttttttatctggagaacacaggcactttcaagagtagcttcagtgcctataatatttttgttaatgaatattaatggagtattttaatgaatgcagagactgctttggattttattagttgaccttaaacagcactttgctcatgcagcccaatttacctacatagacctgggagcactgatgttattaccatccttcgtcattgagaacagaaaggttaagaaggtgatgtccgggtagtgttgctgtttcctgagatgaaaggtctcataaaagtaattattgttttggtttcacctgcggtggggaaatgccttgtagaattatacagttctaccatcaaagtgacccaggaaaccgaagtgactgagggcatctctcttgttattttaattttaaaaattttacatcttaggccagatgtagtggctcatgcctgtaatcccagcactttggaaggcagaggcaggtggatcacctgaggtcaggagttctagaccagcctggccaacatggtgcaaacccatctctactaaaaatacaaaaattatctgggcatggtggtgcacgcctatagtcccagctacttgggagggtgaggcaggagaatcccttgaacctgggaggcggaggctgcagtgagccgagatcgcgccactgcactccagcctgagtgaaagagtgagacgccatcccccccaccaaaaaattacattttaattgataaatcatatttatacatatttttagggtacatgtgatatttttatacctgtatacaatgtgtaataatccaatcagagaaatcaggatatttatcacctcatttatcttttctttgtattggaaacattacaattctttcttctagctattttgaaatatgcagtaaattatctaatctccctattttattttttatttttattttattttgtaatttattattattgttttttcataatagaaatggggtttcaccatgttgcccaggctggtctcaaactgctaagctcaagctatcctcccacctcggcctcccaaaagactgggattatagacgttagccaccatgcccggcatatttttgtttcaataaaatacagccaaggtttcactatgttgcctaggctggtcctgaactcctgagctcaagtgatcctcccaccttggcctcccaaagtgctgggattataggtgttagccaccatgcctggcctatttttagtttaatagaataaatagagagaaggtctcactaagttgtccaggctggtcctgaactcctgagctcaagagatcctcccacctcggcctccctaagtgctaggattacaagcgtgaaccaccacacctggccccagtctccctattttaaaggaaacagcattccagattcagtacgaagacttgcaaaagccacatattgaattaatgtgaaacaggcatcatctctggtttttttttttaagttaaattttaaacaactattatagataaagctcaacttggccaaaacctgtcttcaccactgtggctcctgactttacctgggggttgcaattcctatgagccttttccttccagatatctgccccactttgataaacattaatgaaaagggaaatgttgatgtgtgaatgcgttaaataaaaggtatcatactgtatatattttcagaaaacttatttaaattgaaaaaatactgtactatgtatcttggaaatctactgctattactagacatagaactatcttactcttgatctgatgcatagaatctcatagtaggaatatacaccaatgtatttagccaatctacttcaaagaggggagatttcagttggtttcaatatgactctacttaaagacaatgttggatgaaacatccttcctccatcctggctccctgcactgagtgtggggctagaagcacgagtgctttgctaaaatttaggctcacttttaagtcttgatatttagtggcaactgaaggtaacttgctgtgaattcttcttataacatatattttcacactttaaaagtttttggtgttttgatagtgagccattctatctcattatccttaacatttactttttctagttgatgggaaagttaaaaatattttatgtgcctattgataatttgtaatttttggggtctcttttctaatttatttatcgaaaatatggccaggtggagtggctcatgcttgtaatcctagttcttctgttcctggaccaaaccgagggtttggctgctatttcttgcggctcaataatgagatgcagatgaactgagagagaagggagtttttatttctgtaaccaggtacagggagaaggcctagaaattattgccagaccaactcaaagttacaaagttttctagagcttatctacctgctaagcaatgtgtctatcagtaagtgtgcactcatctaaagacattagtgatgaacttcttctaatctagaacaaaggtctgagtcctgaagaccttcctctggagcctcagtaagttcatttaatctaaatgggtccaggtgctggggtgattacccttatcttgtctctcgctaaatcatggaggtttgaggagttctttcagaccctctataaacttgtttgtggaggtctggggagtttcatcagacccccaataaaacctgtttaatcctaaacgggtcctgttaagaatgccttcgttgtcttgtcatgcttcaaggcccaggagaggcctgggcagaactcttggtgggcttttgtgagattccagcctttgtataagggcgctggctctctcagcttttaatattgaacttcaccactcggtcagtgctgaaacagatgtcatggaggcctgcgttagtgagacctggcctgccacactttgagaggtcgaggtgggaggatcacttaaggccttaaggagtttaaaaccagcctgcaaaacatagcgagaccctatctctacaaatagtaaaaaaattgccaggcatggtgcacacttctagtcccggctactcaggaggctgaggcagaaaaattgcttcagcctatagttcgctgtgctccagcctaggtgacagagcaagactctgtctcaaaaaaaaaaaaaaaaagggaaatgttacagagattttttccttccctgtaactcctttttgctttgtcgatggtctataaaactgttttcagttatttatattagtttcttgtggctgctgtaacaaaataccgcaaactgggtgacttaaaatgacagttattctctcctggtactggggaccagaagtctgagatccaggtgtgggcagggctggttcctcctaaggcctctctccttggcttggagatgctgtcttctccctgtgtcctcacatggccgtccctgtgtgtgtgtgtgtcctcatcttctccctttataaggacaccagtcagattggattagggccagccctggtgatctcattttaccttaattatctgtttaaaggccctgtctttaaatacagtcacatcctgggggactaggagctaggatttcaacatataactttttggcagacacaattcagcctataagagattccactccttatttaatcagaggaatttaaagatagctactttaaagtcctatcctggtcgggcacagtagctcacacctgtaatcccatcactttgggaggccgaggcaggcagatggcttgggttcaggagttctagatcagcctggcctgcatggtaagaccccatctctacaaaaaatacaaaaattagcctagtgtgatggcttgtgccagtggttccagcgactcgggaagctgaggcaggaggatggcttgagcccaggaggcagaggttgcagtaagccaagatcccatcacttcacactccagcctgggtgacagagtgagatcctgtgacaaaaaaagtaaaaaaggaaaggcaggaagacagggaggaagggagggagaggagagagaaaaagaagaaaagaaagaaaggaaggaaggaaggaaggaaagaaagaaagaaaagaatccactgcactccagcttgggagacagagccagactgtctcaagaaaaaaaaaaaagcacgaaacacaacaacaacaaaaaacagatgactcaggataagattctttccctttctttctttctttctttctttctttctttctttctttctttctttctttctctctctctctctcctcctttccttccttcctttcttccttccttccttcctttctttcttccttcctttcttttttgtcacaggatctcactctgtcacccaggctggagtgcagtggtaggatcttggcttactgcaacctccatcttgtgggctcaagcaattctcctgcctcagcctcctgagtagctgggattacacgcgtgtgccaccacatccagctctttttttttttttttttttgagtagagatggggtttcaccatgttggccaggctggtcttgaacttgtgggctcaagcagtcctcctgccttggtctcccaaagtgctgtgattacaggtgtaagccaccgcgcccagccgctgagtcatctgctaattcactggacttctgcacaaataatttccctcattcattgctgttggctgaccccaactgtgtggtgactccataataggccatcattaaccatcatcaaattccctgtgtcctggctggtgacatctcactccagtcttataggtgtttctctggcaccctcagatgcttccagcattgacattgctagctactgtgggttcccatctgtcttccttctcttctagagcatgactttaaaaaaacaaaagaaaacataaacaaaaacaaaaaaccatatctttcttgtttttaaagcatgactgcgctcttgcaatctttgtctaattctgtgactttggcccagccgtgttcaaagtccaccattctgaaatggaacccagaatttggttttgtgatgtttgatctttcttcttctcccttttcccactgtagtgtttccttctgtttttttttttttccacttaagagtctcaatcaagttgatgatgtgtagacagtcctcagtgaccatttattttattttttagtataaagtaaagggctacaagtgcggctatgttgcatggatagattgcacagtggggaagaccaggttttcagtgaatacatcacgaatagtgtacattgtactcactgagtaatttctcattcctcatcaccttcccacccttctgagtctccagtgtctattattccactctctatgtccatgaggacactgtgtttagctcccacttataagtgaacatgcagcatttgactttctgtgtctgagttatttcacttaagataatgccctccagctccatccatgttgctgctaaagacttgattttattcattttttctggctgagtgcatgtgtgagtgtattatataaactggatatacacagatatatatatatctcacatttatttaaaaacacacagaatggccagatatagatatatgtatctcagatttcttacatatataaatatgtgtgcgtgtgtgtgtataatctctcattttcttttaacttttaatttttattttaagttctggggtacatgtgcagcatgtgcaggtttgtcacataggtaaacgtgtgccatggtggtttgctgcacttgtcaacccaccacctaggtattaagcccagcatacattagctatttatcctaatgctctccctccccctactcttaccccccaacaggccccagtgtgtggtgctcccctccctgtgtccatgtgttctcattgttcagctcccacttataagtgagaacatggggtgtttggttttctgttcttgtgttagtttgctgaagataatggcttccagctctatccatgtccctgcaaaggacatgatctctttcctttttacggctgcatagtattccatggtgtataagtacacactttttaatccagtctatcattgatgaacatttgggttgattccacatctttgctattttaatctcacattacagtcatggctacgggcagcagagtgagaccctgtctctaaatgaataaataaataaataaaaataaccttgattccttgctagttggagagaacattgcactggtggctaggaccattcatggtgatccttactaatcttgtcctggagagatgcttattaaaggagggtggaaatggctaaatatggtgaataaaaagacgatattctcaattcatccatgtttctgtctctgtctcacctaactattgggaaactctggattttctcggtgtgaactttatgggaatactaaatagtatattaggcagtggagttacagacatgagaaccagaatgtgatattttttaaatgtcacattgtgggcaagtctaatatagaggtattaattggaagttgtggggtagagaaaatggaccactaaacggttagaacgtgggcttcaccaaatgccccaaggtagttagtctttaaggatattacatttgagagccatattggagggttgaagttgagaagatggcctggggaattggctaatttacacacacacacacacacacacacacacacacacacacacagactcctgagaatcagtccttattttgaatcccagctcttcaatttaccagccttgtgaaagtcttttaagcgatatgaaacccaattgcttctcctagaaaacggaagagtcatcattaaccctttgaggcaagcggggtgagatattttgaggatcaaatagtaacaagtgtgtggaaatgcctggggaattataaagctctgctaacattatggcggtgctattaatctttattatatattatttgtcttgtggggcagttcctcagcctataaagcctcaccaacttggaatcacttgaggattctaggcagggaaacaccagattgtaccactggttgcattcttgtaaaaatatcttaattacagctgctaaacatgtcttcctccaccaaacaagtctggcctccatgactatcacaggtctatggtgtttcttgttgtgctttttaaggtagataccacagttgatccagtatgtgtaaaaacaaagtgctttccagaacagtaccacacataaattagatctgatacaaagcagttattgaatatatgcacattcattgattactgatttactttactgacaccagaatagtaggtttttgttgctataccaacgtaatttcttgtaactctgccattagaattaacctgagctgcatagaccatgcatagaattttgccttattctttgtgagcaaatatcacttatttgcaaatacgtttaaagaatgtgctgggctggccaggcacagtggctcacacctgtaatcatagcactttgggaggccgaggcgtgtggatcacttgaggacaggggttcaagaccagcttggccaacatggtgaaaccctgtctctactaaaaatacaaaaaattagccgggcatggtggtgcacacctgtggtcccagctatttggatggctgaagcatgagaattgctagaatctgggaggcagaggttgcggtgagtcgagtcgctgcactacaccctgggcgatagaacaagactctgtctcaaaaaaaaaaaaaaaaaaaaagaatgtactgggtttactgggtcaccacaaaacaatctagttaagcctttggaccattatctgcctagctatgaggaaaacatttgctttgcagatgctcttattttattcttctcttccttagataatctaagaagaagccatgaagcaattgctgtatgactggtgagctggcaaattcacgaacattcatcactctccatttctagagagaaggattctttgtcaaggttttctctatcctggaggacttgggttaaatatgtgcttaaaatgtcctttatgagggtggattatcaattattcctcatattttattcaagctgtgctttctattttttgtcttttatttatttatgtaatttttttcttttttatagagattgggtctcactatgttgcccaggctggtctcaaactcctggactcaagggatcctcccatctcggcctccctaagtgctggaattagaggcatgagctgctatgcccagcctactgtctatattttcaagccataactaaattcacactggtttatgatgttcatatcatctttgtggatttgtatttttattattctataatagtcttgccattctatattaatgatttttcaattgtaattttcttctggctgatgttattattgttacaagtttcttttgattactacttggctggcctacttagatgtttacatctttttagtttcaagttttgtttgtcattaggttttaggtgtgtcctttaagaaagacataggacagatttttaaaaattagtatgggattctttaataggcaggtaaacccacccacatttgttataaatattaagatagttgatcttatttctgtcatcttacatgctatcttatattttcaagattctcctgtggttttcttttttcccctcttgctttttacgggctgcattaagggttctctgtttcctggctgatatggtttggctgtgaccccacccaaatctcaggttgaattgtaataatccccacgtgtcaagggaggagcccagtggagataattgaatcatggcagtggtttcccccacactgttctcatgatagtgaatgagtctcatgagatctgatggttttataaatcggagttcccctgcacaagctctcttgtctgcctccatgtaagatgtgcctttgcttctcctttgctttccaccatgattgtgaggcctcctcagccatgtggaactgagtctattaaacctctttccctcccacctgtaatcccagcactttgggaggccgaggtgggcagatcacgaggtcaggagatcgagaccatcctggctaacacggtgaaaccccatctctaccaaaaatacaaaaaattagccgggcgtagtggtgggcgcctgtggtctcagctactcgggaagctgaggcacaggagaatggtgtgaacctgggaggtggagcttgcagtgagctgagatcgtgccactgcagtccagcctgggcaacagagagagactctgtctcaaaaaaaaaaaaaaaaaaattacccagtctcaggtatgtctttattagcagtgtgagagcagactaatacactggcccatccttctcccctcaagtggcctggtaactgtacctcatgtttcccttaatcatattaacatcattattaacttaccaaaatatgatggttaatctctatttccagcttccttttgaagaaaggaaagactggagaatgtttgaacactacagtcctaccccccccgccccaccttcctccatgtaattaccgcttagtgaattatttactcctttccaaaataataataattaataatagtttctgtcaatgcgtatttaatgttatcaacatgttttatctcttttcaacatcttttcttatgtctacccttttatttttatttatttatttttgagacagagtcttgctctgtcacccaggctggagtatagttgtgtgatctcagctcactgcaacctccacctcccaggttcaagcgattctcttgcttcagcctctctagtagctgggattacaggcacatgccaccatgcctggctaatgtttgtatttttagtagacaaggggtttcactatgttggccaggctggtctccaacatccaacctcaagtgatccacctgcctcggcctaccaaagtgttggaattacaggcatgagccactgcacttggcctgtctactctttctttctaagataagtttgccttttgctgaaaatattccttagtagattttcatcaagagtttttgggttcatgtacaatccaaatgcctgtaatccctattcattcttcaatgatgtattagaagggtttggaactctgagttcagagtgacttttgtctcagcactctggaagcaatggtccctggtcatcaggcatccactgtggctgttgggaagtctcttgacattccagttatcctcccattttaggttatctgtggttgtgtttaaaccaagtgcctctgtctccatcattgccctttactgagctaggtctaactggaggtttttaatttttttaactgggttcagtctgaaaacttatgtctgtcttcaatcctgaaaaattcttagccaagatatctttcaatgtatcatctccctatcctcatccttaaaccctcttaatagtaggctgggactttttgtccaaaaccatagaatgtacaacagcaagagtgacccttaaattaaactatggactttgggagataatgatttctcaatgtaggttcattgattgtatcagataatgtaccatcttgttgccgggtgttgataatggaggaagctattacatatgtaggggcaggggatatgtgggaactttctgtacctatgctcaatttttctgtgaacctaaaactgctctaaaaaataagtctatttaaaaaaaaacatgagcttgagatttaataaaataactactattaatatttaaaaaagaaataggtcagacactgtgcctcacacctgtaatcccagcactttgggaggctgaggtgggaggattgcttgagctcaggagttcaagaccaacctggccaacctagtgagacccccatctcaatttaaaaagtttttaaaataaaaatataaacatgaaatagaagggaagatggatggatacaaaaggatttatgatataatatttgaggttgaattaggaggacttggaattgattgaatggaatttggagttggggaacctgactgaggggatattggtcttcaattcatagtgatcatttttgatcaatggctgttgtgaatatttcaggatattgtacaattcagctgttacaagagggttcttttacaatctaaaatttaggccgggcgtggcggctcacacctgtaatcccagcactttgggaggccgaggcaggtggatcacctgaggtcaggagtttgagaccagcttggccaacatggcgaaccccatctctactaaaaatacaaaaattagccaggcatggtggtgcacacctgtagtcccagctactcaggaggctgaggtgggaggatcgcttgaacctgggaggcagagggtacggtaagctgagatcgcgccattgcactccagcctaggtgacagagtgagagactccgtctcaaaaaatacataaataaataaataaataaataaaacttagtagatctattccaacattgacccattgaaaaataaaataaaatttagtaaaatctgcctttcattgaactaattgacaaaaaaaatttagcagaatctcaaaaatgttaaattttctttcatagattttaaatgatttctagattgtttttgaagtggaattttttccacctgatttcttctatggacatatgttcttgatgaaccaaaggagaaaacagtttctatacacacatgtgttccatccccaaatatcagtgtttcagcatctagttctgggcttagatctaataagttactggagcttctgttataattgcccccaccccgctccatgtggcttagagaaaacctttgaggttataaaatgtattaaaaagtacaactgaacacttgaaaaatcaaaactgactcgctcttagtctctgattttccattttgcttactttttttttttttttttttttgagagagagaatagtttaataaagctctatcagccaggcgcggtggctcacgcctgtaatcccagcaccttgggaggccgaggcaggtggatcacgaggtcaggagatcaagaccatcccggccaatgtggtgaaaccccgtctctactaaaaatacaaaaaactagctgggcgtggtggcgggcgcctgtagtcccagctactcgggaggctgaggcaggagaatggcgtgaactcgggaggcagagcttgcagtgagccgagactgcgccactgcactccagcctgggtgacagagcgagactctgtctcaaaaaaaaaaaacaaaaaccctaaagctctatcactcagcttcaaaaaaaaaaaaaaaaaaaaaagaatacgtgaatactgacagagttaaaccttggaaagtttcttttctaaaaaggaaactttaaaagtttttatttttaattgacaaataataattgtttataggctgggcacgatggctcacacctctcagcacttcaggaggccgaggtgggaggatcacctgaggtcaggagttcaagacatgcccggccaacatggcgaaacgccatctctaccaaaaaaaatacaaaaatcagctgggcatggtgccacacacacatacacacacacacacacacacccctataagcctcataaatatgaacaattattattattttttgagacagagtctctctctgttgcccaggctgcagtgcagtggcgcgatcttggctcgctgcaacctccgcctctcaggttcaggcaattatccctgcttcagcctcccgagcagatggtattactttttttttttttttgagacggagtctcactcttgctacccaggctggagtgcagtggtgcaatttcagctcactgcaacctccgcctcctgggttcaagtgattctcctgcctcagcctctgaagtagctgggaccacaggcgcgtgtcaccatgcccggttaattttgtatttttagtagagatggggtttcaccatgtttgtcaggctggtctcaaactcctgacctcaggtattccacttgccttggcctctcaaagcactgggattacaggcatgagccactgtgcccggccttggttacatttttattcaataaagtaaacaaaaaagttttttttgagatagggtcttgctctattgtctaagctggagtgcagtggtgcattcatagctcactgcaatcctgacctctcaggctcaagcaatcctctcatctcagcctcctgagtagctgggattataggaatgcatcactatgcccagctatttttgtattgtttgtagagatggggtttcaccatgctgcccaggccagtctcaaacttctgggctcaaatgatccacccgcattggccttccaaagtgctgggattacaggcatgagtcacagcacccggcaaaattcaatttttagagcttaccctcaactgtaacccctgttataaattttaagcctctgatgtcactaaaacaatatcaaaagatgttataagagttaaacctcatcatgcttgcaaaatgaattggtaaaatatgatgccatattcgtatagaacaatggtctccaacatttttggcaccagggtctggttttgtggaagacggtttttccacagacaggaagggggtgcaggatggtttcaggatgattcaagcacattacatttattgtgcactttatttttattattattacacgataatatataatgaaataattatacaactcatcgtagtgtatgatcagtgggtgccctaagcttgttttcctgtgactagatgatcccatctgggggtgatggaagacagagacagatcatcaggcattagattctcataaagagcacacaacctagatcctttgcatgcacagttcacaatagagttctcgctcctatgagaatctaatgctgctaccgatctgacaggaggtggagctcaggcagtgatgcaagcaatggggagcggctgtcaatacagatgaagcttcactcatttgcccaccactcacctcctgctgtgtggcctggttgctaacaggctacggaccagtactggtccatggccaggggattggggaccccggtatagaacattagtttttgttgttgttgtttaatctagtttctgagtaagacaacacaggtacgttgtacagtgagaactgataacgaatatcactgtttcatatgttaagttatctaaaatgcaaatgttaattgatagtgcctggttttttgcttgcttgtttgtttgcttatttctaaaaatgctttcaggagctgctggctgtcagtgtccctgtgctgtttgttttgcggtgttgatggcacatttatgacaagaaacgccagacccaacattgtcctgctgatggcagatgaccttggagtgggggatttgtgctgctacggtaataactcagtgaggtaaagatggactctgaccccctccctgtatgtgggagtctcccttaccacagtgttcacgtctttgccgttgcagagaagggtttctggagagaagtcattgtctgatgttatcggcaggaatagcagaggtcactggggaaaattgcaaaatgtcaggagaccacttaacctcccagtttccttagattctagctgttggtggtggcgttttcattgttgggcaaaatttacatttaaaaattggccttttttgatcaggcatggcggctcaagcctataatcccagcactttggaaggccaaggtgggagcattgcttgagcccaggagtttgcgatcagcctgggcaacacagggagaccccgtctctacaaaaataataaaaaaaaaaatctactgggacatggtggcgtgtgtctgtggtctcagctactcaggaggctggggcaggaggattgcctgagcaagggagattgaggctgcagtgagctatgatcccaccactgcactccagcctgggtgacagagggagactctgtttaaaaaaaaaaaaaaaaatcaccttttaaccattttaaagtgaacaattcagtggcatttggtacattcacagtgttggacaaccgtcacccccacaaagaagacccccatttcccatcctatccccatgccctgttaaccacaaatgtaccctctgtctctatggatgtgtctcttcttagaatttcatatacaagtaatcatataaagtatttattttctcaggctgccgtgacaaaggtccacagactggttggcttagataacatcagcttattctctcacagtcctggaggctggaagttcaagatcaaagtgtgggcagggctggttcctcctgaggcctctctcctgtccttgtagatgccgtcttctccctgtgtcttcacagggtcgtccctctgtgtgggtctgtgtcctcatctcttcttcttatgaggtgtcttagtctatttcaggctgctataaaagaataccatagactgggtggcttagaaacaacagacattgattctcccacagtcctggaggctggaagtctgagatcaaggtgtctgcagggctggttcctcctgaggcctctctcctgggcttggagatgccgtcttctccctgtgtcctcacagggtcatccctctgtgtgtgtctgtgtcctcatttcctcttcttataaagaccccagtcctattggataagggtccactttaacgacctcatgctaccttaatcacctctataaagactccatcttcaaatacagtcacattctgaggtcctgggggttaggacttcagcacaggaatttgggagggacacaatttagctcataacatatggtaagtggtgtttggtgactggcttctttcacttagcgtgatgttttcaaggttcattcatattgtagcatgcgtcagcacttcattcctttccatggctgaatactttttcattatatacatacaccacattagtctacagttttaaaaatatcttccttgaattacttctaaagtctctggtacccggggctctttatttctctactctctatcgatagaccaatctggctcttgtaaaaatacatagcatcttttagtgtggatttaaataacattgtttcttcttggaatgcagatcacagtctagtcctatatcttaagcatatatttgttgattgaaaggcattggtcttcttcttcttattttctttctttctttctttctttctttctttctttctttctttctttctttctttctttctttcttccctttttcttttcctttctttcctctatctcttttttttccttttatttttaagacaggatctcattctgtcatccagactggagtgcagtggcatgatcttggctcactgcagccttgacctcccaggctcaagtgatcctccctcctcagcctcctgagtagctgggactataggcatgagcccccacacctgcctaatttttgtggtttttcttttgttttgttttttttttgttttttgtttttgtagaggtggggttttgccatattgcccaccctggtctgagctcaagtgttcagcccctcttggcctcccaaagtgctggggttacaggcgtgagccatcacactcagcctccattatcatctttctgtgggattatggaaaaaaaatgttgtacccatgggatcaagattggatatggtttagcttttaggagaacaggcacgtcttttttttaacctataagttttacaaaatttttgcaatgtattagacaaacaaaatgggaaataaattaaactccaaaatgtcacaatttggtcataaaataggtcaattttaccgtaagatatatattaatgggaggctgaagtgggaggatcatttgaagccaggagtttgagaccagcctgggcaaaatagcaagacatgtatctctgcataaaattttaaggccaggtgtggtggatcacacctgcaatcccagcagtttgggaggctggggaaagtggatcacttgaggtcaggagttcaagactagcttggccaacatggtgacacctcatctctactaaaaatataccactgggcgtggtggctcatgcctgtaatcccagctagtcaggaggctgaggcaggaggatcacttgaattgggaggcagaggttgcagtgagctgggatcgcaccactgtactccagcctgggtaatagagtgagaccacgtctcagaaaaaaaattaaattaaatacaaatttaaataaattagtagggcatggtagcgcacacctgtggacctagctacttgagaggctgaggtgggaggatcacttgagcccagggaatttaaggttgcagtgagctataactgcaccactacactccaccctgggcaacagagcaagagactgtctcttaaaaaaatatgaaacacattaaaattttacttaatctaaattacccattaattttaggtccttgataagaagaaattggctaatttttccattgaaatacatttttttctcagactcataaaactgtataccgagtgacctgtattcatttgtaatagttttgactaaagatatattttaaacttatgtttccatttgcttctaaccatcaatgcatataaggaaatagacagattaaagttttaaaaagatggattttaggtttaccagaaatagagtcaacttgacccaaaatagaatagctttgatccttgatcattgtattgagaatttttagaaactcacctgctgaattcttctttggtctgcagcacacctaatattgaccgcctggcaagtgaaggagtgaggcttacccagcatctcgcagctgcttccatgtgcaccccaagtcgggctgccttcctgaccggccggtaccccatcagatcaggtgaggcaataaaaaggcagcaacatttcagtctcaccagaatgcattctaatgattagtttttgcaaatctttataagaattctcaaaaggtcactcagagtattagggatctaaattcaaaggtggttgttatccctgggcagcttaaatatgtgtgcctctcaccaggtaccactgcacctgctcatctctgtgcatatagcgacagggtttaggcctcttgggggcaatttgccaacttatggtcaacactcccattttcaggtacttgtgctaagatttctcaagagacccctgatgtctttaagctagcagagaccatgcagtggttctgagataagtggatcaaatccacctctgtggatgagattggaaaactagacacagttgggaaaaaaggtataactgagaaaacaaaaaggaaatgaaacttttacatactcccttacttgaccccatcatttcaagatttagacttaccaagttgatataacgacaattaaatgtgttcctttgctgcttagcttaggatcaatacctacaaacatccactcaagatcaatattatgaacaacaatttttatacccagctaaaatatagtggtgcccttagacactattgaagtgttcatggttatcagactctatgtgaaatatcgtgtcatgctgttgcattttgtttaattctagtatttgcttgtcataattttagtatacctgccttcacagtttaatttttcagtgaaaaatttttctgtatgaattttcttcctcctaagtagtagattctcatccaatacattcaaggaatgaactaattaggttaatgagaattatactaaaattaagagtaaacattaaaagtttttgtcccataaatattgatttattattatctttttttgttgcctaatgaccttctttcataattcaaggttctccattttgttcaaaatagtttggtttctagataagcagtctctatataacacagtaccgtgtatgaagagggataaagatatgaatttgtatgagtttccaaaaaaaactacacttataatttcaggatttcaggattttttctttttttctttctttctttttttttttttttgagacagactcttgctctgtcatccaggctggagtgcaagggtctgatctcagctcactgcaatctctgcctccctggttcaagtgattctcctgcctcagttcctgaatagctgggattacagtcatgcaccaccacacccggctaatttttgtatttttagtagagatgggatttcaccatgttggccaggctggtcttgaattcctggcctcatgtgtgatccacctgccttggccacccaaagtgttgggattacaggagtgagccaccatgctctgcctaatttcagggaattttaagtattgattatggtgaaataaaatttatttttaaaaattaagaaaaaaattaggtgattggtggagagatttcaagtcattgccatgtgtatatttttaatcatttgacacaaacggttcagtttaattcattctacttatcaaaaatttcagcaaaacagttcaacagcaagataatggtctaatgcttcccttaataaaactgtttctctttcctatcaatgacactatctagagtctactttcttcttcttccaaggtaggatccttgaaatatacttttttcttttgagatggagtttccttcttgtcacccaggctggagtgcaatggcatgatctcagctcattgcaacctctgcctcccaggttcaagtgattctcctgcctcagcctcctgagtagctgggattacaggtgcctgccaccaagcccagctaatttttgtatttttagtagagacagggtttcaccatattagccaggccggtctcctgatctcaggtgatccaaccactttggcctcccaaaacactgggattacaggcgtaagccactgagcccggcctgaaattatcatttatttatttcttgctgatcttcacttgtggttttcttgtgaattccttttaaactataggtgtataatattgtccaccagtataaatctacataaaattatatggaggccaggcacggtggctcacatctttaatcccaacactttgggaggctgaggtgggtggatcacgtgaggtcaggagttagagaccagcccggccaacatagtgaaacctcgtctctactaaaaacacacacacaaaaaatagccaggtgtggtggcacacatctgtaattccagctagggaggcggaggcacgagaattgcttgaacctgggaggcggaggttgcagtgagccgagatgttgacactgcactccagcctgggtgacagagtgaaactccatctcaaaaaaaaaaaaaaaaaaaaaaaaaaaaatatatatatatatatatatatatatatataatatatatatgtatgtgtatatacacacacacacatatgaaaaagaaattgtcactcctacacttcttcatttcagattctcaaggatacttttaaaaatgtatttatacccagctaaaatgcagtagtgtcctcagatactattgaaacattgaaggttagcagcctctatatgaaaaactaacgaaggttatttgttgttagtctgaaattcaaatggatataactaagtgtcccgtatttattctggcaaccctaattccaagggaatgtttgcatttagcaagtgaaaaaaggagggtcaaggacgtacagccagaaagcaacagaaaacttggggaagaatggctttgaggaggtgcgggaggagaggactttaagcatgtcgggataaattcggtattagcaaagactatggtgctaacttattgacttctgtgaatttagggatggtgtctgcctacaacctgaaccgtgccttcacgtggcttggtgggtcaggtggtcttcccaccaatgaaacgacttttgccaagctgctgcagcaccgtggctaccgcacgggactcataggtatggcgccggaactctgcccgtggaaacgtgatcctgcagcctctctgtcatcgtgtctaaggtgtttccggggatgttggctttgtgcgcgccagtttgaccgacttctctttgagataagacacttggagaaggaaatgatcacacattgattgagcatgtgtagaatcgagggcatagtattggaaaaacaatgagaacagaaagcaaacaagtgtatccaaagttgccactaaaatggaatgttgtgttggagggatacgatgtttgtgacaccattattagcagaaaaaccagtaaatttgtagagaagtactgttgaaatgggaaacttacagcattaagagttgtcaaatggaggcaattgctggtcgacttagatcacttaatattctatgcccttttggcgggggtgggggtttggggcggggggacatgagcttgtgagggagcctttcaccgaaaaataagtttgtagaattccagtcctagaagatagtcctctaagaataacttgtgtgatcaaatccttttgggaaatgctactcaaaagcattgtacggtccactatttttgaggattcctaatgtgaattgtaagccacagctccgagatatccccagttaaaaaaaaggttaagaaattttctatcagtagggcatgtattcccatgcaactcccagcagcgtcctgtgagtgggaattctctagattagctttgagcagcgttcttacatcattagagcacgggattcagatctgactctgctattattcattaatgtgactcaggcttctgaataaatctagatagctgggcacagtggctcagacctgtaatcccagcactttgggaggctgaggcagaagaaggccaggagttcaagaccagcctaggccaccatagcaagaccctggatctacaaaaataaaatgttaaaattagctgggcatggtggcacgcacctatagtcccagctactcaggaggctgaggcaggagaattgcttgagccaaggagttcgaggctacagtgagctataatcatgccactgcgctccagcctgggcaacagagcaagactctgtctcttaaaaaaataatctagacaatgtgttttttattcataataaagggtctgggaagtgttgaatataataatgtgtgcggacaaatcagaacgtgacctggccccctagagtatgtgcttgataaaaggaattacttgcattatcagaatcgtttggttcttgatgaaattctttggctactttgtcatccctagcttgaggacctagaagaggtgttccatctatacataaaatctcggttacctttcagtgagatggaataagagggtcggaaggcactgctagataaaagcatgaatgtgcaaggtgcactgaaagtccttggtattgtccccaccaaacaaccaagacatcgattctgccctcctagcaagctccagatacctggaaagtttctcattgttcatgaggttgtttggtaccaagcaaaaggtttcttctgaatgaacactaggctcctctccttgtcgcaagcaaagaggctcctgctgcatggcttttgtctgaaagaggcatattgtagggagaaggctgttggtggcatgtctataccagggaggtatttggggatatcaagaaaaaaccatgatgacaacagaatgaaagttatatttgacttttccaaagggaagcccacattctagaaacagaccggcattgaatgctgccatgctgccatggtacgattttattttacttttaggcaaatggcacctgggtttgagctgcgcctctcggaatgatcactgttaccacccgctcaaccatggttttcactacttttacggggtgccttttggacttttaagcgactgccaggcatccaagacaccagaactgcaccgctggctcaggatcaaactgtggatctccacggtagcccttgccctggttccttttctgcttctcattcccaagttcgcccgctggttctcagtgccatggaaggtcatctttgtctttgctctcctcgcctttctgtttttcacttcctggtactctagttatggatttactcgacgttggaattgcatccttatgaggaaccatgaaattatccagcagccaatgaaagaggagaaagtagcttccctcatgctgaaggaggcacttgctttcattgaaaggtatttagccatttcttgcctgatttcctgcatggaaattttatttttatttcataggaggtcatcacaccttgataacatgggcctttaaaagtctcttggagagaatgtgcggcatttggctttctgttcctgtattaatttgcttagaataatggcctccagctgcatccatgttgctgcgaaagacatgatctcattctttttcatggctgtgtagtattttgtgggatataatgggagctaaacattgagcctccatggacataaacatggaaacaatagactgcaaacttctagaggagagagggagacagggagaccaggggcacatggttgcaagactacctattgggtgctctgcttaccccctgagtgcaatagacccacgtaacaaactggcacatggagaccctgtatcgaaaataaaagctgaggaaaaaaaaactttaggtgacatttgtgatagacttgagtctcctcttaggtagaattaaatagttaaatttcctgcaaattttgaatgctcaaaaggcaaaaaaacaaaaaccaaaacaaaaacaaaacataaaaacatattttgctcacctccccatttttaatgttttaattttttttttttttttttactttttgggacaggatctcactctgccacccaggctagagtgcagtggtgcaatcatggctcacagcagcctcgacttcccaagctcaagtgatcctcccacctcagcctccagagtagctgagactacaggcacctacaggatgcctggctaaattttgcattttttttttagaaatggggttttgtcatattgcccaggctggtctcaagttcctgggctcaagtgattcacccactttggcctcccaaagtactggggatacactacgcctggccacttacccctttttaaaaatgaaaactagagttgccatattttaatctatattgcttcagtgtggattgttatgtaaattgattaaacctggggggtaaaattttttttctctgtctcagacacagccggaagagctctctgtccataaactattggatagtggctctgtatttacagatacctagttttaagttttctgtgttcaacacaagctatgcaggcataactataatgagctctcatcatcccataccagctcactcctacgttacaaattattactattattatttggagacagggtctcactctgtcactcaggctggagtgcagtggtgcaatcatagttcactgaaacctcaaactcctgggcaccagtgatcctctcaccttggcctcctgagtagctgggactacaggtgcacatgaccacacccagttaattttataaaattatttttccatagagacaaggtcttgctatgttgcccaggctggtctcgaactcctgggttcaagcgatcctcctgccttgacctcccaaaatgctgggattacaggtgtgagccattgtgcccagcctgggttacaaatgaggggcacattaaagttgttggtgtggattctcattgacactgtttgtcaccttccttagtggggttggcagggagtggagaggggaggatatattgttactccaccaggctgaagggtatgcagtggaatatcattcactcatatgcccctgtgcccatcagattcattatttattccaacacaaccatgagaacagtgatcagccacccactcagctctccattcatcttacctgcccttcccgtcccaacccatttgcttgggctatctttttgggaatatattcaatctccatctccttcccttctttctatgctggttgtgaaaaatgtgtaaaggagtagctttagaatgactgcatgtgacattaaaatgcaaaacacaaggtcaggtgtggtggctcatgtctgtaatcccagcactttgggaggctgaggcaggaggattgcttcagcccaggagtttgacaccagactgggcaatatagtgagctcccatctctacaaaaaatgtacaaaattagccaggcttggtggcgtgtacctgtggtctcagctccttggaaggataaggtggaagaatcacttgagcccaggaggttgagccatgattgcaccactgcactccagcctgggcaacagagtgagactttgtctcaaaataaataaatacataaaatgcagaacacaaaaagcaagatgtaaatgaggggaatttatttctctcttggggtaggcaggctacagatacagtgaggttatcttgttctctgccatcctttgtgagcagcctcatggcccaaggtagatgccaaagctccagccatcagacttatgttccaggaaccatgaaggaggtggaagaaagaaagaagggaaaatggagagtaaggagcatcaaatccttactgtggcacatctgagtctgtccttaagatatgattcttctgaactcatacctaaaagaacactttgaaacaatagatgaggagaattcatactttttaacccattcaacaaagattaaaagatttattaagctgctactttatgtcagatgctaaactggacacaagagagtataaaatgaactgcgttaaacatttttgttgttgttgttaagacagggtctcactgcgttgcccaggctggagtgcagtggtgtgataatagctcacggcagcctccacctcccaggctcaagcgaaccccttgcctcagcctcctgagtagctgggatcacaggtgtgccattaagcacagctatatttttgtattttctgtagagacgaggtcttgccatgttgcctgggctggtctcacactcctgggctcatgcaatgctcctgcctcagcctcccaaagtgcaaagaatataggcatgagccactgtgcctggctacatgaaacattttactgggaacacaaatgttctgttatccttcattcctcctcatatcctttcaacataaatcttgtggtatttacgactcacaggagtggtattgtcatctaaagtacatagaaaacctccgccagctattatgagatcttttcatcagtgcagaatcgcatttaaatgatggaaatgacttcatatttgtgaaggtaattttggtaactttctaccccttaggtacaaaagggaaccttttctcctctttttttccttcctgcacgtacatactccactcatctccaaaaagaagtttgttgggcgcagtaaatatggcaggtatggggacaatgtagaagaaatggattggatggtgggtaagtattcagtaacagaactgtaaatatctgaagtacgggctacagaaaaacaaatctgtactaactgtctcaaattatgtccagccccttgcatagcatagatacctgaaaagtatctgtttcatcccttaattggattaaaagctggcttttaattgttcagcaataccagtgaaatatattccccaagataagtcacagtttgtaaatacaagttttcccatctttaaaataaagacagccacttttctgaaaaactcattggcaagataaagaaagctgcactgtaaagtatattgtaattcctggccgggcacgcagtggctcacacctgtaatcccagcactttgaaaggccaaggctggcagatcacttgaggtcaggagttctagaccagcctggccaacatggtgaaaccccatctctactgaaaatacaaaaattagccaggcatggttatgcgggcctgtagtcccagctgctcgggagggtgaggcaggagaatcacttggatccaggatgcagaggttgcagtcagccaagatgagaccactgcactccagcctgagtgacacagcgagattctgtttcaaaaaaaaaaaaaaaaaaaagaatattgtaatttcaattcccaattattttgatggatataaaagggaacgttattctgattagtcagttctacaggaaatacatagaaaattgggatggggatttaacacaactaaagcaacttatttcaaaggcatagtgttcactataaagaaatgctaaggataataaatgagcaggtgggaagagttactgtatgcattccagaataataaatagctgtgctagttgaattgcatttgcccacccccgcctctatgtacgtgacagagttgtccttcctctcagcgatggtgtttcattttggaatacagtacttttcttcttcttctgagtgcaaacttctgaaaacggtgctctgccgaaccattgaaacgaacaatctcccagttatcagccgcctctgttgacttatatggagtgcctttgaaagaaacagagctattttaatttaaatgcatttaaggggtgttaatcaatcacattttattataaataactttcttttctctgaaaaccaccatctaagtgagctataaaatactagttaaaattactgaagaactagtggtgtcggataggacaaagaggggaatcttgtcatgggataaatttctcttgtatatttccactatgtgtgtttacctctaattataggtaccattgtaacatttactgtctatatttaatcccaaagaggagatagaatacagagaggggccaggcgtggtggctcatgtctgtagccccagcacttttggaggttcaggcgggaggatcacttgatcccatgagtttgagaccagcctgggcaacataccaaggctccatctctacaaaaaaatacaaacattagccaggcatggtgtcacacgcacgccttgtagttccagctacctaggaggctgaggtgggtggatcacttgaacctgggaggtgggggtagcagtgagccgagattgcaccactgtactccaagaccccgtctcaaaaaaaaaaaaaaaaaaaaaaaaaaaaaaagaggccgagtgcggtggctcacgcctgtaatcccagcactttgggaggccgaggcgggcggatcacaaagtcaggagatcgagaccatcctggctaacacggtgaaaccccgtctctactaaaaatagaaaaaatgagccgggcgcggtggcgggcgcctgtagtcccagctactccggaggctgaggcaggagaatggcgtgaacctgggaggcggagcttgcagtgagccgagattgtgccactgcactccagcctgggcgacagagccagactcagtctcaaaaaaaaaaaaaaaaaaaaaaagaatacaaggaaagtcagtgctgccaggctgccagtaaggcatttaagcagaaatggggagaaaaaaggaatgtgttaaagggaaaaacttatgggcttagttaaagggaactaaccctgacatccaaacccttttgaagcttgctgaactaaagctaagctctgtatttcttaatttaatctttgctgtgggatgtgtatgtgtgtgtatatatatacacacccagctgcagttattttatttgcacggtataaattacaaatcacttttatgcataatactatagtcagatttaatatgaattaagctatatacacacacacaccatatgttatatacatatatatatacacacaccccatatggtttatatgtatacacaagttatgttttatacatatacacacatagcactgtatgttgcatatatacacatttattatatatagtttaattccttggtaacgaaatacaaacactgaaaggtgttacagttaaaaatagctataacactgtagcctttatggaattatataattgggattttttttttttctctgcttcttttgaaatcgcttactatagttgtacttagtcaaaggacagtttcccgtaaagggattttctgttaaagtctatatctgagtgtttatcactaagaaataattatgtttgttttacagtatatgtaaatacatgatgaagacgtgttacaaaagctagcaattgcattattaaatggctaatattatttgacacaggagaaatgatgagtagctatttttctgcgtaacatctcccaaatattctgagttttctccgtcatttcttataaaaattctaccaaaataaagacatattgaaagtcagacaggtatctctgtgggtattattttactatttaacaatatgagtataaaactcaaaggtttagtaacttattaactttactcaaaaataagccataacaatgctatactcatgcaaatgcaaatacaacgtgcaaaatgaacttaatgaatcttcgggaattcagtaacattttaaactttccaatgaaagaaacttgtgcctattaaaaaacacttttagtcctttttttttttttttttaagacacagggtctcactcttttgcccagtctggctggaatgcagtggtgcgatcacagctcaccacacacttgacctcctcggctcaggtgatcctcccacctcagcctcgtgagtagctgggactaaaaatgtgcaccaccatgtctggccaatttgtgtgtgtgtgtgtgtgtgtgtgtgtgtgtctctgtgtgttttgtagtggagttttgccatcttgcccaggctggtctcgaactcttgggctcaagcaaacttcccacctcggcctcccaaagtcctgggattacatgtgtgagccaccaggcccaaccttaatcacttttcattattggtttctttccaggtgtctttggtaggaggtcttataagtgacctattaccattagtatttatatattcatatgcatctgtgtgttttcactttagacactatacagacaattatttgcaaatatatttgttctggaacagaaaaagaatttgcagctactatatttgcacagtataaattacaaatcacttttatgatttttttatactatagccagatctaatgtgaattgataatttacatataattatgctgttcccagaaagcctttacaatctttcatcttacaaaccctgggctttaaaatatcttaatttctaattatagcatttctaaaaaatagtatatgtcacttctaaaacaaatcactgagtttacgtataaacagttttctgtgcagctagttaagctagttacattttcttttatctttgaatgggacaagagcatagcacagagatgatctagtgtaaactagaaatgcagtgtgacctcaggcccaggacgatgttatctgttgattagcaaatgctcaacagacatcagaaaggaaatgaatgttgtttggaattttgctagaacagctttctacttattattttaaaaaactgtcctcctgagggattgtcaacacattaaagacagtgtctgctgagtctagcgcagcattaattgtcattagatcttaaccataacccaaacagcaagaataacctgcaatttccatgtagacttcagatagcagccaggacagcaagtctctaagggaggtggtgctgtgccctggagtacggggatggctttgctcatatgttcctggaggtgtcattttgcaaactgtatttttttaaattaatgttcatcggtttatttaactgctgggccttcttggcactgtctatttgaatcgtttggggcaatgatgaccttatgtattattacacgatttgtataataaaatagattttattatatattcaataataaaataatgaacacattatacaataaaattgtataataaaccagtactttatatattgtatatgaactattctacattttaaattaatataattaatgtatctagtatatttaatataatttatataattacattaatataataaaattaattaaagtaatatgtgacacatatcattcaattatataaaataatatagtatatatttatataaagatataaatttatgataaaatttaatatattaattagacatatattataaaatttaatatgttcattatatattatacatttattacatatactcatattttatcttatagttaatatattttcctatgtcaataaacatatatttttacatattgcattgatatacaaaatactatataataaaataatagttacatgttattatataattacataacaatttttacacaatgataaactattatataatgatatgtttctagtattgtaaagtcatatggtataataatacatagtatgtattgattgtacatattacaatatattttgttctattccataattgattatattttaatatataacaattctttatgcatttttaatacatcatgttatatattaatatgtatttgtaagaaatatgtactatatatcatacaatatataataaatatataattagtaattcaaatgtataaaagtatgtattatagtaaatatagcatatattatacattattacattatatattaaatattttaactgctggatataatatatattatatacactatattacgtacagtttaaaatagtatgtattacaatattatatgattaattatacaatatcgtgtagtgcagaataacattgaaacgctatgtgtaataaatacatagtagcagatatgtaataaagcagtggtgatctgcatcaagaggtcaacgtctttgtgtctctgaccctctccaggtaaaatcctggatgccctggaccaggagcgcctggccaaccacaccttggtgtacttcacctctgacaacgggggccacctggagcccctggacggggctgttcagctgggtggctggaacgggatctacaaaggtgattgtgtgtagagaaccaacgcctgtccattttaaatcagtagtctctattggctttgtgtttgcttgaattcatttgccatgatgttcagatattttgatgtgagttagactcttattaagctagaccgaaaaaaaaaaaaagctgcaaattttggggcagtttccaagagcttcaaagtaaaatgtttgaagcaacgccaaccccaggagacagcacagcatctcaatgaccatctgtggcagatgtcccagcctccgcacgattgacatttgaggctggaggattctctggctgggggcatcctgtgccgttgtaggtgttgaacagcgtctgtgggctccacccacacatgccagtagcacccaccgcagagcagcaacaaccagaaatgtctcctgatattgcccagtgtcccctggggacaaggtcatttctaagtgagaagtgctcctttagattaatcctcacttggattctcagatgcaggtttttaattcaatcacaccaatgatgctattcattatgctttaactagtgttatgtggatcagaaaaaagagtttttcatttgactggggtgcctagctcctcatggccagcagattcttccagctcactttgatagacttcatgccgggttgttcaagaactccatggcacccactcttaggcatcaccaaaggcatgccaacagaaagaataatttaaaaaagaattctgcattcgctattttccccctacccgctaaccttccaagtaaaacaaaaaaactaaaagggtatcaaaatcgtcatcattataaaatcagaatgtttgaacttccttatatttcattaaaaagttctgtgtgtgtgtgtcttatatatgtattttcctggaggtataatcactatgtatataaattcaccgtattaattgtatgtaatataatatagaatcatatatattcatcatatgtgatatataatcctatatatagtcactatgtatatatagttactatattcattacacataacacatataatcctatatatattcgctatattcattatatataatacatgtaattttacatatttactacatataatatacataatcctgtacacattcactatgtatatatagtcattatattcattatatatacacacataattctatatatttactatatttattgtatagatcattatatataattttatatattcagtatatataatataatatataatactatatatatttactatgtctatagtcacatattaattatatatagtatatagaattctatatattcactgtatagagtatacataaccctacacatattcactatatgtactcactatattcattatatattacacataatcctatatatatattcactatattcattgtatatatataggattgtggatactggattatatattgtaaattaatagaagtgagctcctgaaagcattcacctcctctggcttgtcatgtggacttgctgtagtcataactgttaattagcaaagactaaattggtgctaaacctagtagaaaaagtgaggaacagatctgagtcaccatatatatgccatctaacgaagtgtgattattacagtcatgatgattctaacaactgtacctattatatattataataattattataattgcatgagtatgtgtgagtgtaaagcccctgtccttaaaaagcacacataaccctggaataggactggcaaaattgttgtgagcatttctcaggctttgggacaggatgcctgtttctcagggtgcttcctgtgaagcgatgaattcaatggatagagagatttagatctcctgggtaagcaatgggttttgttctagtctagttacacctcgcagctctgccccacaaagatacaggttattaaatacgatgaagaaaacatcaggatggctttatgattgtatgttaaaagcacatagatttggttcagtgagcttgtcgagtttttcttataataaagaatggtgctacttgggaggctcaggagggaggctcgcttgagcccaggagttggaagctgcagtgagctatgattgcgccactgcactccagtctgggtgacagaaggagacagtgtcttaattaaaaaaaataaaaataaaaaaagaatggtgccaagaagctgagctgcctttcaacactggttagactggttagatcagtgaatgtgtcagcagtgaattttacctcattttctgctagaggcttccggttttgtgtttctttgtaatgctgcctgtcagacaggtgcgcacgtagaagacattcaatgaaaatttcacataggaagagaccttttcctccagagaggttcctattttttcttaaagagtctagacatatggtcttgacactggcatttggcatagggccatttttctattctgtaacaaccgcctcagtctcatgattgatcttacggcaagggcttcatttttgttttgtgctcagaaacacccaaggggacttttgtctaagaagtgattctcaactctgcctctggccatttttctactcacactcctctctttcttcctctatatgggaaatcacggggtaaagttttttagcttgttcctcaaggatcattataatgtggataaaacctgtatttttcttttctttttctttttcttttttattttttggagacagagtctcaccctgtcaccgaggctggagtgcagtggcacaatctcagctcactgcaatctccacttcctcgtctctgatcccccgacttcagcctcccgagtaggtgggactacaggcatgcaccaccatggagtgcagtggcgtgatctcggctcaccacaaccttcgcctcctgggtttaagcgattctcctgcctcagcctcccacgtagcttggattacaggcgcccaccaccatgcccagctaatggttttgtatttttagcagagacggggtttcaccatgttggccaggctggtcttgaactcctgacctcaagtgatccgcccacctcggccccccaaagtgctgggattacaggcgtgagccaccgtgcccggccaatatggttgggttttaactcatctttggttgtgtcgtaatctttggttttaggtggcaaaggaatgggaggatgggaaggaggtatccgtgtgccagggatattccggtggccgtcagtcttggaggctgggagagtgatcaatgagcccaccagcttaatggacatctatccgacgctgtcttatataggcggagggatcttgtcccaggacaggtatggaaacagtgtttgctcctaacctagggtgatatatttgaacataagtggatatacttgataattctatgtgtgtgtgtatgtacatagtatattacttaattatcaatattctgcccatagggccagatgtctttctccccttggtgcgtggtggaatattttgttttcttcttagagtataccttaatatcctttgtcatattacacttatgcctgtgtgtgtttgactgttctcatggatgggatctgattctcatacatcatcacatccctcacagcttctagaccattatgcaattaagtgttaaatgattactgaataaaaacatgtatgcctagagcaggtgcggtggctcgtgcctgtaatcctagcactttgggaggtcaaggctggcggatcacttgaagtcaggagttcgagaccagcctggccaacatggtgaaacccccatctctactaaaaatacaaaaatcagtctggtgtggtggcacgtgcctgtaatcccagctacctgggaggctgaggtgggaggatcgcttgaacccaggaggtagagattgcagtgagccgagatctcgtcactgcactccagcctgggtgacagggtgatgccctgtttcaaacaaaaacaaaaacgaaaacaaaacacgtatgtgtaattgcatgtgtgctaaatgatattattctttctggtttgcactttgtctatgagcttatttttaatttaatttaaatttattttttttgagacagagtctcgtcctgtcagccaggctggaatgcagtggtgtgatctcggctcagtgcaatctctgcgtcccgggttcaagtgattcttctgcctcagcctcctgagtagctgggactacaggcgggcgccaccatgctcagctaatttttgtatttttagtagagatggggtttcagcatgttggccaggatggtctcgatctcttgacctcgtgatccacccacctcggcctcccaaagtgctgggattacaggcacgagccaccaggcctggctttgtctatgagctttaaaatgaacaaatacatcctgtgctttaacgatttaattccatgtatgtggggtgatatctattcattaaatgtgaagttttattggaatcaaaagggcgtaaatagcttaatttttccaatccacaacagtaactcatattgtcttgcaaggtatcaggataatagttctagctgttctcttcttccatgacctcagaaaatgaatgttttgtttctctttctttttgttataaaatgagggaaaaggagaaagttttaagaattccttcttccgccaggcgccgtggctcacgcctgtaatcctagcactttgggaggccgaggcaggcggatcatgaggtcaggagttcgagaccagcctggccaacatggtgaaaccccgtctgtactaaaaatacaaaaattagcagggcatggtggcgtgtgcctgtaatcccagctacttgggaagctgaggcaggagaattgcttgaacccgggaggcggaggttgcagtgagcagagatcgcaccattgcactccagcctgggtgacagagcaagactccatttcaaaaaaaaaaaaaaagaaaaaagaaattcttcctctttatctttcgcctccttctcttcctccccttccttttcctcctcctcctcctcctcctctttcttctgctataaaatgcgtgactgaaccatgcctctctcatcaccttctacacacccccttctctcccaagagtgattgacggccagaacctaatgcccctgctggaaggaagggcgtcccactccgaccacgagttcctcttccactactgtggggtctatctgcacacggtcaggtggcatcagaaggactgtaagtatgaaggctgtggacacgtggaaagacgataagggcccggttccggtctccttcgtctcctggcggaagctgcaccatgtgcagatattgcccagctatgatggttctttttcgctgagaaagccacataaacagtgcactgcagtaggattttattttattttattttattttgagatagggtctcactctgtcacccaggttggagtacagtggcgcaatctcggctcaccacaacctccacctcccaggttcaagtgagtctcctgcctcagcctcctgagtaactgggactacaggcacctaccaccatgactagttaatttttgtatttttagtagagatggggtttcaccatgttggccaggctggtctcgaactcctgacctcaggcgatctgcccacctcagcctcccaaagtgctgggattacaggcgtgagccaccgtgcctggcctgcagtaggattttagagagatgtgtttgtgagagagatttgtgcccaaagggttttattttaaatttttaaaatatttataaaatagagacaagatcttactatgtggcccaggctggtctcgaactgctgagctcaagtgatcctctctctttggcctcccacaggtgtgacccaccacagccgatccactcaaagcattttaacttagggaggtgagtgctgacacagacaaaccaatgccattgcaatattttcatgacttagatttcccgagagaaggggatatgccctaccacacaggttcacggtgggaagcaccagggcttggcttggaagcagaggcaggaaggaatgaggagcccaagcaacagcctttattattaggctttccaagggaaaggtcaggcagggcagggtgaacagcttcacactggtagtttgagtaattacagtaagtttggagcaacagagactgcccctagctgcctggtacccggtgctgggttgatttaggacagagaaaatatcagcttactgtgtgagagttagataaaggaggtggatgcttgcataggtagggtgtgttcctaagtgagttgttactatttgtattagtccattctcacgttgctaataaagacatactcaagactgggtaatttataaaggaaaaagtggtttaatggactcacagttccacatggctggggaggcctcacaatcatggtggaaggcacatcttacatggtggaaagcaagagagaatgagagccaagcgaaaagggaaatgccttataaaaccatcagatctcgtgagacttattccttaccatgggaacagtatggcagaaactgcccccatattcaattatctccacttggctctgcccttgacatatggggattattacaactcaaggtgagattagggtggggacagagccaaaccatatcgctatttttaggaatcagctagtcctgggaggagcagtctttccccaagtctatgaggcccctcaagctgtcaaaatactagcctggcacagtggctcacagttgtaatctcagcacttcaggaggccaaggtaggaggattatttgagcccaggagtttgatatcagcctgggcaacattgcaagaccctgtccctacaaagaaaaaaaaaagaattagccaggtatggtggcatacaactgtagtccagctactcaggaggctgagtgggaagtttgaggctgcagttggcaatgatcgtgccactgtactccagcctgggcaacaaagtgagacactgtctcaaaaaaaaaaaaaagtcaaaacattataggatacagaaaattaagacaacatgattaatgtgtgtgtgtaagtatgcattagcttgtgtgaatgtatacatgagagagagaacaagagagaaagagagactatgaatacccacagcttagggatgactgaagtaattattctagcaacgaggagtaaattcttcaacatgacctgccgggtggttgcttatctccaccttccttcctttctaacatcctagtgattgtttctgtcccacattcgtgctatggaagtcatgcaaacaaatataaattaacaaatagcatcgtttgccttagacctgtaaagaaaggtcttttggagtcattgcatgaaattccagaattcttacttggttggatttaactttatttgcaggaggaattttctctgatgggatcagtcacttgtggtgtgatgtatcttcattttgatgtggatagtcccacataaaacaattaaaaaaacaaaaataagtaaataaaaatctatgtttttaagattctatatgagtgcaggacatgatcaatgataaataaaacagccccgtaaacagcacaagcctcccaaatttaactatagaggattatacagtagaattttttgttattattttttctcatcataatttcagaagttgggagcatggggctgacacagtgctcagtgccacggtcatgggaccagggttctttttttctacttggccacctctgacatgctagctttcattcttgtgcatctcacctcatggttgcaaagtggctgcagttcctccaagcatcacacctgcactccatgcagtaaggagggaaaaaaccaaaggcggtaaagaatccagttagatgatttgatcctattttagtaggaaagcacagcttctctgcaagaccccaccagtagacttcggtataatcctcatttaccagaggctggggaatgcttatattttctatctaaaattgatctctgcagccaggcatggtggcacatgcctgtaaatccagctactcgggaggctgaggtgggagaatcacttgaacccaggaggcagaggttgcagtgagctgagatgttgccactgcactccagcctgggcgacagagtgagaccctgcctcaaaataaataaataagtaaataataaaaaatgaaaaataaaattgatctctgaaaatagatttggtaaccatttcatatcagaagaaagaagaaaggaagggagggagggaggaaggaaaggaaggaaggaaaggaaggaaggaaggaaggggaagggaagggaaggaagggaagtaaaggaaggaggaaaggagggagcgagggagggagagaaggaaggagggaaagaaagaaaagaagaaaacagaaatggaggaaaaaaggaaggaaagaagagagtgagaaagagggagggaggaagggaagaggagggagggagagacagaagagggagggagaaaaggataaagaatgattaactttgccaaattacttttgtcaatttcagatgtgaaagtggcatttagccttggatcatttttaattttgtttgtacctaatcagattgaggtagaattttaatttggtattcccagaattaccctattcccatctgggtcatcattattatctccaaatattctcatgacaagatttctaaaaatgtctgcaagtttgcagtgaaattgtgcattgttcttagagttgaagaaatgctactgttgctgtgtaatgctgtgcagaagagtattatcaatcactagaaaaagcttttgagaaaaacatctttaacgaaaagagtcctaaaatcaccacaaagatggtatcatacataatgcaacttgttttttaggtgcaactgtgtggaaagctcattatgtgactcctaaattctaccctgaaggaacaggtgcctgctatgggagtggaatatgttcatgttcgggggatgtaacctaccacgacccaccactcctctttgacatctcaagagacccttcagaagcccttccactgaaccctgacaatgagccattatttgactccgtgatcaaaaagatggaggcagccataagagagcatcgtaggacactaacacctgtcccacagcagttctctgtgttcaacacaatttggaaaccatggctgcagccttgctgtgggaccttccccttctgtgggtgtgacaaggaagatgacatccttcccatggctccctgagaccatgcggaccacgtgttacccaccacaaacttactgttacaatggtcataggagcagagctcacctgactgattcattccatttgggataaaaactgatggcccaacccattgttttatcctcagaaatcagttctttcaagagctcggtgaaattaaagtgggcccatataacagtgaacctggaggggagcatttgttgtataatttttttctagtatataattgtgccattgcccaaggaaaagagcaaatcaaggtgacttcagcagattcttgtagagcttttgttcctagaattcatggaagcatcaggtccaatgtcataagttagaaacttctgcttgcagattctatacccaggcatgctagctttctaataaatcatgataagtacttaattttttcatgaagcagagggtcacataaaacttgaagtagtgctgttatagtcagtttgacttcttgattttctctctttccttcttttctcttcctgtccgatacgcatctggttatgagaaaaaatgctgggctgaagttcttgactttgcttcctcgtagctatatcatcgtggaaatgtctctgtgatttggtttcttcatgtgtaaaataaggaaaaccagtgtctacttcacagagtagctatgaggattacatgcattaattaatgtgaaattgccttgtgtagaataagcagtcaataaatgttattattacaaatgttgttgtaagcatcatcaattgcagttaatcatgattccttaaacacaaaataagaaaaatggcaaagaagagtcaacatttaagaaaaaataaagaaacatggctaaaacaattatttaattgaagaaaggcatttggcaatacacataggaagtaattcaaagcaggataaacaaacataaatccaaaatttgaagcatttgtgactgcagactacaaaagacaaagaaaagatctacagatggatgcagggcaggtgagccccaaattggggcttagcctgggagggttcttggcttccctcaggaaataattcaagagtaagccagtggtggaagcaacagctttatggagaaggtagtgtcacagttctgtgaccgctcctgcagagaacaggagctcagggcactgctgcagtcatatttatacccacttttaattgcatgcagattaatgggcagtttatgcagaaatttctaggaaaagggtggtaacttctgagtgctcaggtcattgccatagaagaggccagtaatgcccagatgttgccatggcaatggtaaactgacatggcatgctgttaggcatgtcttatggaatgctgcttccatgttttagctagtcctcagtttggtcctctgtctgcttctgcttcttcttcttaccattcctgggctcaagcaatccttctgccttggcctcccaaagtgctgggattacaggtgtgagccaccacatgtggccaacaatgaatgttctttattttattatactttatattttgagatagagtctcactctgtcagccaggctggagtgcagtggaggcgatctcagctcacggaaacctctgcctcctgggttcaagtgattctcctgcctcagcctcctgagtagctgggattacaggcacacaccactacaaccagctaatttttgtatttttagtagagacaggatttaaccatgttgacgaggctggtctcgaactcctgacctcaagccatccacctgcatcagcctcccaaagtgctgggattataggcgtgagccaccgtgccagcaacaatgaatgttcttaatatcaccagcctgtgcacttaaacatgatttaaaatggtaaattttgttatgtgttattttaccataattaattttttatttttatttttttgagatggaatttccctctgtcgcccaggctggagtgcagtgggagatcttttctcaaaaacaaaacaaaaccccaaaaaaagaccgaacaaacaaatgcaataacaacatcttttgcaatttttgaagtttgaagattacttatttcactcagagctcccttgtattacttgtctttaatgctgttctcaaatttgtgtgtgtgtgtgtggaggggggggcagctagcaggtcctacatcaccccaaatccatgattttctctttattcaattctgcagtggtgcgatctcggctcactgcaacctccgcctcctgggttcaagcgattctccttcctcagcctccccagtagctgggattacaggcgcccgccaccacacccagctaattttttgtatttttaagtagagacagggtttctctatgttggccaggctggtctcgaactcctgacctcaggcgatccagccgcctcggcctcccaaagtgctgggattacagtcgtgagccaccgcacccgcccccattctgctatttcttatccctctttgcattgcagccacactgcaatgtaaatgaacctttgacctaaatgaaccaattaattatgcccccacttcactaatgggccactagagggcgttagaaaaacatttctcaactactcggtcaatgcgttcaagcatgccacaggtgttcttgctagagacttgtcattgatgttttcttgagccattagaaggaaatggccatgaggaaaagactcggtttgctttatgttaatccaggggatatgatggtagataggtaccaaccagacatgtccatttcagacagtcaaagtagccaatctgtcctccacaattcagcatttttagagaaataaaaaatggtgctgaaacatgcagagtctaaaactgaatgtctgcttttcaagttctttctaattattggctagggaaaaatcagtgtcacttaacttctctgtagtgcaatgtctcaactttaaaatgactacaatagcaaatgcttcatagagttgctgcaaagattacatagataaatatgcgaaaacacaagaggctggaacgagcactttaagatgacagtaattttattttattacaagaaagactgaggttgaattttcttaacccagaacttagattaggaagaagtggtcattaaaatataccatgcattattacttattatggtcaccattctgtgcaatagatctctaagcttattgctcctgggaggggaaagatttattgacttgcctgatgtaatcattccacattgtgaacatatatcaaagcattccatggtactatatatataatatatataatattttatataaaatattatatataatatatataatattatatataaaatattatatatataatatatataatattatatataaaatattatatatataatattatataatatatattatatataatattatatattttatataaaatattatatatatattatatataaaatattatatataatatatataaaatattatatataatattatatataaaatattatataaaatatatataatatatatatattatatatattatatataatattatatataatatatataatatatatatattatatatataaaatattatatataatattatatattatatatatatattatatatataaaatattatatataatattatatataatatatatattatatatataaaatattatatataatattatatataaaatatatataatatatataatattatatataaaatatatataatatatataatattatatataaaatatatataatatatataatatattatatataatattatatataaaatattatatataatgttatatataaaatattatatataatgttatatataaaatattatatataatatatataaaatttatcaattaaaaataaaaataaaatgctgacaaaataagaggtgttaaatgaatgtataagaaacatgaggtagctgaagtaggagtcttactcaaaccatctgccctgatctgtctatcatcccatgctgggacatgaaaaggcacatattcagaggactgggggaattgagagagagtgaaggacagacagagtcttcatcagggacgctcccacatgggaagcctcctaccatgaaccttaaagacgtgagttctggaaggtgtctgagaagagattttctgtggttttgccagagagctggcaacgaggtgatgggagcaaacccttccttcattattatattttccaaaactcacagcattattttggagaattgttaaggtagtaggagggagatttaagaaatagccccagagtgtctttgtgtttgctgccctgcatgtttgccaggaagaacatattcctcaggtattagtctcgtgctgctgataaagacatacccaagactgggtaatttataaaggaaagaggtttaatggactcacagttccacatcactggggaggcctcacaatcatggcaggaggcaaaaggcacatctcacatggtggcaggcaagagagaaaaaagagccaagtgaaacctcttataaaaccatcagatctcatgaggcttactcactaccatgagaacagtggaaaccacccccatgattcaattatctttcactgggttcctcctgcaacacgtggcaattatgggagctacagttgaagatgagctttggatggggacacagtcaaaccatatcacctgaggtatggagagactgaagaaaatgaatgtgccatttttgatctttacagagggtttcaaatttgcaaatgctcaaaaatgttatccctcaaagacctttgaggaaaaagttagttgattgactccagcaaaatggaatgtaatacaagaaaggcgagagtagacaagcacagtggctcatgcctgtaaccacagcattttgggaggctgaggtgggaggatcgcttgggtccaggagttcaagaccagcctggacaacatagtgcaatctcatctttactaaaaattcgtttaaaattgctgagtgtttactaaaaatttgtttaaaattgctgagtggcacatgcctgtagtcccagctactcagaaggctgaggtgggaggatcacttgagcccaggacattgaagctgcagtgagctatgactacactactgcactccagcctgggtgacagagcaagaccctgtctcaaaatactactactactactactaataataataataaaaagaagagagtacacaggaagcagtgctgaataaataaatgtataaaacaaagtctgaatgtgttagtgcacagttgtgaaaataatctggaattaacatttcacatgggaggtaattgaaagagcagagaagaaagagagaatgagcatatgttcatgtttttgtttcgtctgggaagaagacataggtaatgactatctttatatttgatagaaaatataagcttaaatacgtgtgctgacaggtgaaaggtggttaccaccagaaaactagaaaagatgtgtacaagtttcagagccttaatgggaaatgcgtggattgaagaaaacctgattcatgcaatcagaggtgggtgggaaagaattacaccgaagaagcagaaaatctgatatgtgtaaaaaagggaaaataatataaagtgaaactgcaggactcaatccaaatataaccatgatcataataaacatggatggattaaaattcctttaaaaaagataggctttctgaatgggaaaataaacataaaatccggacatacggtagtgtaggaggcagcttaattaaaaacaaacaaaatgttgaaaataaatggatgcatttgatatgattctgttccactatccaatctaagtaatggtcaattattttatagattgttcttcagtttttttttttttttttgagacagagtcttcctttatccctcaggccggagtgcagtggtgcgatcttggctcactgcaacctctgcctcccaggttcaagcaattctcatgcctcagcctccacaattgctgggagtagaggcacctgccaccacgcccggctagtttttgtatttttagtagagacggggtttcaccttgttggccaggctggtctcgaactcctgatgtcaggtgatccgcccgcctcagcctcccaaagtgctggaattacaggcttgagccactgtgcccagccttcagtttggttttgtccagtgttttctcatgattagactgaggttatgcatttttggcaaaaaaatcatcagaattgatgtaagttttcagtgtgtcatgttacggagtgcatgatgtctgtatgtcctgtcctggtgatgttaaatttcatcacctggattaagtggtgtctgttggaattctccactgtgaaattattattttttctgatccaggaaaggttaagcaagagtctggcaccattttaagtctaataagaaacatttactacctgatttctctgaagcctgctacctgcgggctacatgtgcataataaaaactttggtctcctcaacgccttatcctcacccagacatttcctttctactaattacaggtctttaatcagaaaatcctggaatccacctacgacctggaagttcctcactttgaatggaatcccacctttctggactaagccaatgtacatctcacatgtgtcgattgatgtctcctgtccccgtaaattgtataaagccaagctgtcacccaaccaccttgggcacttgttctcaggacctccttggggctgtgtcgtgagccattggttaaatgaataactcttttcaaatattttacagagtttgactcttttcatggacattaattggtgccctacacgtggggcctcagaaaagactcagaatccttgacgcagttgcccgaacccggagctaagttacccgcagggccattggaagccctccctggctttaggtttctcctccagtggaaccggtgagtcctctgcagctctggaccttccatttggttgatggtccttggttcattctgagctgtttttctacctcctttttatttttctcctaggaagttgttgtataggatcctactttaggtttggtggtgcattctaaatggtcttctccactgcccttttccccccaaattaatgtcgattggcctgtgagtacatttgcgtgagagactgaactgccacttttgtggcataattttgaattgccaaacgagaggctgacctcctcagcttggaaaagaaagggagttttgctcctcctagccaaaaaccacccctgggtggtaggggttgagtgggagtctctgggggattgactcctgccatgatgtgcagtgaccctacagggaaccacacaacaaaattaattttaagaggctcatccaggagacaggtgtaagagctgatcacttgctatgttgagccctgtcagaggtctagacctctggagagagaaactcagacacgtgaaagggtagaaagactcagtggtgacacacagtgtagtccctctcacagccagcacacttcaatccaccctactaaaacccaggccacagtttagttcctcattttaaaataaaagtgggagacatagcatgtaaggatgaggaaaggcggagagagcgacccccatttgggcaccccttttggttctctggttcctctacttgcaagtatttgtgtaagcgggaaaagcttgagggcatgccaggtcaaacaagaagcttcctgttacatattatgtctgtgcttgttcacactttaaactgctgcacacattacaccagagaaaattccagcccaaaggtcaacctgcaaccaatcagttcctaagtcctctattttgctattttcttttctgcctactttaaatcttctgtttactttttgttcttttcttttcttttctttttctttttttttttttttgagacagagtcttgctctgtcacccaggctggagtgcaatggcgctatctactgcagcctctgccttccaggttcaagcgattctcctgcctcagcctccccagtagctgggattacagacgtgcgccaccacgtctacgtaatttttgtatttttagtggagacaggctctcaccatgttgaccaggctggtctcgaactcccgacctcaagtgatccgccggcctcggcctcccaaagtgctgggattacaggcgtgaaccaccactcctggcccttctgttacttttccactgctgttgagatagaagtcactgttgggatccaacctttttgtttgtataaactggtgagtttgtgttgatatctcttgctagagttctgaagtaaaagctataggatctttgtgtgagtgtgcatgcgtatttagatgtgtttatgtacatgcacatatgtgtgcacatatacattttttacgtgctttagccctgaagtgtcaaattggcttcaagtcaaagagtactcataaattaaataataagccaaaacgcttttcaagttcacgtgacttacataaatctttaataaataagctggctttaaaattattggtacgatagtattagaaatatcttaaaaattgtcagcatacatgtttgtttgcatttactgatcaagcagtttcatatttacctctgacagatattataaggtgtcaaaatttggcataaggcttacaaaactataaacccagcaacccagcatgaaacacaataatctttgtttctgtactttttgagaaataagacgtttaatgttattagtgtagtaaaaagagctaaatcccaagttatcagtaaaatatatatatatttaaaatttttgcttaggcaaacacagaaaattcatagactataaaaatggttaacagggaaataactttaaatgatgactatcagagttttcacagataatctaggtaaaagattttataaaattaattaggtaaatgtaatgaaacaaatgcctgtaaataaatataatttagaatctaaagttaaataatagatattcactaaatgtctgggccattttcaatttaaataaattgtattatagaaaaacttttctaaaaaatatgttcttattcaaagctaagttattttcatctaattccatgtttatttatttatattttttgagatggagcctcgctctgtctcccaggctggagtgcaatggtgcagtctcagctcactgcaacctctgcctcccaggttcaagcgattctcctgcctcagcctcccttgtagctgggattacaggtgcccaccaccatgcctggctaatttttgtaattttagtagagataggggtcttgccatgttggccaggctggtctcgaactcctaacctcaggtgatccacccacctaagcctcccaaagtgctgggataacaggtgcaagccaccgcacccggccagattctaggtttatttaagggttatttatgaaatatggtaaaaggaaccaagaaacaagagatgtaaagaaagttaggctgcgtgcattgggtcacacctgtaatcccagcactttgggaggctgaggcaggcggatcatgaggtcaggagtttgagaccagcctgaccaacacagtgaaaccccacctctactaaaaatataaaaattagtcaggcatggtggcatgtgcctgtaatcccagctactcaggaggctgaggtaggagaattgcttgcacccgggaggcagaggttgcagtgagccaagatcgtgccactgcactccaggctgggtgacagagcgagactactccatctcaaaaaaaaagaagaagaaagttacaaggaggtatttttggtaagaaatgttaaaagaaaaataattttgtatgagaaagaatcttgttgtttaagagagatgtttaggacagaacagaaaatccaagcaggttgtatatggtctgtgcaagtcataatacagtctgtaaaaaaggaattcaaaaaaatttttatgtaattaagtttgctataactaaaaggaaattataatcattctaggtattggacttcaataataaaaatacagtaatgcaaaaggagatcattggttagaacaagattttcttaaaatactgatgtactcagtgaaattgcaagaagttttttatttttgaattccataatctcttcttgaaattcttcagatggacatcctaggggttccacttctgctgcatcctgcttgcctcagagctttccctcttttgaaaaggcctgggatggtaactctctccttcaacttttgctggctcccgtaattttttaaaaattaatagtctaaaggaagagagagaatttttgaaaacaggcaagtgaaaaatgttataggatgtgcctctatctgtgtgtctgtctataagtttatttattgtctgtttgtttgattgatttgtttattttggagacagggtctcactctgtcacccaggctggagcgcagtggtgtgatcttggttcactgttcccttgagcactgggctcaagggatcctcctgcctcacctcagccatccatgtagctggaaccacaggtgcatactatctcgcccagctaattttttgtattttttatgtagagatggggttttgccatgttggccaggctggtctcagtcctgagctcaagcgatccacccgtcttggcctcctaaagtgctaggattacaggcgtgtggcaccatgcctggccttgtctgtaagtttctatctgtcatgaggaagtaatatttcagtaccaaattatatgaaagagctctaatcaaatggcttaaagaaaagtaagtgcttatcagacaaccaaaagctagctcagatgcttttaattgacattcctttagtaatctttggtaagactaatttggtaaatttaatttcaaaatcctgtccagtggtttaaaatcttagagtcacgttagatgggactgttcccctgaccttgacccccttcgtgggcaggaactggagtggctcatgttactcagcctgcagtttgtggacagctatgtgttaacagctcagtgaagggtcaaggtgacagccttctgcatctgtccttttggacaccgacttcttgtttggtgtccaagaatcatcaggtcacacaaactgaaagatgatgaatgtggaggactttattgagcagtggaagtggctcttggtggaagaggagctggaaaggggatggtgtgtgaagaaggtgatgtttctctgaagcctagccttctctggctgggctcccctccaaaaccacaccgtctgaagttagtcatgtttatctgtagtctccaatgctcagttacttctctgctcgccactcagtagcttgtatccctgccggtcagctgcttgtgttgcttttttctttttctttttcgtttttcttcctgccagctggtctggtccttatgggcacaggatagggggcagggcaggccaaaaaggcaatcatctgggcagagaaacgaggtcagctgctttcactagggccgagcttccagacttgaggttgtagtttagccgggagcccagccatcctgtatcaatgttagattaaattaggcaatcctaggttttgcactggaaattagggttactgggagttggaatagtaggagagtaagatgtatttttggtgaggtttataaaaacacaaagatgtggtttttgccaaagaaaatgtaatgtttagaggctatttaaaggtcactttaaaataaatggaaaattatgtagataaaactcattggagaaagagaaaaataaagaggtggggaatgagaaacctttgacttttgggtggccacgtggtcacacatggtaatgaagtggcatcattttctggggtaaatacccgagattcattgtctcatggccacagaaatcgaggacgtggacacacagaatgaggttgagagcagaagtttagtaggcaaaagaaagagaagagctctctgcagcagagcggggtcctggagaagtgggttgctgcttctttgctgaaatgcagcaagttttatagatgagcttgaggaggcagtgtatgatttacataggacgcaaaagattggttggaccaggtgtaccattttcatagggcatgtaaagctggttaggactagatgtgtcatttgcatagggcatgaaaagctgggctaatcttttttttttttttttttgagatagaattttgctcttgttgcccaggctggagtgcaatggcgccatctcggctcactgcaacctccacctcccgggttcaagtgattctcctgcctcagcctcctgagtagctgggattacaggtgcctgccaccacacctggctgatttcgtacttttagtacagatggggtttctccatgttggtcaggctggtctcaaactcctgacctcaggtgatctgcccacctcggtgcctaatcttttattatgcagatggactctttacctggctagtgccatgtcgcctgttttttttgtttgttttgttttgttttgttttttgagacggagtttcactcattttgcccaggctggggtgcagtggcgtgatcttggcctaatgcaacctctgcctcccgagttcaagcaattctcctgcctcagcctcctgagtagctgggattacaggcatgtgccaccacgcctggctaatttttgtatttttttaagtagagacggggtttcaccatgttggccaggctggtctcgaactcctaacctcagatgatccgcccgcctcggcctcccagagtgctgagattacaggcgtgagccactgcgcctggcctctggttttttactgtacacgtggtgacaaagaaaagggaagacggagcctccatgttgaacatacctggcttccaggtagccctttcccattggcacagctgccagcatttacccattcaagcttccagcttgcttattatctatgcctgcagctctattttccaggctgctctttgttaaaaagaaatgatttgggggctcctttttaaaaagggaaattctgccaaggactcttttaccctcactatctgcctgaataatttctttctagttcctctatcagtaaggagatgcagctggcttgtcttcagtcactaaaggtcaaagccaccagaggaatttagagatggatcctactcatagtcccagggaatttcgttcactggatatatagcaaatgcaaattaataaggaaaaagtgaactattcaatcccttgcttactgcctctgtagttgctaaaatgaaagtaaaagagtgctgccttgggcgtgaaggcagcaccaagctcagatgtgggtctgtctcagatcaggccagtgacctcaaagcttcctacacaaggaaaaattaagccacgtcaaccaaaagttacctctgagacctgtgattaccaagaagatagacatgtggaggaagggcaaaaccaagtaactattaaacccagagggtatttacagggctgttcaatcttttggcttccctgggccacactggaagaaaaattgtcttgggccatgcataaaatacacaaacactaatgatagctgatgagaaaaaaaaaaggcaagaaaatgtcgtaacattttcagaaagtttacacatttgtgttgggccacattcaaagctgtcctaagccacgtgcggcccgcgggccgtggattggacaagcttgaaaaggaattggttcatcttctagattggtatcgtcagcttcctgagttcccttttctaaaatgggttgtaagaatgactactttaagaacagtatgtttaatttttttttttttgagaaagggtctcattctgtcacccagactggagtgcagtggcatgatctcagctcatcgcaacctccacctcctgggttcaagtaattctcccacctcagcctcctgagaagctgggattacaggcacacgccaccatgcccggctaatttttctattttttggtagagatggaatttcaccatgttggccagactactcttgaactcctgacctcaggtgatctgcccaccttggcctcccaaagtgctgggattacaggcgtgatccactctgcccaccgatatgcttaatttttaaatgccacagaaagaaagagcatgtttgggctggtgcagggcccgcagctcactcactattaaacacttgctgatgagtgtatgggacccagatgcacaggaagtttttcctgaggaaatggccagcctggtggactaggtaaacaccactacaaggtctgtttatcctgaaaaggggactgcccagccctccctataaaatgccaagtggagcaccctagataaagcagctgatgtgcttcatatgcaagccatgtgggattggcttaatgatgaccgggatattcaccagctgaatatgcccattacccaatgtattagtccgttttcatgctgctgataaagacatacccgagattgggcaatttacaaaagaaagaggggtaattagacttacagttccacgtggtgggggaagcctcacgatcatggtggagggcagggaggaacaagtcacatcttacatggatggtggcaggcaaagaaagagagccaagcgaaaggagtttctccttgtaaaaccatcagatctcgtgagactcattcactaccacaagaataatatggaggaaactgccaccagaattcaattatctcccaccaggtccctcccacaacaatgggaattatgggagatacaattcaagatgagctttgggtgtggacacagtcaaactatatcaccgaggtcatagtgtgaaaggaaaataaatctcaggaccccaaaatcactaagccaagggaaaagtcaagctgggaactgtgtcaggcaagcctgcctcccatttgattcttaaataagacagctacaaagataagaagctacatacccccctcacaatttgtgcttaaggaaattccttgtggacaaaggacagacggaactcaaagtcatccttccaaggctcccctgagacaaatgcttatctgataacttcctctgcctcattgcttatgtaaaagtacagattcacggagccagcctaaattgtgtattcagtggaaagctgatcaaggactcaaaagaatgtaaccttttgtctcgtgtctacttctaatctgaaagctcccacttcaagttgtcctgaattactgaactgagcccatgtatgtcttacacatattgattgatgtctcatgtctccctaaaatatataaaagcaagctgtgccctgaacaccttgggcacatgtcgtcaggacttcctgaggctgtgtcacaggtgcacgttctcaaccttggtaaaataaactttctaaattgactgagacctgtctcagatattttgggttcgcaatagattctcagtgtattaatgatgttaggtgaagaactgtgaagctcataaatttggaaaggaaaggtttatttctataaatgttgtggttcaagggtccccttctacaagagcaccccaggtgacattactcttgcagaatcaaacaatggtttgagaaaccttatcaaatttgcagttgtagctttccctcatgggtcttacagatgctaccaaaagactagggtgtcaacgagaagagacaaactgtaaatttttttaagaggtttattctgagccaaatatgagtgaccatggccgcccgtgacgcagacttcaggagatcctgagaacatgcgcccaatgtggtctgcgtacagcttggttttctacattttagggagacatgagatatcgatcaatacatgtaagacgtacattgtttccattcaaaaaaggtgagataactcaaagtgggggattccagctcatggatggacaagacacagaaggttgcattcttttcggtctttgatcagaatacacaatttacatgtgacggaggttggggggtgggggtggtgggtagaggaatagtgactgatgcctgttcagtgaatctgcaagtttgcgtaaacaatagggcaggggaatctatcagatatgcatttgtctcaggtgagcagagagggctgactttcacttctgtctctcctttgacccacacctgtgaagataagccaaggtgaaattgaacagaactgttttagggtaaagatcttgaggtccacaaaaaatttctttgtgggcaaattatgaaagaggtatgtagctttttgttttgttttgtttgtttgtttgtttgtttttgtctccatagctgtcttatttaggagaaaatgggaggcaggtttttctgatgcagttcccagcttgccttttccccttggcttggggattttggtttcctttcactaattaacaaacaaaattaataaattaacaaacaaaaacagggaagggaaaagtgagtcaaagggctcatgccagaagggtggaaatctttagataattattttgttattattattaatttttctttttttgagatggagtttcgctcttgttgcccaggctgacatgcaatggtgccatcttggctcactgcaaccccacctcccaggttcaagtgattctcctgcctcaacctcctgagtagctgggattacaggcacctgccaccacgcccagctaatttttttgtatttttagtagagacgaagtttcacaatgttgggcaggctggaatctttagataattgttaagaaataaaagaaaaggaaaattgatggagttaaaacaaaagactttacaacatgatcaaaggttgggtgggccacagggagccccaactggtcccccaacatgaaggggccccatgccagttttcttcatttgcctcagattggagaagtttaagaaaaattgaggctgggcatggtggctcaagcctgtaatcccagaactttgggaggccaaggcaggcggatcatctgaggtcaggagttcgagaccaggctggccaacatggtgaaaccccgtctctactaaaaatacagaaaaatttgctgggcgtcgtggcacgcacctgtaatcccagctactcaggaggctgaggcaggagaatcgcttgaacccaggaggcagaggttgcagtgagcagagatcatgccattgcactccagcctgggcaacaagagcgaaactctgtctcaaaaaaaaaaaaaaaaagttttagagcaggaatgaaaagaaggaaagtacacttggaagatggccaagtagctgacctaagagatcaagtgtatggttgacctttagacttggggttttataggttggcatgcttctggagtcttgtgtcccttctccgctgagtcttcccttggggttgggctgtccacatgcacagtggcctgccagcacttgggaggggagcatgcgcagtgtgtttactggagttggacgcatgctcacttgaggcgttcttcccttaccagctgaatgttcctagaaggttatagaccagttaaactccaccgttttgcttctcagtgtgcatgcttgagcccactcactcacctcctgagatcgtattgggaaactgctgaccaccagttttaggtgttttctatttactgggagacggcctttccctggtgctgactgtgaccaattattattttagagagacagtttaataaccgcctgatgctcgcctgacattcctggtggggctggggagagcctttcctgccttgctcatgcctgactagctacctactgtaacaataactgaactctttctaccgatttccagtgagaaaatctatgcatctatctatgacctgcaagcccccactttgaagtgtgtcacctttcctggctgaaccaatgtccatcttacatgtattgaggggtgtcttatgtctccctaaaatgcataaagccaatctgtaactcaacaaccctgagcacatgttctcaggatctcctgagggctgtgctatgggccagtagtcactcatatttggctcagaataaatatcttagaatagtttacagagtttgacccttttcatcagcagaggcatacactcttgctatgggatgttaaccgaagctaatggaaataatggtgtccaaaagagttccgtgatgaaacgtaaatggttcatgtaggacctgctacctggggaatgcaaagataatatacaaggagggagcttctttttcctcttcagactgactctgtaactgtgagaagatttttgccttccaaagttattagtgtgttcatttttatctcttaggaaaaaagtggcaaagttggagatggtgtacactttcctttattgcttgactgaggttaaaaatttggccaggcatggtggctcactcctgtaatcatagcattttgagagcccaaggccaaggatagcttgagccaagaagttcaagaccagcctgggcagcatagcgagaccttgtctctacaaaaaataaaaaaattagctgggtgtggtggtgaacacctgtaatcacatctacttggggggctgaggtgggaggattgcttgagctcaggagctggaggttgcagtgagccaagattataccactgcactccagcctgggcaaccaagcgagatgctgtctcaaaacaacaacaacaacaaaaagaacaacaaaaaacaaaaaaaaacttgtattctattgtctcccatcagattatttttaactaattttattttaatcacttactgttgagtcacctctgagattttctattccagtggcgtccttataaaatgaagcttccttgtcaactgcacttgttataacaccgagcttctgctaagaaaaagcaaatgcataactctgtataacctatctcccatgacagggtctatgcctcgctgtatttaagcattcattttagttttcagcaatgtagtactttcacctatattttgtcaaattcaaacacttgcaatacttcatttattttttctgcatgtccttcatattttggctttgctagtccactttggccaaaaagctttgattctttaagtataggcctaaatatcctatcttaagcatgggtgtaattttcttctattaccaacagaggttcttttatagtttttgaaatcactgattaaaaagaaacagctcaaattatattctactgtaaaaatgatacattcagcctgggcacggtcagtcacatctgtaatcacaatacgttgggaggctgaggcaggaggatcacttgagtccaggagttgaggctgcagtgagctgtgatcacaccactgcactctagtgtgggtgacagtgagaccctgtctcaaaaaaaaaaaaaaaaagatacattcaaagaagtcaaaataaaacagtataaaacctatctccctgattgcagctacctttttttatgcatacgcctgcaatccttttacacctatcacacactaaaaatgttttacagttattgttattgcacacagaaggcatctaggaatgttttaaagaacctgtctctctgaagttcatcctgcttatctaacttgtctatcaaggaaattattttcttgattattattgctgagaaagactgggtgaggttgctaccccagaattagcagatgcaaatcaggaggaagtgaacaggctgcaaattagcaagttctggcatggggtgaggcaatggcagaaaatcggtttcctgggaaccatgcccaggaactagcctgacattgtgagaaagctcccaacattcataatgagttgcatattaaattccagggaagggcactgtaggtaagatggaccacatttggaaatacactttttcagacgttttatttagggagaatttctgacatgtcctccgataatttgaacttccttgatttgcagttgtacattgagagatcatttcttggtcaaaataaatgttcagcaggtgtgaatgctgtatccacaacttttttttttttttttttttgagacagtctcactctgttgcccggggtgaagtacagtggtgtgatctcagctcactgcaaactctgcctcccaaattcaagcaattctagtgcctcagcctcccgagtagctgggattacaggcatgtgccaccatgcctggctaattacaacttaatttttaaatttgggcagatttacaaaactatcaagctattaccctgcagcatccttagccctaagcttgtcactacttgtaatgtatttttattttatttatttattttttgagacagagtttcactcttgtcgcccaggctggggtgcagtggcatgattgcggctcactgcaacctccacctcctgagttcaagcgattctcttgcctcagccttccggaccacaggtgcatgccaccacgcctgggtaattttttttttttttttttttgaggtggagtttcgttcttgtcattcaggctagagtgcaatggtgtgatcttggtttactgcaacctccacctcccaggttcaagcgattttcctgcctcagcctcccaagtagctgggattacaggtgcccaccaccacacccggctaatttttgtatttttagtagagacagggtttcaccatgttggccaggctggtcttgaactcctgacctcaggtgatccacctgcctcggccttccaaagtgctgggattacaggcatgagccactgcacccagcctacctactggactttttttcggagacacactgtagtttctcaagaaagaatgcctgttcctggtcccagctgcacactcactttacagtgtgtgctgtacttggtcaagtgtattgatattgaaacacaagccagactggatggaccttggtcataaatcatggggcagctctccttcactgtcagataaaatccaaattctctattactacctccaaggtcccagcattgacgatctgttcttttcttcctgaagggacatcacccccggttctcagggtgtctcctcacaggcttcttacaaatgcctttcctcaggaatgtggctccacaatgacttttttttaattaaaaaatttgcagcctacaatcagcctcctcaattattattattattattaattgttattatcattacttgaaacagggggagagtctcactatgtggtccagactggtttcaaactccttgtctcaaaccatcgtcttgccttgacctcccacagtactgggatgacaggtgtgagcccccgcacctaagtgtcctcttaaaacccatgaagtcttttagggctgtctacttttctctatggaattcaaatcgctaagcattcatgaaagtttagataaggtggaaataaatccaacctttaggatggatgcatgaaactgctctcttttttttttttttggtagagttttgctgttgttgcccaggctggagtgcaacggcacgatctcggctcactgcaatctccgcctcccaggttcaagcgattctcctgcctcagcctcccgagtagctaggattacaggcatgtgccactacgcctggctaatattttttgtatttagtagagacagggtttcaccatattggtgggctggtcttgaactcctgacctcaggcgatctacccacttcagcctcccaaaagtgctgggattacaggcatgagccaccacatccagccaaaactgcacttaaaatccaatctttggccgggcgcagtgactcatgcctgtaatcccagcactttgggaggccaagacgggcagatcacctgaggtcaggagttcgagaccagcctgaacaacatggagaaaccccgtctctactaaaaatacataattagccgagcatggtggcacatgcctgtaatcccagctactcggaaggctgaggcaagagtatcacttgaacctgggaggcggaggttgcagtgagcccagatcgcgccactgcactccagcctgggcaacaagagcaaaactccatttcaaaaaaaaaaaaaaaaaaaaaaatctaatattgtccccaattcctacttttgggagtaaactatgcctatttcaaactattgctggacaagattgcctggtttctgcttccccttatccctcttgttcaagtcaaccagtcaggaaatataaagaatgatcaaggaaacctccaagttaacacagaaatacgtatatatggtgaatgctgtctgcagacagcttatggccccatggtactagccgtcatagcacatggcaaagttgtcctattgactctgctgtcagcccctgcgtggaagaccaaataaaggtgctgggacagaaggatgaaaaggaatcctaggataaatatctcatcttcatcgtccctgggttggataattctgagggtctgtcgttgaatctcagtgtttctgcacagcactcagcttcaatagcccagtggcaagctgcttcataagtacaacctctactggcttcctgcctttccctgtctctcttcctctttccctgaccaatgctccctcaattacctccctaataacctacttggatttaaggtttgaaaaagaaatgcggcatcattctttttgtcttaaatttttaattaaaaaaaatttttttcgagatgggatcttgctctgttgcccgggctgtagaacagtggtggaattacgatacggctcattgcagcctcaaaccctttagctgaagcaatcctcccacctcagcctcctgagtaactgggaccacaggtgtgtgccaccgtgcctggataatttttgtaaaatattttttgtagagacagggtctcactagttgcccaggctggtctcaaactcccaggctcaatcaatctgcctgtctcaacctctcaaggtgttgggattacaggcgtgagccactgcgccgggtcgcaccatcattcctattttttttttttttttttggaaatgaagttccctctgtcacccaggctggagcacagtggcgctatctcggctcactgcaacctctgcctcccgggttcaagtgattctcctgtctcagcctcctgagtagttgggattacagtcatgtgccaccacacctggctaatttttatatttttagtagagacggcgtttcgccctgttggccaggctggtctcgaactcctgggctcaagccatctgcttgcctcaactcccaaagtggtgagattccaggcatgagccaccactcctggacgaagcatcattcttaatttcaatgtctagtctagacatttaaaagaattgaacatattggatcgtatcaaaacaacatcttgttgaagagaatgaccctctccacccaacctgaaacagatggaggcagtgctgactttatctcaatcttaaacaaaatctgtttcactcaattttcttgtagacaggccgactgctttattagaaaacaggagaacattgacctttttctatgattctcttccgatcaccctaggtagaattcctttcactttctaacctgtgtctgtttcaacccaggatacattaagcttgttgtctgtgacactttattgaactttttaatagccacgactgacactgatcctctctgctgagagaggagctattctgattccattcattgtgactccaaagtctaccctggaagtcagatgctcaggtgggattttataaatattccatgaacaaatgaacttcggctttggggtaaaagagtcggttgcccatcatttgatagatccctggatattttttcataaaaaacaccctagcaggttgcttattgcaaaatgacatgtgtcatatcttctctggagctgaatattgttaagcaaaatttatattaatgagaagcaaaaaaaagtttgtttgttttgctttgcttcagcaagaattatctgttgcatcagaaatgcagggagcacttttgctctttattagcgtttttttccccagaaactctgacattactaggacacttggtcatctgtgatctgcttaaaagctctcttcagctcctggaagagtaggtggttctgattctctttcggtgagatggtttatggagccctcttcatcccataattctgaagagtaacaggcagaacgtcttattagggggcagctgaaatcgtctagggaatgtggctagggagtgtcgtcatctttacatcaaaggctatgcacagataacacgccaatcctgatttcacccatgagaaaagtgaactccaagaatttcaggaatgtagacgtgtcgatgataaacattgcatttattacaatttcactttatttcctagaagaggggacattatatttcctggccagatgctaccctttgaaagaaatgcaaactttgataaaatagacatgctatcaatttccttaggggagctttatcttcactgggtcactatacccagcatgacagtaaagtctgccatgtgtttcttgtcccactggaaaaaaatacatagaaaagctatgtacaaggactgtattaagattcatctatgtctttcagagatggcaggcaagtgccatttctgaacaatttgggtgaagtcagacacatgcaccttaccccgacaaccactcaatggacagcagaacattgcaaatcatgacctgtaataggactgtctttgacttacacagctcaggaaacaacacttggtttggtcaaaggtttgttccttttcatttcgtgttctagtgttttcttttcctgcccttatgacagttgtgtgcaatggcattattgcattaaatagacacgactgattaggtagcatgaaccatagtttagaatttggctaagtgtggctatgttactgtctgttttttctttttctttttttaggagatagggtcttgctgtgttgcccaggctggagtacagtggctattcagacatgtgattccaccactatcagcacgagagttttgacctgctgcatttgtgacttagggtggttcaccaggccttaggcagcctggtggtcttctgctcctgggaggtcaccaagctggtgctgaacgtagtgcagatacttgatcagcctagcgcaccatagcccagaacttctgggccgaagcgatcccccacctcagtctcctgagtagccgggaccacaggcaggctacttgctgtttttgtcaacataaaagggagtcagaaaaggcagaacatatcaagatcagtaaatctaggctgggcatgatggctcacacctataatcacagtgcttcatgaggccaaggcaggaggattctttgaggccaggagttcaaaaccagcctgggcaatatagggagaccttgtctctacaaaaaaatagaaaataaagaaattacccaggtgcagtggtgcatgcctgtagttccagccactccagaggctgagactggaggatctttcgagcttaggaggctgaggctgcagcgagctcttatcacaccagtgcactccaacttgggtgacagaatgagaccctgtctctaaaagaaaaagaaaaaaagagattagtaaattctttagaaaccaagattttaccatgagcagttgcatgaaggtggaaaacctttctgtgattataagtagggattctgaaagaagtcctcaaagtgaatacttattccatggagaaacagaatgaattgagagagtcctggaagctgggaggagaggaatctgtagaaagcagagtcacttaactaattcaccaatgagactgcaaaccgatggtcatggagctgccatgggaatctgaattacagtcacttttattctttgtattttattgtttggattgaaaatgcggccaggcacggtggctcatgcttgtaatcccagcactttgggaggctggggtgggtggatcacctgagatcaggagtttgagaccagcctgaccaacatggtgaaaccccgtctctactaaaaatacaaaaattgggattccattccaagatggccaaatagaaacagctccggtctacagctcccagcgtgatcaacacagaaaacgggtgatttctgcatttccaactgaggtatcttgttcatctaattgggactggttggacagtgggtgcagcccacagagggcaagccgaaacagggcagggcattgcctcacctgggaagtgtcagaggatttccctttcctagccaaggaagctgtgacagactgtacctggaaaactgggacactctcgcccacatactgcacttttccaatggtcttagcaaagagcacaccaggagattatatcctgcacctggctcggcagttcccactcccacagagccttgctcactgctagcacagcagtctgagattgaactgtgaggcagcagcctggctgggggggtgggcatccaacattgctgaggcttgagtaggtaaacaatgtggccagggaagctcgaactgggcagagcccactgcagctcagcaaggcctactgcctctgtagattccacctctgggggcagggtatagctgaacaaaaggcagcagaaacttctgcagacttaaacgtccctgtctgacagctctgaagagagcagtggtgctcccagcatggtgtttgaggtcttagaatggacagactgcctcctcaagtgggtccctgacccccttgtagcctaactgggagacacctcccagtaggggccaactgacaactcatacaggtggtgcccctctgggacaaagcttccagaggaaggatcaggcagcaatatttgctgttctgcaatatttgctgttctgcagcctccactggtgatatccaggcaaacagggtctggagtggacctccagcaaactccaacagacctgcaggtgagggatctgactgtcagaaggaaaactaacaaacagaaaggaatagcatcaacatcaacaaaaaggacatctacaccaaaactccatctgtaggtcaccagcatcaaagacaaaaggtaggtaaaaccacaaagatggagagaaaccagagcagaaaagctgaaaattctaaaaaccagagtgcctcttctcctccaaagggttgcagctcctcacgagcaacggaagaaagctggatggagaatgactttgacgagctgacagaagtaggcttcagaaggtcggtaataacaaacttctccgagctaaaggaaatgttcaaacccatcgcaaggacgctaaaaaccttgaaaaaagattagacgaacagctaactagaataaatagtgtagagaagaccttaaatgacctgacggagctgaaaaccacagcataagagctacgtgatgcatgcccaagcttcaatagccgattcaatcaagtggaagaaagggtatcagtgattgaagatcaaatgaatgaaataaagtgataagagaagtttagagaaaaaagagtaaaaagaaatgaacaaagcctccaagagatatgggactatgtgaaaagaccaaatctacatctgattggtgtacctgaaagtgacagggagaatggaaccaagttggaaaacactcatcaggatattatccaggagaacttccccaacctagcaaggcaggccaacattcaaattcaggaaatatagagaaagccacaaagatactcctcgagaagacacataattgtcagattcaccaaagttgaaatgaaggaaaaaatgttaagggcagccagagagaaaggtcgggttacccacaaagggaagcccatcagactaacagtggatctctcggcagaaactctacaagccagaagagagtgggggccaatgttcaacattcttaaagaaaagaattttcaatccagaatttcatatccagccatactaagcttcacaagtgaaggagaaataaaatcctttacagacaagcaaatgctgagagattttgtcaccaccaggcctgccctacgagagctcctggaggaagcactaaacatggaaaggaacaaccagtaccagccactgcaaaaacatgccaaattgtaaagaccatcgatgctaggaagaaactgcatcaactaacgagcaaaataaccagctaacatcataatgacaggatcaaattcacacctaacaatattaaccttaaatgtaaatgggttaactgccctgattaaaagacacagactggcaaattggatagagtcaagacccaacagtgtgctgtattcaggagacccatctcatgtgcagagacacatgtaggctcaaaataaagggatggaggaagatctaccaagcaaatggaaagcaaaaaaaaagcagaggttacaatcctagtctctgataaaacagactttaaaccaacagagatcaaaagagagaaagaaggccgttacataatggtaaagggatcaattcaacaagaagacctaactatcctaaatatatatgcacccaatacaggagcacccagattcataaagggagtccttagagacctacaaagagacttagacttccacacaataataatgggagactttaacaccccactgtcaatattagacagatcaacgagacagaaggttaacaaggatatccagtacttgaattcagctctgcaccaagtggacctaatagacatctacagaactctccaccccaaatcaacagaatatacattcttctcagcaccacatcacacttattcaaaaattgaccacatagttggaagtaaagcactcctcagcaaatgtaaaagaacagaaatcacaacaaactgtctctcagaccacagtgcaatcaaattagaactcaggattaagaaactcactcaaaactgctcaactacatggaaactgaacaacctgctcctgaatgactactgggtaaataacgaaatgaaggcagaaataaatatgttctttgaaaccaatgagaacaaagacacaacataccagaatctctgggacacatttaaaacagtgtgtagagggaaatttatagcactaaatgcccacagaagaaagcaggaaatatctaaaatcaacaccctaacatcacaatgaaaagaactagagaagcaagagcaaacacattcaaaagctagcagaaggcaagaaataactaagatcagggcagagctgaaggagatagagacacaaaaaacccttcaaaaaaatcaatgaatccaggagttggttttttgaaaagatcaacaaaattgataggccgctaacaacactaataaagaagaaaagagagaagaatcaaatagatgcaataaaaaatgataaaggggatatcaccaccaatcccacagaaatacaaactaccatgagagaatactataaacacctctatgcaaatgaactagaaaatctagaagaaatggataaatttctggacacatacaccctcccaagactaaaccaggaagaaattgaacctctgaatagaccaataacaggctctgaaattgaggcaataattaatagcctaccaaccaaaaaaagtccaggaccagatggattcacagccaaattctaccagaggtacaaagaggagctggtaccattacttctgaaactattccaatcaatagaaaaagagggaatcctccctaactcattttatgaggccaacatcatcctgataccaaagcctggcagagacacaacaaaaaaagagaattttagatcaatatccctgatgaacatcagtgcaaaaatcctcaataaaatactggcaaaccaaatccagcagcacatcgaaaagcttatccatcatggtcaagttggcttcatccctgggatgcaaggctggttcaacatatgcaaatcagtaaacataatccatcacataaacagaaccatcaacaaaaaccacatgattatctcaatagatgcagaaaaggcctttgataaaattcagcagcccttcatgctaaaaactctcaataaactaggtattgatgggacgtatctcaaaataataagagctatttatgacaaactcacagccaatatcatactgaatgggcaaaaactggaagcattccctttgaaaactggcacaagacagggatgctctctttcaccactcctattcaacatagtgttggaagttctggtcagggcaatcaggcaagagaaagaaagaaagggttttcaattaggaaaagaggaagtcgaattgtccctgtttgcagatgacatgattgtatatttagaaaaccccatcgtctcagcccaaaatctccttaagctgataagcaacttcagcaaagtctcaggatacaaaatcaatgtgcaaaaatcacaagcattcctgtacaccaataacagacaaacagacagccaaatcatgagtgaactcccattcacaattgctacaaagagaataaaatacctaggaatccaacttacaagggatgtgaaggacctcttcaaggagaactacaaaccactgctcaacgaaataaaatgacacaaacaaatggaagaacattccatgctcatggataggaagaatcaatattgtgaaaatggccatactgcccaaggtaatttatagattcaatgtcatctccatcaagctaccaatgactttcttcacagaattgggaaaaacgactttaaagttcatatggaaccaaaaaagagcccagattgccaggtcaatcctaagcaaaaagaacaaagccggaggcaccatgctacctgacttcaaactatactacaaggctacagtaaccaaaacagcatggtactcataccaaaacagagatatagaccaatggaacagaacagaggcctcagaaataacaccatacatctaccaccatctgatctttgacaaacctgacaaaaaccagaaatggggaaaagattccctatttaataaatggtgctgggaaaactggctagtcatatgtagaaagttgaaactggatcccttccttacactttatacaaaattaattcaagatggattaaagacttacatgttagacctaaaccataaaaaccctagaagaaaacctaggcaataccattcaggacataggcatgggcaaggacttcatgactaaaacaacaaaagcaatggcaacaaaagccaaaatagacaaatgggatctaattaaactaaagagcttctgcacagcaaaagaaactaccatcagagtgaacaggcaacctacagaatgggagaaaatttttgcagtgtacccatctgacaaagggctaatatccaaaatctacaaagaacataaacaaatttacaagaaaaaaacaaacaaccccatcaaaaagtgggcaaaggatatgaacagacacttctcaaaagaagacatttatgcagccaaaagacacatgaaaaaatgctcaccatcactggccatcagagaaatgcaaatcaaaaccacactgagataccatctcacaccagttagaatggcgatcattaaaaagtcaggaaacaacagatcctggagaggatgtggagaaataggaacacttttacactgttggcgggagtgtaaactagttcaaccattgtggaagacagtgtggcaattcctcaaggatctagagctagcaataccatttgacccagtaatcccattactgggtatatacccaaagcattataaatcatgctgctatcaagacatatgcacactattcacaatagcaaagacttggaaccaacccaaatgtccatcaatgatagactggattaagaaaacctggcacatagacaccatggaatactatgcagccataaaaaatgataagttaatgtcctttgcagggacatggatgaagctggaaaccatcattctgagcaaactatcacaaggacagaaaaccaaacactgcatgttctcactcataggtggtaattgaacaatgagaacacttggacacagggtgggggacatcacacaccgggcctgttgtggggtggggggttgggggagggatagcattgggagagatacctaatgtaaatgacgggttgatggatgcagcgggccagcatggcacatgtatacctatgtaacgagcctgcatgttgtgcacatgtaccctagaacttaaagtataataaaaataaataaataaataaataaataaataaaataaaatcaggagaaaaaaaattggccagtcatggtggcaggtgcctgtaattccagctactcaggaggccgagacaggaaaatcgtttaagaccaggaggcagagattttagtgagctgaaattgtgctgctgcactccagcttcggcaacagagtgagactctgtctcaaaaaaaaaaaaaaatgcacatgccctttatatgtaaattttcattttagggaataagttcacatcttcttaacatatattattttggtgtttttagacaattccagttcaaaattcctctccaggtacatttacctgaagaaatctgcatctctggtctaatgcaagatctggtttccaggctgggcgcagtgactctcgcctataatcccagcactttgggaggccgagatgggaggattgcttgagcccaggagtttgagaccagcctgggcaacatagtgagattatgtaaaaatacaaaaattatccatggactagtgggtgcctgtagtcccagctattcgggaggctgaagcaggaggatcactcgagcctggaagtcgaggctgcagtgagctgtgatcaccataattttactccagcctgggtaacagagagacaaccagtctcataaacaaaacaaaacaaaatctggtttctagagtttatagaatcatacaacagcatgtttcatggagcgttccatctcacaaggtggtgtttggtttagagagggttatgtatgccctctgatattctcaaatctttatttaaaatgctgggagagttgctatctggctttgcatcagtgtttaatataatagccatccttttggggtgggtgttgacgaacagcacacctgccatcttccaaattataccccacactttgtcttgttgaatattattaagatataaagacagggaagaccttccatttccctcccacgtccccaccacctttagttgggagcacagatgtccctgaggcactgctatagaccatgaggtcaccgcaacacaagggacatcaaatgggattgctctggctcaaaacagccagtcttaattctggtgcgatgaatggctttggtggtcgtcccagataagaacattcagcgtcagcaagaaaggctgtaggtatttggctgaatgtaatgttttgttgttgatgtgctgttgtttttcttttcctgggtgtgtagtaggagttgcaaatgcgggctgcagattagcaacgggaaccatctgggtgagcctagcagggaccagccctcccatgggagagagaggtgacacggagcagctgatgctttcgtaatgattcgaggcagctgccaaaagaggcagagcctttgcagaacagcctgtctgttctgctcctagacattagagagataatacggctgataggtgagttggggaaggcttgtttggacacattttctcagccttttttttttttttttaacctctggtagaaacgggcatagttgaaagatccattgacctattgtattctgaaactcaatggatcatcagcttaggcactgagaaatggattccaaaccaattttagtgtgagcaagtttctctcctttctgttactctcataccctttcttctttcttccctccctccctcccttcctttttctttcttaaccaagaacgtgtgtgtgtgtgtgtgtgagtgtgcgtgcgtgtgtgtctgtgtagtgtgtatagtatgtgtccagagtatacatgctttggaacaaaatgaatttaaggaggaatgcgtttgtattttgtccttagtgttattttaaggtacaaatatgggtaataacttgcagactacagatgggcttttctttcattgtaatgcatttggctgtcatatcccttagtcctaacccctctgccactgccaactaaatataaccattagtcattcagtggtttctgcattttgcagtcaaaaaagagggagctcattttgattaattgcctctttccttattcaggacacagaagctttctgagtttaaacttttaggcttggcaggacattgagacaatgctcttgggccagcatgtttcagggcaggttttgccactgagacaattcatccaagagccccaggacttggggcagcaggagttcttttaaaaatgggccaaaagacgggcagagcacttgaggtcagcagttcaggaccagcctggccaacatgctgaaaccccatctctactaaaaatacaagaattagccgggcgtggtggtgcacgcctgtagtccccactactcaggaggctgaggcaggagaatggcttgaacccgggaggcagaggttgcagtgagctgaggttgcaccactgcactccagcctgggtgacagcgagactccggctcaaaaaaaaaaaaaaggtcaaaagaatgaactcattgaaagttcaggatttgtgcagtagtggccttggaaaatcaatttaaaaatgtcggaattagggatatggctcacaagtctagtgtgaatttcatgctgggaactaatttaattgacacatgaatgatactttttttttttttttttggtcttttaaatcacgtctgtgtcttctgccaaagacaacaagaaggtattccaagctgcacaatgaggcccaggtaggtaaagccatatactgcattgtgagcacattgaatctaatgtataattctgtgtatttgtgaatccagccttataggtagaggcatttaatatcatctgcctttttttcttttttctttttcttttcttgtaacctactatgagtcaacatgctgtctttatatggctggccataagatgtctaagttcattctctcgacttagtaagtgtgtaagttttttaaaaaggtaggagttaggcaattgatagagatgtaaactgtaaatttccaacagatacatatgagtttatgtttatttttatttattttagagacagggtttcacagggttttgctctgtcacccagggtagacgacagtggtgcagtcatagctcactgcaacctccaactcctgggctcaagagatcctccagcctcagcctccagagtagctgggacctcaggtgcttatcgccacgcccagctaattttttatttttattttttgtagagacaggttctcattttgttgcccaggttggtcttgaactcctgggctcaaggaatccccccgcctcagcctctcaaagtgctgggattacaggtgtgagccaccattgtgcccagccgtatacatgattttaaagtgttgtaaaaacaggaggtgaaaaaattcaactaactttgcatagatgaaaagcatttctataacttcggggatttggcccacagtcctgagcatgtagcttttgcctgcaagacattctcaatcttcaaggagatgtttgcatacagcaaaaaaattgtactcttctgtggctgtcattgtttcagagtatttacaaaggactctgagagccaatagggatgaactcctgtttgtattttttctctcagaggagatatttgaagtgggttttgaaacatgtatagacatgagataggaattgaatcaataatccacatgtccaatattcattacctgataactgagtagggatatgctgagaagagcgtcatgtgtttccttaagaaaatatgacctcagctgggactgagcaaaactatgaagtggactcaggtggtcctcagagtccacgtttctttcttttcctcaattcagttctttccccaacttccacttttcctttacttggtaattccttattttattttatttatttatttttttgcttgtttttcttttctccagccaaagctgctattctcacactttttcttcttttgagggtctcgtcctgtagcccaggctagagtgcagtggcgcaatctcagctcactgcaggcttgaactcctgagctcaagcgatcctcccacctcagcctccagagtagctgggactacaggcatgcaccaccacacccagttcatttttacatttttttgtagggatggggtctcactatgttacccaggctggtgacgaactgattctcctgcctcagccccccaaagagctgggattacaggtgtgagccactgcaacctgactttttaaaaatttggagtaatgataaattgcatgtatttattctttttatattatgaatattttatttttatttattttttctttctttttaaattcatttttctttttatttttttcctttttaaatttctttttctttttttattgtcccttgagtcaaaaaagctgacatataaacattgcatagatttatggtgtacaacttgatgttttgaaatacgcctgcattttggaatagctcaattatgctaatgcatgttacctcatccacttacctatttgtgatgagaacactttgagtagattttatcagtaattttcaactctaaaatacattcttattaactacagtcagcacaagtacaatagattctttgaacttatttctcctgtcaaattgaaattttgtatccttcgaccaacatctccccaacccctccactggccccccagctcccagcaggcatcattctaccctttccttctatgagatcaactttttgagatttcacatagaagtgagatcatgtggtattggtgtttctgtgccaggcttattttccttagcataatgacctccaggttcatccacgttgttgtaaatgacagaatttcattcttttttaacgctgaataatattccacggtgtatatgtaccgcattttctttatccattcatgcaatgatggacactgaggttgatttcacagtttggccattgtgaatagtactgtaaggatcacacacacccacatgcccttaaattagaataaaaattctaattttagaatgaagttaaggttaaatcccttacctgtagagactcatttaagtcccttaaatgaggttaagtccctggaagagggagttaacctcaggagtcttatcgtctccgtcctctgcaatgatttgcccctgagtacgtgttttcagacttccctcctggaagggcatctactttagccttttaaaaaaaattcaatagtttttggggagcaggtgatgtttgattacatggataagttctttagtggtgatttgtgagattttgatgcacccatcccctgagcagtgtacactgcacacaatgtgcggtctttgatccctcactcccctcccaccctttccctgagtccccaaagtccattgcgtcattcttatgcctttgcagcctcatagcttagctcccacttatgagtgagaacatacaatgtttggttttccattcctgagttacttcacttagaataattgtctccaactccatccaggttgctgcaaatgacattattttgttcctttttatggctgagtagtattccatggtgtgtgtgtgtgtgtgtgtgtgtgtgtgtgtgtatgaatatgaaaatttgatatggatagatagatacctgcagatctatacagataaagaagatgtgttatatataggtatctacagatctatagatatcaagagtgtctcgctccaagcaccaagcactgctgctgaatggcagcagaagtgcccaaagaaatgcgctcttggcttctcactttgtatacaatctatagctatctatctctatatatcacattttctttatccactcattgattgatgggtatttgggctggttccacatttttgcaactgcaaattgtgctgctgtaaacatgcgtgtgcaagtgtcttttgttgttgttgttgttgttgttgttgtttttgatggaacctcggtccgtcacccaggctggagtgcagtggcacaatcttggctcactgcaacctccgcctcccgggttcaagtgattctcctgcctcagcccccctagcagctgggattacaggagtgtgccactacactcggctaatttttgtacttttagtagacacagagtttcaccatgttggccaggctggtctcgagctcctgacctcaggtgatccacctgcctcggcctcccaaagtgctgagattacaggtgtgagccaccacacccggccgcaagtgtcttttatatataatgccttcttttcctctgggtagatacccaggagtgggattgctggatcaaatagtagatctacttttagttctttaaggaatctccatactgttttccacagcgcttgtacattcccactaacagtataaaaggattcccttttcactgcatccatgttaacatctgttgttttagcctttattttatgcaaagtgagaagccaataacgcattacgttgggcacttccgctaccattcagcagcagtgctcggtgcttggagagagacactcttgagcttcaggagatgcctgggagatccacgtgatctccaaagacccctgttgtgttgtgttgggaggtggatcctgaatccacccagagaagcctgataccaataaaatccctgcttgctttccaggagacccttggtcttcatgtctttggtgtgtgcactcttgaacacatgccaggcacacagggtgcatgacgacaagcctaatattgtcctaatcatggttgatgacctgggtattggagatctgggctgctacggcaatgacaccatgaggtaaggcggtttcatggccagtcatacgttcgtcagtcgttcaggttcagcaggctggctgtacggctgcatctatgtgcaaaaccaaatgtatttgttgggacttttttttaagttactttaaactttttgatagttttaaattatttagattatgtaatagttttacaattacatttttaataattttaatttgaatctctttcagtttttaaacttaagaaataataattgtccatcttcacagggtacacagtgaggtttggatacatacaaagtatagtgatcagatcagggtaatcagcacatccagtgcctctagcattaaccaggatggtcatagtaaaagcatggctatctggacccgagtcctggctctgcatttactagctctgaagtcttagagaagtcgctgaacctctctgtgcctgttttcttatttgtcgaatgcagagaaggctttatatccctgagtttatgtgtgtaaagaacttagaatagtacctaacacacaactaccctctatcatacagcctattatgaagcatgatgattgtatgtacatgtacatatacagatatgaacatataaatgtcattatataaatatatgtgatatattcatatatgaatatattctataatatataaagtatatatcatacatttattatattacatatccatatattatgaatatatgaacatacattcaatgtataaacatatatgaatatatttataatatatgaatatataatattactaatatatatgaatatgttattcatatatacatgaacatatacatatttctatgtctatgaatatatattcacttttatataaatgtatttttaaaaattaaatataaatatatttaaataaatatataaacatatatttatatattttataaaagtacatttaaataaatatatgtaaatatatattcattttatataaataaatatttatataaaatgaatatatcttcatacatattgataatatataaaagtatatattatcaatatatattgataatatataaatatatatttatatatataatatataatattcataataggctgtatgatagagggtagttgtgtgttaggtactattctaagttctttacacacataaactcagggatataaaggcttctctgcatttgacaaataagaaaacaggcacagagaggttcagcgacttctccaagacttcagagctagtaaatgcagagccaggactcgggtccagatagccatgcttttactatgaccatcctggttaatgctagaggcactggatgtgctgattaccctgatctgatcactatactatatattaataaataaatatatattatttattaatatatatttaattatacatatataaatattttaatataaataaatataatataaatatttataaatatatttataaataaaattatatataattataaatatataattaaatatataattaataaatatatattataaatatagatttataatatataaatatatattaataaatatgtatgaatttatgaatatatattcaattatatatattcataaatatataaatgtgaatatgtatattcagcagaattcattctgtttcctaatttggtgagccaatagattctttaagatggtgagcttgtatttttaacaatgggcattctgaaagaagaaaaacagatatgaaacaaactcagtgctttgtggtggataatagaagctatctgtattagccattcttatactgagcttaggagtacatcgttatcagacgtacatcatacacttttaagatcattgcgttgtatgactaatagatgctgaaggtagtcatcacagttttcgacaacggagctaggagtcatgaaaaagtagtcgccaaaaattaaccattgcttatgagaaaagaagagaggactcaccgaaaagcgcagaaacatggtgtccataaatggcagatatttacagagagtatgttagcgtggggtatcggtgttttgctgaaaatactagcaatttgagaagtgagattataatgtgaaatctaaaaccaggcacatgtgccccaggaatgcagtttacaatttttttctttgcaaaataaataatgttttaaaagttggtaggtgacttccatatctgaaaaaaaaatcagatgcacaccttggtaaagctggaacttctccttgcaccagttacctgtcataatttctctcatgaataaatgtagaactcattatattttattttcatccaagaggagactgattctttttccagaagtctctccagcctccagaaatctcttgttaaattattttttaattgacgaattatagttctgtgtatttctggtgtacatcatgatgttttgattcatggatccattgtggaatagctaaatcaagctaattaacatgcacaaccacacatacttattatttatatgtggtgaaaatggtgaaaattatagcaatttcaagaatagaatacattgttattaactatagtcaccacaatctgcaacagatctcttaaatttattcctctatgtgaggaataaatcaaatagaggatttattcacgtttggctccgtgaaatgttgtatcctttaacctacctgttctcgaccctcaccccagcgcctgatacccaccattctactgtctacttctgagtttgctattttagattccacacataagtgagatcatgcggtatttgtctctctgtgcttggcttatttcatttaatctaatacccttccagttcatctgtgttgtcgaaaatggtgggatttccttcttttgaatatttaatcatatgacagttttgcaacctatgcagactgcagggaaatgtatctatcaaaccagtgagtgggtgggtctgtgagtagttaggcataagtaaggtctgtaagcaattagcctcgatgaatcagaccccaatcccttaagcattttattttgtaaggctgaagtacagtgaatggacaccatatagtggcacccaggtatatgaaccctgcagaacaacagctgcctggaatctcagtcatacttcaccttgacacgggcaaaaaagaaaaatgaactccgtgtgcagttacctgctctgggtacctggaaatcataataaacagagatgttgtttatcttcagatctctctgtctctctctctgtctctctctctcctctttctgtctctacatctctttctatgcctatgcgtgtctctgtcacccctctctgtctgcttgtctctttctatctctctctctgtctctctctgtctccctctctttgtctgcctgtctctctatctctctctctgattgtctctctctgtctccctctctttgtctatctcattctatccatttctttctatctctttctgtctctctctctccctctctctgtccttctgtttccatctgtctctccatctctttctatgtctgtctctgtcttccccctttctctgtctgcttgtctctctatgtctctctgattgtctgtctctgtctctgtctctctctttgtctatctcactctatccatttctttctgtgtctttctctctttccttctctctccctctgtctgtatctttccatctctctctgtctctctcttcctctcttcttctctctctccatctctctctctgtatctctctctgtgtctctttctctcttttcatctctccctgtttgtctctctctgtttttctttctgtctccctccatctgtctctttttccacctctctttctgtttctctctgtctccctccctctgtttatctctctttccatttctttctgtctctctcttaatctctgcatgtctctttccatctctctctttctgtttctctctctctgtctttctctctctctcttgtcttctctctgtccctctctgtctttctctgtctccctctttctgtctttctctctccttttttctgtttgtctctctctttccatctctctctgtttctctctgtgtgtcttaccctttgtctctttctctgtctcttttcatctctctctttctgtttttctctttctatccttttctgttgctctctttctcgtttgtctctctctctctttcatcctttctttctgtctgtctctctctctgcctcgctttctgggtctctccctctctccctgtctgtctctcctctctctttccacctgtgcctttctgtttgtccttctctgtcttcctctcgctcttcctctctgcttcccccgccccccaccttttccttctctccaatacaccttccctctcccccttcaggacgcctcacatcgaccgccttgccagggaaggcgtgcgactgactcagcacatctctgccgcctccctctgcagcccaagccggtccgcgttcttgacgggaagataccccatccgatcaggtgcgcaaactggcgggctctgctgggctctgccctcatgttaggatgtgaggaaacaaaaatgtggcttgaccacgttaacaagtaaaaaagggctgggcacgatggctcacgcctgtaatcccagaacttcgggaggccaaggtgggaggattgcttgagcccaggagtttcaaaccagcctgggcaacagagcaagaccccatctccacaaaatttttttaaaataagttgagcatggtggcatgtgtctgtggtcccagctacttgggaggctgaagtgggaggatcgcctgagcccgggagtttgaggctgcagtgagtgtgatcacagcattgcactctagcctcgttgatagagcatgtgttagaaagaaaaaaaaagatacaaaggaaagaaaagaaaaagcacacatgtgcataggtgcactggcacacacagctagcactggtcacatcaaaatggctgcgcttctcagagatgcaagatcaccctgtgtgcttcagttgtcttttgatgcaatgagagttttttatctgaattccaagtcacaaggtgtacatttgagtttcccaggtcaacaaagataagctgtcttggaatgaagtaattaatacaacatgtgtttacacattcagtctgtcaccaaaaaatatctttttttttctttcaaaccacaaagtcatggccgggcatggtggctcatgcctgtaatcccagcactttgggaggccaaggcaggtggatcacttgaggtcaggagttcgagcccagcctggccaacacggtgaaagctcatctctactaaaaatacaaaaattagccggacatgggggcatgcacctgtagtcccagctactcaggaggctgaggcaggagaatcgcttgaacccgggaggcagaggttgcagtgagccaagattgtgccactgcattccagcctgggtgacagagcgagactctgtctcaaaacaaacaaacagcaacaacaaccaaaaacccacaaagtcataaaccaagaaatagctatcagatttttggacaactttcatcacagcattttacccatggagacagtagtattatccccttgctcaatttatatcaattttattttatttattattattattattattattattatttttgaaatggagtctcgctctgttacccaggctggagttcagtggtgcaatctcggctcattgcaacctctgcctcctgggttcaagtgattctactgcctcagcctcctgggtaactgggattacaggcacgtgccaccaggcctgtctaatttttgtatttttagtagagatggagtttcgccatgttggccaggctggtcttgaactcctgaccttaggtgatccacccacctcagcctcccagagtgcggggattataggtgtgagccaccgcacccggccatatatcaattttagataaaacaaaaatgaaatgagaagaacgaaattatcgtaagctctagttgtcatgttctcattactttttaatttattactattattttgagacaaggtcttgctctgttgaccgggatggagtgcagtggtatgatcacagctcactgcaacctcaaccttccaggctcaggtgatcctcccacctcagcttcctaagtaactggaaccacaagtgtgcaccactatgcctggctaattttttaactacttagggtattgctgtgttccccaggctggtctcgagctcctgaactcaagccatcttccctctttggcctccaaaagttctgggattacaggcatgagcaactgcacccaacctggtgactttttttgtttgtttggttttttgcttttgagatagggtctccctttgttgcccaggctgaagtgcagtgtcacaatctcagctcatcacagcctcaaactccagggctcaagcgattctccctcctcagcctcctgagtagctgagattacaggtacccgccaccatgcccagctaatttttgtatttttggtagagatggggtctcaccatgttaaccaggctggtcttgaattcctgagctcaagtgatcggcccacctcggcctcccaaagtgctgggattttaggcatgagccaccgtgcctggccaaaagtagctatttttaaatgtgctattcagtagcatgtagctctttcccaatattgtacaaccatcacctctatcgaattctagaacatttccatcacccacaaaggagatcttgtccccatgaagcaatcactccccattcccccttctcgcagcccccggtcaccaagaatccactttccgtctctacaaacatgtctgtcctggacatttcacataaaaggaatcatacagtatgtgacagtctgtgactggcgtctgtcaccaagcataatgttttatggtagcctgggtcagagtttcatttatttttatgttgaatactattccctcgcatggattcactacagtttctccatccattcatcaattgatgggcagtcaagatgtttctattgtttagtgattgtgaggaatacaactatgaacatacatgtacaagtttttctttgaataccagttttcaatccttttgggttcctcaggaacctcaattcttttgacattccccaggagtgaaattgttgggttgcatggttctattttttttttttttttttttcagatggagtttcactcttgttgcccaggctggagtgcaatggcgcaatctcggctcactgcaacctctgcccctgggttcaagcgattctcctgcctcagcctcctgagtagctgggattacaggcatgtaccaccacgcccagctgattttgtatttttagtagagacggggtttccccatattggtcaggctggtctcgaactcctgacttcaggtaatccccctgccttgtcctcccaaagtgctgggattacaggtgcgagtcaccacatccagtcatatagttctatttttaaaggtgagggaagtgggcttggggcatggtggctcacacctgtaatcccagcactttgggaagctgaggagggcagatcagttgaggccaggaattcaagaacagcctggccaacatggtgaaaccccatctctactaaaaatacaaaattagctgggcatggtggtacatacctgtaatcccagctactcgggaggctgagacaggagaattgcttgaactcaggaggcagaggttgcagtgagctgagatcatgccactgcactctagcctgggcagcagagtgagatttcatgtcaacaacaacaacaaaaaaaaaaaaaaaaaaaaaagagagagagagaaaaaaaaaaaagaaaaaaaaatggtgagggaagtagtcttcgcttgtgggtacagatgccgcagtttaatgccaaattatgtggattccagatagcggttcttggaggcagaataaaatcgcacgtatcaaccctactgccagtctgctgacactgactttggacgagaagaaagaaaaggtcttttttggctgagtgcagtggctcatgcctgtaatcccagcactttgggaggccaaggcgggcagatcatgaggtccggagatgcagaccatcctggccaacatgatgaaactccgtctgtactaaaaatacaaaaattagctgggtgtggtggcgtgcacccatagttccagctacttgggaggctgaggcaggagaatcacttgaacctgggaggtggaggttgcagtgagctgagatggcactgctgcactccagcctggtgacaaagcgagacttcatctcaaaaaaaaaaaaagatcttttcttagtctgtttgggctgctataacaaaaataccatagactgggaggcttatctacaacagacatttactgctcacagttctggaggctggaagtccaagatcaaggcatgccagattcagtgtctgctggggacctgcttcctggttcatacacggcgccctcttgctgtgtcctcacatggtggaaggggtgagggagctctctggggtcccttttgtaagggcactgattccattcttgaggctccaccctcctgacctcatcccctcctaaaagccctacctcctaaccattaccttgcagatgaggatttcaatgtgcaaattttgtagtgacaaaaatattccctctgtagcaacacctactcattgtacttttttccacactacatctaggtatggtttctagtggtaatagacgtgtcatccaaaatcttgcagtccccgcaggcctccctcttaatgagacaacacttgcagccttgctaaagaagcaaggatacagcacggggcttataggtaagacacaagaattggtgttagtcattgatcataaggtaatcatgtcctttgttctacccttgatttatgactttcttggaaacgctgtattttacaatgtcttatgtaaaggcgcagtggcccatgcctacaatcccagtactttgggaggccaaggtgggaggatcgctggaaaccaggagtttcagaccagcctgggcaacatagaaagaccccgtctctaaaaatataaaattagctaggcattgtggcatgtgcctatggtcccagctactccagaggctgaggtgggaggattacttgtggcaggacttcttttctttattattatttttaaaacagaggagtctcactgtgtcacccaggctggagcacagtggcacaatctcggctcactgcaacctccatctcctgggttcaagggattcttgtgcctcagcctctcaagtagctgggactacaggcgcgtgccaccacgactggctaatttttgtatttttagtagagatggggtttcatcatgttggccaggctggtcttgaactcctggcctccagtggtctgcctgccttggcctcccaaagtgctgggattatggatgtgagccaccacacctagtctgattcttcacacagctcagtgataggagatgttttaaaatgaatatattacaagaacataaaatttttctggctctgcctgcccgcatagtctctcaccgtgtatcctgtcatctgcctctttatttcactaaaaatggaccacacagattttcttctcactgccaaggatgatagaagtcctcagccacccagtagttggaactccaactactattcctgtttgggaagcctgggtttcagctggtgtgagaataacatgctgttttaaatcccttcaatttttgtaatacatctgctgttgataagagaaggcaatctccgtggggttgcaggacaggaagcctaagccagtagcactgcctctcctctacctatccccacaggcactcagaggttgatggaagcacaggcattcttgatggggccctcaccacatacaggaagctgttaatattcctagtagatacacattatcgcagcctctgagggtttgctgatcatccacatgctagcaggactcacaggcaccctttggtgatcattcaaggtgtggtacgttttactgaataagtcccttacttcgatcagttttaatgagagcccctaggatttgcagtcagccagctattcatccatccatgctggtccatcctccatgatttatctatagctatcatcggtcatctctctctctttctccatccatccatcaacccatatatctctatgcatctatccatccatctacctgtctatctatctacctgtttgtctattgatcaatccatcatctatcatttatctatcatctatgaatctatctacccatcatctatctatcatctataatctattcatccactcattcatctatcatgtatctatctatccatcatctatatctgtctatttatctagccattcattcatctatttagacatctctctatccattcacccatccacccatatatctctatccctgtctatttatctatctgtctactcacccatctatcctttcatccacctacatatacaaatatgctccatctgtcctccatcatttatttgtacgtgtcatatttattacatctatgtctctattgatatatacatacacatatgtatacatagatgcatactccataatttatttttatccatatcttacctgtctattcatccacccacaacacagatctattcatgcatctctctatctaatcacccactcatccaggtatccatctgtccacctacacacacatatatacatgctccatctatcctccatcatttatttgaatctgtcctatcctatcttatctatttatctatctatccatctatccaactactcactctatctctatcatctatttatctatctatccattcatctatcaatccatctatccatcatatctatctatctatctattcatctatcctatctatctatccacccatagatctccatccacctatctactcacctactcagccacccacctatctatccatgcatccacttacacatacatacatgccccatctatccatccatcatttatttgtatctatcatatttatcacatctatctctctattgatatatacatacacatatgtatacatagatgtatacaccataatttatttttatctatcatatcccatctgtctattcatccacccacaacacagatctatttgtgcatctatctaattagctagtcatctatcgatccatccatccacctacacacacatctatacatgctccatctatcctccgtcatttatttgaatctgtcctatcctctcctctcctctatcctatctatctatctatctatctatctatctatctatctatctatctatccatccatccatccatccaaccactcactctatctctatcatctatctgcctatctttctgtctacatattatctatcatctatctttctttctatcatctctatttatctagctagctatatctacatatgcatctgttcatctgtctatctacctatctttctgtctacatattatctatctatatatctacctacctatcatctctagctagctagctagctctatctatgtatacatctattcttccatcaactataacctgccttgtctctgtgatgtatctattcttccatcatctgtaacctgccttgtctctgcggtgtatctattcttccatcatctgtaacctgccttgcctctgtgatgtctctatctttgtggctatgactttgtcttctcagtgaatgagaaaatttctagttcacgtcattgacagaaactcacaattctatttttctcccttattgtttatcctatcctgttgctcacaaccggatctgaatacaaacttcctctgtaaactaaagaagaacaaaaaaaatgtggctaagtggcactcggattttttagaggaaggagaatatctctgctactttatttttgtgtattagctgattgtttcacgtgaagaatgctcacatggtttttgcaatgtgctggcatatgttgacatattgatgcgtagatgtgtttgtgtgtttggttttaggcaaatggcaccaaggcttgaactgcgactcccgaagtgaccagtgccaccatccatataattatgggtttgactactactatggcatgccgttcactctcgttgacagctgctggccggacccctctcgtaacacggaattagcctttgagagtcagctctggctctgtgtgcagctagttgccattgccatcctcaccctaacctttgggaagctgagcggctgggtctctgttccctggctcctgatcttctccatgattctgtttattttcctcttgggctatgcttggttctccagccacacgtcccctttatactgggactgcctcctcatgcgggggcacgagatcacggagcagcccatgaaggctgaacgagctggatccattatggtgaaggaagcgatttcctttttagaaaggtaagcggaataattacaaattcatgtaataatgataatgatctcttttttaaaaggacctagatagatctgtagggtgattgtagtttataataatctattgtacacttctaaatagctaaaagagaataagtcaaatggctctagaataaagaaaagacaaatatttaaggtgatggacaccccaattacactgatttgaaaaaataaatcatttgtaataattctttacaaattatatgaatgtattaaattgtaacgtgtactcttaaactatgcacatctataatgcattaataaaaataataggggatgatggtattaaaaatattgagttaggaaatggaatattgctaaatggtgtaatagggttagataaaaatatgaagtgtattgaagaccagttggactcttcagttggtacctaaagcggtggtaccttgtttgggctcctgttattaaaatcatggcctctctattggctctgaaatttatatgttgtcagaccatggacgcagaccctagtaacttaaactcacaaattgtttacgttaatttacaatgcatcttgtcatcatgttaacttacaacagggaatatgtacatatacaatatgtatatactatactatatatgtatatatataatatattttataatattttttgtctggttccctgatacatatagataaatatatatatatatctggaaatcagatgaaaaaagtaagttttccattgcattatgttcctgttgttaaaaaacaaaaaaaaagctacttggggaaattaaaatcagaaggcttctctttgagcatgtgatacgtaagggctatttcatgaattggatgaggtaaatggtcaaaggtgattgttataaaaactttatgcatccagaacacaatgactggaaattttcaagggtatctatcctcttgttgttggaccttctttctttaaaaaaagcctgtaaacacattttttcatttgctttttccatattgattgaggcttaatctttaccaatagccattctaggatctggattttcaggatgtaaggtgtcttgtgtactctggtacatagctttgtcctcactctgtagcccaagtgaaggtgataaatatgtagtttggggctggcagcggtggctcagcactctgggaggccgaggagggtggatcatctgagaccagcctgaccaacatagtgaaacgccatctctactaaaaatacatattagctgggaggctgaggcaggagaatcgcttgaatccgggtggcggaggttgcagtgagctgagatcacgccattgcactccagcctgagcaacagagggagactctgtcttaaaaaaaaaaatgttgtctgggagtaataaagccatacttgctctgtagatgcaactgaatgcttggtgtcacttagagcaaatctttctgttccctggtacctttccaaatgtgcagagttctatgaatttttacagacagagcatcaatatgtgcaaattagcaccaaccactctgaaagtatatgataagcaatcctattctcttctgtctgccagttcgtcttcaaacattcccacacagttctccttaggaatttacatgagtacttgaagaacagatcctatggttgagatgtacattgttcaccaaaacctctgtcgagtttcaaaagttccatatgatccacaataacacaatattgaatggaaaaaacaatggtgaagaggaaatataaagacttggacgttgtgacaataagctcatggcttaggttcatgaatgctcaaaactatttttatctggattctcagtgtatgactctcctacagttgctataacaaatcactatagggctgagtccaatggctcatgcctgtaattccagcactttgggaggctgaggtaagcgatcacttaagttctggagattgagaccagccaaagcaacatatgggagccatatttctacaaaaaatacaaaaaaattagttggatatgatggcatgcatcagtagtcacagctactcaggaggctgaggtgggaggattagttgagcctgggaggttgaggctgcagtgagccgtgattgcaccactgcactccagtctgggcaacagagtgaggccctgtcttaaaaaataaaaaaaattaccacaaatgtagtggcctaatgcaacacaaagttattattctgctgttcttgaggtaagaaatccaaaattaaacttgtgggctaaaatcaagatgttggtggggctagttacttctaggggttctaggggagaatctgttttctctttcttctagtttcttgaagctgcctgcattctttagcttgtagggttttgttttctgactcagacccttctgcatctctcttataaaaggacatttctgattccactggacctacccagataacccaggataatcactttgtctcatgatccttaattcattcccatctgcaaaaaccttttaccatgtaatatcacatgttcacaggttttgagaatgaggatgtggatatctttggaatggggcattattcagctgatcactttgaccacgactctttattttggcagcttagtttgggatgcaaactatttaattttaaatatttaatgttcagagctgtgcttcctctgtaggctctaggggaggattcttcctgcccttccccactcctggtggcttcaggcatccctgggcttgtagccgcatcactccagtctctgcttcatctgcatatggccttcccctctgtgtttgtgtctcatcttctgtctcttataacgacaatagtcattggatttagtgcccatcctaattccaggatgagctcatcttcagatccttaattaattacctctgcaaaggtcttgatatccaaataaggtctcattccaggttctgggctttaaaatatatggacttatatttctgggggctactattcaaactactacaattgtatccagtttcttctggaggctctaggggaggatctcttctgcctcctctagctcctggtggctccagatgccccttggctggtggttgcattactccatttccacatggcctcttcttctgtgcttgtgtctcctcttctcctatagggacaacattattggattggggactcatcctaatccagaatgatcacatcttaagtaattaaatctccagaggccccatttccaaataaggtcccattctgaggtttcaagtgaacgtgaattttgaggggtcactgttcaagacaccatgacataagtcttgtttttaaaattcattttttttatttctttatattttgatatctcaccagagcagaaatttcccaacgaatggcatttgtgctgtgtgttttcctgggtagctgaggacttatcattcatgcagatggattatcaaaattaacagcgggtcagcctagttccctgtatcctcatgtgagaacctacagggtgcaaatggcttgccaaggcattcctgtttgtactggcttatggctcgtgaaactcttgatctggctaagaaatgacttccataccactgtctcttgatgtatctcagggtgtgaccctagtttgaggcttcacgagcagtgagaacatccaccaaacagagctggatttgacttttcgcactcgcatgatatgggaggtccgtgttggcttgcagtatattctacagctgtcctggcatctgagaatcaaaggaactgtgatggtgtcacaggactaccaggttcatatgcctgctgcacagtaacataccaatacactgaggcagcagggtttatggcagagaaaggtttaataattgcagggcaattagtgcgaacatgagaggagacctcaaatccatctttttttttttttttgagactgagtatcactctgttgcccaggctggagcgcagtggtgcaatctcagctcactgcaacttctgcctcctgggttcagcgattctcccacctcagcttccccagtagctgggattacaggagcccatcatcatatctggctaatttttgtatttttagtagagataagatttcaccctgttggccaggctggtctcaaactcctaacctcaggtgatccgccatcttcagcctcccaaagtggtgtgattataggcgtgagccactgtgcctgtcctcaaacccatccttccaaggagttctgggctggattttttaggggaatcatggagggtcttggggtcactgatgggttggggtaagagggaatggaatcatcagaatatggaaatggtatgctttggtaagtcagcttctcatagggtccttcagagaagcagacatcagcagtttccctggtatgcacaacctgaaagattattgcaaatggaaaacttaacatttcatgatgttatgttatcatcctgtaacaggatctgtgcgattctagaacaaataggtaccaaacaagtaggaatacatagatgagagggcaagctgacctcaggatcaaagctgagtatgctgcaagcttagttcattttgtttctcccgctcccttcctctctgattgattttatgaagtttatagagatggtttcagtagcattaccaaaggggttagggagcagttgaggtgctgcaggatcatggagtccattctatgcaggatggggcccttgggtggacccactctatcttctgcagcttggagaagaaggaagcaggtcatgtctatgagaagccaaaacaatagttttcacattcatagatattgaaaactcacaagtagtttcattgatgtcttctcaggcacagtaaggaaactttccttctctttttctcctttcttcacgtgcacacacctctccccaccacggacgatttcactggcaccagcaagcatggcttgtatggggataatgtggaagagatggactccatggtgggtaagtcacaggacttaagtggacagaaactaacgtgttctgataggacaggacacctgaaaactgctcttggtcaacctgtagagtgaagagaattatgcctatgggacagagtggtctgagacattaatgaggtaatagttgctagcaattgagaaagtcagcaaaaaaactatatgcatttcctctcctttctttgcatgctgtccacttatcaacttgggtctttgtctacttgactgcgtctccagtgctggccagataacaaatcaaatcttcttttcaaaaatttcaactcttgttttagattcagggagtacatgtgcaggttttttacctgggtgtattacgtgatgctgaggtttaggatatgatcaaacccttcacccggacactaagcatagcacgcaatagttagttttcaacccttcccccactccttccttcacccctctagtagtccccagtatctattgtactgatctgtgtgtccacatatacttgatgttatgctcccacttattttgtttcatttttaaaaataaattttattgtgtattttaagattcacaacgtgacgttaaaagatacgtatagatagtaaaatgattactatagtgaagcaaatagtaatcattaagtaacataatatagtaatattaagtaatagtaatatagtaagcaaatgtatctatcatctcacactgttacttttttgtgacaagatcagctaaaatctatttaacaaaagtccagctgagcacagtggcttccatctgtaatcctggcactttgggaggctgaggcaggaggatcacttgagcctaggagtttgagaccagcctggacaacatagtgagaccctgtctctacaaaaatacaaaaattagctgagtgtggtggcatgtgcctgtagtcccagctacttaggagactgaagcgggaggattgcttgagcccataaattgaggctgtagtgagccatgattgcaccactgcactccatgcactccagtctgggtgacagtagctcccacttataagtgagaacatgcagtatttggttttctatgtctgcattaatttgcataggataatgtccaccaccggcatctatgttgctgcaaaggacatgatcttgttcttttttatggctgtgtaatattccatggtgtatacgtaccacattttctttatccaatccaccattgatgggtgcctaggttgatttatgtctttgctcttgtgaatagtgctgtgatgaacatatgagtgcacatgtctttttttttttttgagacaagatctcactctgtcactcaggcagaagtgcaatgacatgatctcagctcactgaaatctctgcctcctgagctaatgcgattctcctgcctcagcctcctgagtagctggggctatctataggcacatgctactgcgcccggctaatttttgtattttttgtagaggcaaggtttttccatgttacccaggctgctcttgaactcccaagctcaggtaatatgcctgcctcagcctctcaaagtgctgggatgacaggcatgagtcactgcacccagcccacatatctttttgatagaaagagaaatcatattttcagactctttagtgacatagccaaactttatttcaggtctgttgagcaccaatatcttagttggggattgggaattaactggtaagtcagaatccagtaccctcatgaactcatcctgtagagagaacaatgtaaatgggacgtcctaggacttacatggtaaatgtattgattagcaaaatggctttaattttccaacattaatgaaagaaaaccatgagtgaaactcacatatatgcaggacacaaatttaaagtataatattttccagacacagatattgtgaaatatatgtcactaaatagaaagacgctttggaaaattaagcctggaaaaagcaaagccaatttgcatagtcttaaacacataaaaaatatgaagtatttaaaaatataaataatattcaaaccaaatacatgaacatgaatagatgtttatgtaggtataagtgtgtgtgtctgtgtctgtagtgtttgtgtacatatgtatagaaacagatgattgacagagatagatgatggatagatagatgataggtaaatagatgatagatggatagatagatgatggactgatagttgatagatgataggtagatagatagatgatggatgatagatagatgataaatagacgatagatgatcgatagaaagatagatgattgagagatagatacatagataaacagatgatagatgacagagagacagatgatagattgatagattatagatggatacatgaatagaaagatgaataaacagatatatagatgatagatggatagatatatagataagtacatgatacatatgacagatgatagatgacagataagataggtgattgatagataagatagatagatgataggatagattgacagatacgtagatgataggtaggtagatagatgatagatagatacatacatacatacatacatacatacatacatagatacatagatagatagatagctatgcatacccctcttactttctgcctccaccagcactagtccttaaagtttagattcttaatattgcactcaatctcaaaaatcgtggcgatcctatttttgatttgatctttgaaaatcaatgaaataggtcattcaaactcaggctgtgataagtaaaagacattactatttgctttaaaaatttaaattaacaaagctcccaaagtatctaatttaataaacctgatgatgtgtcatagtgttcaaacaaggcactttgggtatgactttaatttcgatgggatttttctggtgacattcagataatattacgcaaacggatgggtgtgttgaatctggttggacaagctgtgatatctgaaaattatattttgaaaaagcgcaactgagatgtacatgatactggtgcccagaggttttgaatgttttgtccacacagccagaatcaagcctttaggaagaataaacatctgctttaatatataattttagcaattctcaagcaaacatatatttaccctgaaattatttatcccagaagctgtaacaataccccaagtcctaagaattgttgcttttcttattagaaaagttgatttgtggccattcctggtagagatatcaccttcctgccttttataattatcataggtggccgggcgcggtggctcacgcctgtaatcccagcactttgggaggccaaggcgggtggataacgagttcaggcaatcaaaaccatcctggttaacactgtgaaaccccgtctctactaaatatacaaacacatccgtggtggcgggcgtctgtagtcccagctactcgggaggctgaggcaggagaatggcgtgaacctgggaggcagagcttgcagtggccgagatcgcgccactgcactccagcctgggcaacggagcgagactccgtctcaaaagaaaaaaaaattatcatgggtttcccacagcagtgccctgaaataatggagtctactgatagaataaacatttattttcattttttaataatttccaccttttattttagattcagggagtacgcatgcaggtttgttacctgggtatattgcatgatgccaagatttgaagtacaatagctcctgtcacccagggagcgagcatggcaaccaatagatagattttcagcccttgtcccccaccttccttctccccttttggagtccccagtgtctattgttcccatctttatgtccatgagtacccaatgtttaactcccacttatgagaacatgtggtagttggttttctttttctgtgttaatttgcttaggacaatagcctccagctgtatccatgttactgcaaaggatgtgattttgttcttttttatggctgtgtagtattccatggtgcatctgtaccacattttctttatccatgtagattggttctatgtctttgctattgtgaatagtatgataatcatgcaagtgcctgtgtctatttggtagaatgatttatttccctttgggtagacacccagtaatggcattgctgggtcagagggtagttctgttttaagttatctgagaaatctccaaagtgctttccacagtggctgagccaatttatattccaaacaatagtatataagtgttgcatcttctctgcagcctcaccagcatctgttcctcttttatttttttgacttattgggttcgtgcaaaagtaactgaggtctttgtcattgaaagtaatgatagattgatagattatagatggatacattgaaagtaatgacaaagacctcaattacttttgcaccaacctaatagtagcctttccagctggtataataaacacttttaaaagtgatacttcctatgggccatgcactgttaccagtgtattctggatgaatccccacaacatccccggagacgagtatcatcttcatcatcatgtttatctccattcacagagaaggaggcaaaagtatgtggcctttggtggctgctcctggagataagccagggttgggctccaaagctcttactccctagctcagctacctcttatgcagggcaaagaagtcatgttgaatgatgaggaaggagagctacattcttctctgaagtctccagtagccccattagactcctacagaccgtcatttcacaggagtcagaaaaactccaaaaacttcccccaacctggcttcctgcttccttcgagcccagcgagaggctttcattggagataccacccttgccccacccaggggaaaatctctgatgccgaatgagtcatgcatttctgcatgggcaagagtccatcagcttggatctgaagagcaggtttctcaagaatgcagataagaaagtaaaatgtgcaaaaatgagtaggagaaatggccttatcagcaggagatgagacaaggatgagggtcttggctgagcctgttgtacagacagttgtgagtggtggaatcccagggcaggcctgtctgtggacagcaacacagcttgggcagcaaccctggacagggcagaactgcaaaggaggctgtaaacatgtatttctatgtcatatatatatataatttatatgaaatatttgagacacatatataaaatataacttaaccctttataatatatatatttatattatttgttatacatattagtattaataatttgaaagttatcatatatatgaatatatattatgtatttctgtagcatataatttctatatttatttatttatttcagttgatgttagaaaggtacgaatcatttccatggttgtaatccctgctactttggaggctgatgtggcaggatcatttaagcccaggagtttgaggctgcagtgagccacgattgcaccactgcactctagcctgggtgacagagcaaaatcctgtctcagaaataatcatttccatggccactatgtaatctctctaaattttaagatataaatagaataattgaatataattgaataatattaagaatacaaacaactcaaagtaatttaatattatttgtaaagaacagaattgcctatgttaaaaaccctagagtttaataaaacacatatcagcacatagatgacatatgatattataataaaattatattacatataatttatattatagttatattacttatatacatcattatattattatgttcatatataatataaacatatcattaatatacaattattagattttaatatattatatggttctatcttatatatatcacaattatgctatgcatattatatattatgtacatgtatacatcagtaccatagaggttttattaaactttctggggtttccaacataggtatgttcactacatttaatgttaagtttgtattttatgtgttaaagtatgtatttaactttaatgttaattgcattagtcaggttatgtacaaaaataagttacataatgacaaaaatattcttatttttctggtattaatgaaatagtttcaatttttacttttaagcataatgttgactgacgctttgaatattttaattcttaatattttgagagacttataagatgtgcattaattagatagtagccaggaaaattcttgcatgctttctagtattacctaactatatatatgtatatgtagttaactatatacatgttatatatcatgctgttgatattatctatattttatatatatctaacaatataacttataaaacatttttattatatacataaatacatatatactacatgttatgtagtatatgtgttctaaagattgatatataatataataaatacatttgtttttgtatagtatatgttagtatagtattagtccaatagtataattagttacatttatatattagctatacataaatatattagctatatataaaaatatattagttatacatatatatgaagtctacagtgtttctctgttgggtatatgcaccaaaattaagaccttttctttttgttaaaaataatgcatttcaagatacaatggatcaccagctactattcattatagctccaatgtcaataactaaaatatttagaaataatttttcaagcagtaaatgagtatctcgaagctgactcatgaaagaaaacttgaatacatggaaaggaagagtggattgtatacatgtattagttatttcaaagttaatattgaaggctaaggtagctctgattagagcattaattactgttctctggggagtggtcattatagaggtgatgatgaaatacacactgaataaactgataggaaataaactttccagaaacatctgatgagaaagtctttggtagaaaacatcaagaaacacttctgtgatcataagaaatgctatcaaaaagataactacaaaaattaaaacgcagaaatacaagatttgacttttagatcaatgaagcagaaaataatagccttagagcaggtctgggaaagagaaggacattacattcggtacaataaagtttttaaatcaaggtggcaggggtgaaaggtgttggggaaagtttgtgttatgagttgacttacatccccccaaaaaggtatgttcaagtcataatccaaggtatgtgagaatgggatcttatttggaaatagggtcgttgcaggtggaatcaagttaagatgaggtcattgggggtgggtcctaatccgatatggtgaattaggatgaggctgctacatgccaaggaaggctaaggactgatgccaactgtctgaagtgaggaagaggtaaggaaaggtcctcccctagaaacttcagagagagagagtgactctgccaacacattgattttgaacatctggcccccagaactgtgaaagaataaatgtttgttgttttaagccacctcatttgtactaatttgtttcagcagcccaaggaaattcacagagttagtttaggaaaaaccattaccaattcaattagcatgcttttccatacacattaaggacattgagtgaaacaaaacaaaaattggaagaagctatagttaaacagtaaatttacatctggatgaggtatagtgttagtaatagcaaaaggttatctgataagtagcatgactaaaggccctatgcaaactgaggaaatattagcaacaacatgacattgttttaactgcttgacaaataaagagttcttataaatcaataatggaaacacataattccttccaaaaatatcagcaaaattttaaacatcttttacagattaaaagtacaaatattagagtggacacaggaggaaactcatgatcattcataatgtaccataatcacctatcaaacattagatactgatgaggaattgagaaaatgaactattattaatgccaaaagttgttcattatggcattttaaattatggcaaagtatgaaaattaaccagaatagtgaacaacagtaaaatggttaaataatttatactacttaaaaataaagtatcataaattgtttaggccaggtgtggtggctcacgcctgtaatcccagcactttgggatgccgaggcaggcagatcacctgaggtcgggagttcgagaccagcctgaccaacatggagaaatcctgtctctactaaaaatacaaaattagctgggtgtggtggcgcatgcctgcagctgaggcaggagaaatgcttgaacctgcgaagcggaggttgcagtgagctgagatcgtgccattgcactccagcctgggtaacaaatgcaaaactccatctcaaaataaaatatatatatatacacatacacacacaacacacacacacacacacacacacacacacacacacacacaatggacacttttccagccattaaattgtacatataattttttaaatttatttttttaattgagacagggtctcactgtgttgacaagggtggtctcaaatacctgagctcaagggatccgccttccttgccctcccaaattgctgggattacaggtgtgagccatgatgcccagtcttgaataattttttaacacgaagattttccgagaaataatattggatgaagaaagcaagttgaaaaccgttcatacaatatcaacccaaatagagagagagagatgcatctacaagagtatgtgatatggtttggctgtgtccccacccaaatctcatcttgaattgtagctcccataattcccacatgttgtgggggggacctggtgggagataattgaatcatggaggcagtttcccccatagtgttctcatggtagtgaataagtctcatgagatctgatggttttataaggggaaactccttttgcttggctctcattctctcatgtctgccaccgtgtaagatgtgcctttcacctcccatcgtgattgtgtgtcctctccagccacgtagaactgtgattccattaaacctctttttctttataagttaccccgtctcaggtatgtctttattagcatcgtgaaaacagactaatacagtatgtaacaattttttttaaatagtcaaatggcaatggggcaggaaattggtggtctttattttcctccttataattttctttatttttttgtatttcccaagctattttgtatttttataatcagaaaaatattagctttgttgttttttcttgctacttttcactatttactgaaaagtagcaagaagagtaaaaacaactcccgtgtccccttcacccatctttcccaattgttagcaatttatcaaatatatcttctctcgcccctcttcctttctcctgatcatcctctttcttcctctctctctctttctctcttccacctccacatgtttcttatgcttctgaatatttgggaataagatgcagatatgatgttcattaaatttagaaactttagtgtgtattttctaaaacaaagacattctcctacatcatcactgcgaatcatcaaaatcgggaaattaacatgggtggattcttaggatttaattcacaaatcccagccaaacttctccagctgtcctcaaaagaaaatttatacacagcaagcaaaaccaatggacaaacaaaaaccaaccaacaaaacccctacttcctctaccctctttctgttctggtccatggattttcttgttgtatctgtttaaactcctctgatctggacaaagactgagcaatctttattctttcttgaattcaaagaccttgacattttctgagaataaagaccgggtatcatctagaatgtcccttgaattgggttggtttgacatttccttcaatggaagtggaagtgatggtgtgttctcaatccagtagacaagtaagtgaattagccccaacaatggttataaaattcttcatctcttgattaaatggtgtcttccagttttctccactgtaaagttacttattttgtcattacttaataatttgagatttttaactattttatgggagatactttgagatgaagccaatattttggttcttatcaaacatttaatgccaggtttagcatccattgatcattttctcttggatgaattttcagtgcgatttttgctaaaagtattgtggtaaatttttaaaagtattttaaaatataaattctttcttaacttgcccttacttgtgtgccttggctctagaagaaaatttctaaggtatagtactttaggaatgttaatgtaatgttatctgagataaccaacagtagaacacatagaattagacacgtttgagactaataagctttttcataattatgcataatacagactgggtttgggaactctaggaatttagctattttcctataaaaatgattggaaatgtggtttattttgaatacattcttcctcttttaacttgcccattgagtctaattctcccaacctagtcatcctattctctatttaaaatatcaaataagaagggaagggaaaatggttaaagaattacttatctaaatcatctgcaagaatatatcaaataaattatgtgaacccaacagtgggagtgtcttattcttgcctctgtctcctcaaattctgtaacaatgtctgccttctgtgagcagagaggttgcataaaccgtgactgccattctgtgcaacatcagtcagaataccactacagtccttcgtttcatatccagtgggaaaaactgtatttctctgtttaatgttttcattctgcatgaaggaaattatcaaggagaatttgtccttttaaatgataccagtagcaactgatgttcatttgtattgccataatatttttttcttaaagcaggtcatcttttatttcttaaaaattttggactctcagttttttgtttttttgttttttgtttttttgagatgagtctcactctgtcacccaggttggagtgcagtggcacgatctgagctctctgcaacctctgcctcccgggtgtaagcaattctctgcctcagccacctgagtagctgggattacaggcctgtgccaccatgcctggctaatttttgtgtttttagtagagacagggtttcatgatcttggccaggctgatcttgaactcctgaccttgtgatccacccacttcagcctcccaaagtgctgggattacaggcatgagccaccgcgcccggcctgactctcagtttttttctctttcaatggtttgtcaatttaaactgttaatgcacatttcttttcttttgtggcttttgacatagggtcacaccatccttgttttcctttagatagctcatgcccatttgacttaggggtgaaatacctcataatgtcattatttttacttgtctcttgtatattattttaggcaagattcttgatgctatcgatgattttggcctaaggaacaacacccttgtctactttacatcagatcacggagggcatttggaagctaggcgagggcatgcccaacttggtggatggaatggaatatacaaaggtgaggagaggaactcatgcaagtgatctggtggtgaataagcttttttgtggttcttataattaaagcccatgacacaaaggaatgaggcctgaaaaactgaacaagtttgtttaatttgactcttagtaaaatgaagtattggaccaaggtcaagaaaattggtcttacatttgttaacatttctgtggaaggaagccatttatgtagagggagcatctagaaatatgcctttctgacaaccctatcaaattatgaggagttagcacaagcagatgcttttatggggtctttaaagaaatatctactcattcattccatttatgagattattgagagattaaatgagggggagtgtgattcctagagaacagagatcagaaaccagggatccttcatcattaagaagtcttcgacactctcttccaaggatatagtacagcatagaaagtagacaagcctgtcttgggtttcatgattaaattcacatatactgattttatgtcctgctgtaacatttagtccacaaaataggtccataagctactacattggccagtctataatgtgtaacctgatgttagaatattatcttcatttgtgaaatgaggattaaaaaaagaaaaagaaaaaagataattatctggaaaatgtcgagtatattttatcatatgtcttgagagagattttaaagtattttctagaggaaaatacgttgttattcatgcaactacagattccacagtcttggattcggtaggaaattataatttctgtatgaatgaggtaaaggctctgcctccatcttgcagagggtatgaatgtgtactctttagagcgtgtagcactaaagtgtgcacttaggacccaaaacaaatccttagtggaaattgttattatagacattctattttaaaaaaaaaattcagtagttttggggttacaggtggtttttggttacacagataagttctttagtggtgatttctgagattttagtgcaccgtcatctgagcatgtactctgttcccaatatgtagtatttttttcctcagcctactcccaatcattccccaaagtcaccagagcccattatatgattcttatgcctttgcattcttgtagcttaactcccacttataagtgaaaacaggctgtttggttttccattcctgagttacttcacttagaataatggcctccagctccatccaagttactgcaaaagatattatttcacttatttttatggctgagtagaattccatggtgtatgtacaccacgttttctttatccacctgttggttgatgggtacttaggcttgttccatatctttgcaattgagaattgcactgctataagcatgcgtgcgcatgttagacattgtatgtttgcttatgggaactgtttttaaaaatttttggctcatgcctgtaatcccagcactttgggaggctgaggcaggcggatcacaaggtcaagagatcgagaccatctggccaacatggtgaaactccatctctactaaaaatacaaaaattagctgggcatagtggcggacacctgtagtcccagctactcaggaggctgaggcaggagaatggcgtgaacccaggaggcggaggttgcagtgagccgcgatagcaccactgcactccagcctggcaacagagcgagactccatctcaaaaaaaaaaaaattaacttttcagcatgccatgacataatgtagattttactctgattaacttaataaaataagagtcaattaacacaggacagtggccacttctcctaatttccccctggaaatcctggtgtatgcctgtcatcttggtataattaagacaactttctgcttttattctcaataataccttgatgtggacaataagttaccatatgtccatagtattccatttgttttcaaggtgcatgaatcaacagtgagcaaaataggcagaaatcctcgtcttcatggagtttatatcctactggagggaggcacagcagaaaataaaataaaataaataaataatatggcatattagaaggtggctgtaaataagaaaaaacacgagagtaaagaattctggggtgggactgccatttcaaataaaatgttcaggcacgcctcattgaggttactgtgagttccataaaattgggggctggatacaagaaaaatattaattaaaaaaaatataggaagttactttgagcaaaggtatgagggaggttggaaatgaagtaggtgtatatttgagataagaacactttaagtagagaaaatagccatgcaaatagaatgtaaatgtccaatattacatatgcttagttatttaatcaaaaacctaccagcagcacaggaaaatataattctgtagacgtgcactacttaccccactaggactctacatagagtagacactatacaaatgtgatctcttttgatactagcttaccttttaaatacattcaatacagtgactattttaactaggcacaataattgaacttaattgcattgtcttataggtggaaaaggcatggggggctgggaaggtggaatccgcgtcccaggaattgtccgatggcctggaaaggtaccagctggacggttgattaaggaacctacaagtttaatggatattttaccaactgtcgcatcagtgtcaggaggaagtctccctcaggacaggtgatgtcatataaactgttaacaagagcttattttcacccttcttccttctcagaagattcagaacaaggagactgactctatcctggcagacccactttttccctagtatctacacagttttaccttcctatatgactgtgtctattcagcatttttcagaagagaccagtcttttctttttttctattgaggtaaaatatacatatataatttaccatctttaccatttttcagtatacagttcagtggtaataaacatacttattttctttttttccccttcattttcctctcatctctcccctctggtcatcactattctactttctatcttcctaagattcactattatttatttttagctcccacactgagtgagaagatgtgatgtttgcctttctctgggcttggcttatttcacttaacataatggccaccagttccattcatgttgctgcaaatgacaggaattccttcttttttagggatgaatagtattcccttgtgcatatataacactttttaaaaagttaatttgtctgccgataggtggttaggttgattctatagcttggctattgtgaagagtgctgcgataaacatggaaatgcagctattcctttgatctgttgatttcttttcttttgggtgtataccaagtagttggatttctggatcacatggtagctctatttttggttttctgaggaacacctcaccacgcaaaacagataaagcaaattacaaccgaaaatagagatggacagatttataaccagaggtcctgaacaagtatcagagaccagtcttagatactaatctaatgcggaccatcttagatactttaacattttcaattgagagaaagatggagacaggaagctttggagatgaagacatggtaggtaaaactcactcatctctataagaaagggaaaaataatcctagtctctggtgtgaaagatctggaagactgagaagaaggtaagatatttgaggatgctttgaactctatcatgaatactttgaatttcttcaagaggagatcgttcatactacattgctccattccctggcagcaaccagcctaggtaggtttgctgctgattgacagttcattgatcacagctctgcaagggaatccagatgggttagaaccgcagctatgtctctcctccaagcccacagagttcttgtaatatttctttcttcacgtaacaaagctaatctatttctgaagaaataggttctgttggcactaatacagaaaagaaaaatattttagaagtcatggttaacttactgaaaaacaaactatcaagaactaatcaagacacatccccaagtttgcctttctaatatttaaaaatttatgtttgatgctagcagatatctctatcaacacactaaggctggaatttattttataattttcgggactgaactttagatgaagacatttttattttctgcctggaaagaagttagtcattgatgatgctaacacaggaaagaaaaaatattttattctttatttttatttattttatttttgagacagagtttcgttctgttgcccaggctggagtgcagtggcacgatctcagctcactgcaacctctgcctcccgggttcaagtaattctcctgcctcagcctctccagtagctgggactacaggcaccggccaccacgcctgggtaatttttgtatgtcttgtagagatgggttttcgccatgttggccaggctggtcttgaactcctgacctcaagtgatcctccctcctcaacctcccaaagtgttgggatttacaggtgtgagccatcatgaccagcccagaaaaaatatttaaaaaaccactgtgaagttattgcaaaaagaacctatcaaaaaactatggagaagcccagctttcctgttctaccatttagaaatagttgttttaagaagtctgtcgttccacatagcccaacagcctgttagggagacggcaaatgtccaggcacaatattgttacgttgcatgagggtggaaggcaactgctgccaagttccagccgttgtcctcacgttaaaaagaagaacgagttgattggagtcactcatcactccagtgcattcggcgccatgagattacatgctcatttggtcaggggtttagggttatgagtttggtgtccttgataagatgtatagtacagctgtcctttcctgcctgcaaccatgactccactagccataggctaagtcttcagaggacgcaccatctttgtagttcaacgggaagtggaagaatatcgcgaagatgactaaggcactgtggtgggagacctaacctcagcttcacgtacaggtcggcgtgccgggtactactcatcaggttgattttttggttattcctatgcttggttctcccaagcctctttatttgaattcatgacttctttggcatgtgcattgaccagttaaatatgtccttgctaatagagaatagctgtactacgtagaagggaacaaacagcaaattcacagtatcaggctcactgtctatgacaccagcatcatgagggcctgtggatacctctctcctgtctgcttcaatccccaacacaatgaaatcaacaagaagaactcaaaagcggctctcacctgtacagaaatgaaggctgctaatactgtaaaagccaaatagttatttatttttagaattaacacaatttgtttcaccacctcatcacacaaaacagataaagcaaattacaaccaaaaatagagatggacagatttataaccagagatcctgaacaagagtgtagaatagacaaaaaagaaaagtaaagataaaacagaggacaccattaatgtgtagaaacacgggaatctgaggatgcaatggtttatcaaagtgttgggaaaaaatgacttatcaggtatgtggtttaccaatacagctgtcccttggtatccatggggggttggtctcaagacctcacgtggataccaaaatacccagatgctcccgtccctgatgtaaaatactgtagtatttgcatattacctacacacatccttttgtatatattaaatcatctctagattactcataatacctaatacaatgtatgtaaatgccacataaaatagttgttatattgtaccctttagggaataatgacgagaaaaagtctgtacatattcagtacaaacaagaccgtccctaaaaggaccataagcctaaatgtaaacccaaaattataacacttctaaataaaacataggagaaaatcattgtaatattcagataagaaaataatttttttagatttatcaaaaaagttgcaagctataaaagaaaaaagtgatagattagtcattatcaaaatttaaaatttctgcttttcaaatgtcaatatcaagtaaataaacatgtgacctcagtccattagtggagaaaaaaagaaaagaaagaaaaaattaaaatattaaatatgaacttaaaagaaagtttaaaagaaaagaaaaagacaagccgtggagtagaagcaaatagtcatccctctgaactcagaggttctgcatctgcgaattcaatcaactgcagatcaaaagtatttcataagattttctagaataaagaatctagaatagcctaaaattttttgaagaagaaaatcatttgaagactcactacataattccaaaatttactataaagctagagtaatcaagtttaaaagagtaatcaggatggtgttctaatgctctaaatttttaaaattgatatttaatattttaatttttttctttttttctttttccccactaatggagtgaggtcacatgtttattttcttgacattgccatttgaaaagcagaagttttacattttgataatggctaatttatctttttttcttttataacttgtgatttttgtgataaaacttaaaaaaaattttcttatcaaaagatcacagtgattttctcctatgttttcacttagaagttttatagttttgggtttacatttaggcttatggtccacattgagttaattttttaatgtggcttgaggtataggctgagatttattttccttgcatttggatatccaatttgtctactgtcatttattgaaagacagtcctatctctactgaattattttgagcatttgttgaaaagcagtatacgtgttggtcaattcctggactctcctatttcattgatccattgaaacccttatttcaacactacactgtctcaattagtctagctttatagtaaatctgggagttatgtagtgagtcttcaaactattttcttcttcaaaaaattttaaaccattctaggatctttattttcccatgtaaattttggaataagtttcttcctttcaacataaacctttctgaaattgtgattgagattgctttaaatctatagatcaatttgcagaaaattgatgtcttaaaaaactttgaattttccaatcaataaatatagttcatttctccatttatttctcttatttggtgctttgtggcttttctcatacaaatttttcacataaaaatgctatccctaaatacttcatgctttctcatgttatagtacatgatactttaaaaagctattcccagctattcattgcaaatatatagacatttttaaaagttgttattgtattgtgtgatcttgctagtcttactcattatttccggcagttttttcagtgataattaacataggaaatcattgtatctgatagtaaatatagttttatttcttttaagatcctttttaggcatggcacggtggctcacacctgtattcccagcactttgggaggccaaggcagataggtcacctgaggtcaggagtttgagaccagcctgaccaacatggtgaaaccccgtctctactgaaaatacaaaattagccaggcatggtggcacacgcctgtaatcgcagctactcaggaggctgaggcaggagaattgcttgaacctgggagatggaggttgcattgagccgagatcgtgccgttgcactccagcctgggcaacaagagcaaaactctgtctccaagaaagaaaaaaaaatcctggctgggcgcggtggctcacgcttataatcccagcactttgagaggccgaggtgggtggatcccctgaggttgggagttcaagaccagcctgactgacatggagaaaccccatctctactaaaaatacaaaattagctgggtgtggcggcacatgcttgtaatcccagctacttggaaggctgagacaggagaatcccttgaacccgggaagcagaggttgcggtgagcagagatcacaccactgcccctcagcctgggaaacaagagtgaaactccatctcaaaaaaaataaaagagaaaaatccttatctgggatgtattattatgtgtcccattacaaagcaggttttattattattgctttctaatacaaggcataagatatattttctaatataaatttttaaaattcattttagtttagattcagggtcccatgtgcaggtttgttatttggatatattgtgtgatgctgaggtttctattaaattcatcacccaagcagtgaacatagcgcccaacgggtagtttttcaacccttccctcctccctccctcctgcttttcggagccccccagtgtctaatgttcccatcttcatgttcatgtgtacccagtgtttagctcccatttgtaagtgagaacatggtgattggttttctgtttgtgcgttcatttactccatttctcatataaaattagaagtatatgactttttagtgattacataaaattttttcaaagggtagcaatataattgcaaatgaagttcagatttatgaaattgccataaattgctgagctgtggagagctctgtgtcgcagccaaggctgtctgatcttttcgcctttggggcatgcattgtcacattcctcggcctcatcatttcaggatcagaacttagctttcttctcttgtccactggagtgtaatctcccagagagcatgcatgagttttcctaaagactcagtacgctgtcctctggacctgaggcatgacgcagtcttcaccaagtacccttcaggtagcttgggacccaacgtcccttctcctcattttccttatctgcactgtctgtgtctctgcagggtcattgacggccgagacctcatgcccttgctgcagggcaacgtcaggcactcggagcatgaatttcttttccactactgtggctcctacctgcacgccgtgcggtggatccccaaggacgacagtgagtgctcaacccgttgcttcctgttccctgccaggagcagggtcactcaggtgtatcctgaacgcattcttcctttcctctctagaccggtcctttcattccagggctcactgaacacatggttttggagaagtttctcagaattgctcttctgcagaaaggcaggtgggggtaatggagatgctaattggcttcacttaattatctcagcagtcgcacatacattaaaacatcacattgtgcatggaaaatctatgcaatttttacttatcgattacactttaataaagaaaacagatgtatgaacataagatttgcctataaagttagagagacacttttacgaaacatacatttttagtcaggtgtggtggatcacgcctgtaatcccagaactttgggaggccgaggcgggcagatcacttgaggtcaggaatttgagaccagcctggcaaacatggcaaagccctgtctctactaagaaatacaaaaattagccaggcatggtggtgcacacctgtagtcccagctacttgggaggctgaggcggtagaatcacttgaacccaggaggcagaggttgcagtgagctgagatcacaccattgcactccagcctggaagacagagtgagactccatctcaaacaaaaacaaaaccaaaaaatatatatacatttttagaaacaggactgatatctgctggaaaatgtgtatatcatttcaccagggaactctaatgttctcgttttgttgtaaggattgcataatatttagcattgacgtgtgggcaaaaagaagcccaagaaccagccttgagaagacggaagaagacaagagaagccagcaccttgggtgcatgcctctgatgtgctttctttctttcttttttttttttttggagataaaaaaatatgtattgaatatcttctatgggcaggttattttgtaggcataagtggtcatggctaaactttcatttataaaaatcaattctaggcagactaaagataaaatgtaagattaaaagtgttagaagaaaatgagtttatgacccagaaattggaagttttttaaatttttaaaaagtggcacacatataataatatgcacacattgcacatgaaaattggggatatctagtgatattttgagataggcaatgcatagtgatcagattagaataattggcacatccatcatctcaaacatgcataatttctttgtgttgggaacattgaatatcctccttctagctatttgtaactatgtaacatattattgttaactatagttattctacagtgtttagaacaggagtccccaacttttttggcaccagggaccagttttgtaaaagataatttttctgcagactggggtgggggatggttttgggatgattcaaatgcatgacatttattgtgcactttatttctatcattattatattgtattacataatgaaataattctacaactcatcatcatgtagaatcagtgggagccctgagcttgctttcctgcaactagatggtcccatctgggggtgatgggagacagtgacagatcatcaggcattagattctcatacgtagcctgcaacccagatccctcgcatgcacagttcacaataggtctcgtgctcttatgagaatctgatgcagccactgatatctgacaggaggaagagctcaggcaataatgccaacgatagggaatggctgtaaatacagagataaagcttcgctctctcccccaaccactcacctcctgtgtgtgaccaggttcttaacaggccacgaacaggtaccagtttgtggcctggggactggggacccctgctatagaacactaggacttcttcctttgatctggctgaagtgcgcatcatttgacgagtctctcttttctcctccaggtgggtcagtttggaaggctcactatgtgaccccggtattccagccaccagcttctggtggctgctatgtcacctcattatgcagatgtttcggagaacaggttacctaccacaacccccctctgctcttcgatctctccagggacccctcagagtccacacccctgacacctgccacagagcccctccatgattttgtgattaaaaaggtggccaacgccctgaaggaacaccaggaaaccatcgtgcctgtgacctaccaactctcagaactgaatcagggcaggacgtggctgaagccttgctgtggggtgttcccattttgtctgtgtgacaaggaagaggaagtctctcagcctcggggtcctaacgagaagagataattacaatcaggctaccagaggaagcctttggtcctaacgagaagagataattacaatcaggctaccaaaggaagcactaactttggtgctttcaagttggcaaggagtgcatttaatagtcaataaattcatctaccattccagattattaaaggcccactggttgttccacttgctgcttttttttggattcctgtggataaatgttgattgaaatttgttttatttcccgaaagcttataatttactaattctcttataaaaaatccgcacgatggccgctgataatgtcactgcagaattgctacttcttctgtttgtcacccagtctccaccttgcctatcgccagcaccaacactggcctttgcagtcttcctgactttctttgttttgttctttcattccatttgctgtttccttgaggtctttctcttctcacatgggctgtgtcttgcaagtctatgtttgggttcatttttctttgcataatctgaagatttgtaaatcgtgccaaaaccagttgtcttgccaccaccaaaatgaattctgaatatgaatacaaagaggacatcctggctgggcacgggggctcactcctataatcccagcactttgggaggttggggtggggggatcacttgaggccaggagtttgagaccagcctggccaacatcatgaaaccccgtctctactaaaaatacaaaaattagccaggcgtggtgacacatgcctgtaatcccagctacttgggaggctgaggcgggagaattgcttgaacctgggaggcagatgttgtagtgagccaagattgcgccactgcactccagcctgggcaacagagcaagtctccgtttcaaaaacaaccaaaaaaccaggacatcctgtgtggtcttgtccatttcggctagtttttcctgaatatctgtcttaggtgctgttgccttcctggggtgaaggacatcgatgaccatttgttgcctctgaagaagtcagtagctcatgaccttcctgtgtagatagttactatgtcatccatgttgacagctgagggcactggcaccatcataactcactgaagactccacagcaatcctcccagttcagcctctggagtaggtggcactgcagacacataccaccacgcccggctctttttattcttttgtagagaatgggtcttgctatgttgcccaggcccatctcaaactcctgtccccaagtgatcctcctgcctcagcctcccaaagtgctggaattataggcatgagccactgcatcaagcctaatttccattttctaaacgtgtctttccgtgccagaaaacaagcacctacagacacttgtgccatctgctcagttgctttgctctaaatataaggccctgtgtcatcaggaggcaacatacgaggcatttaaacagtgcattaagaggatcaagtctaaacgtggccactaaccaaccaaaagggtttatgtttgtcaacaacagatagaaattgaatcaagagtggtgcaataattcagcaaaacgtgtgtgaacccagaaagtctgagacaggtctcagataacttagaaagtttattttgccaaggttgaggacgcgcctgtgacacagcctccggaagtcctgacaacatgtgcccaaggtggttggggcacagcttcattttgtacactttagggagacatgagacatcaatcaacatatgtaagaagtacattggttcgctttggaaaggcgggaccacttgaagtaagggctggaagacttgaagtgggagggggctttcaggtcacagacggtgagacacaaacagttgcattttttgactttctgcttagcctttccagaagaggcgatcagatatacatctatctcagtgagcagaagggtgactttgaatagaatgggaggcaggtttgccctgagcagtttccagcttgagttttcctgagtcattttgggggcccaggatatttttttttcacacatgctagcactgagtgacatagcaattggtctcctggcagcctggaaatttcagcaacagctgataagacagcgtggtgagcagccaggttctagaaagcaaagagaagtaggcatcaacaacctgggaggagcactgctttgatccccccagaatgtgccagaccattaatgaagtatcttatttccttcttaattcagcctcatgatttaggtataaacacttgtgtgagattgcccagagctgccataaaaatcaccataaacttggtggtttaagaaaacagacattcattcttccacaattctggaggctagaagttcaaaaatcaaggtgcttcctccgaggccctgggtagaatccgtccttgccaatccttgaaattccttggcttgtggacatatcactccaatctctgcctttgtcattacatgaatgtctacgctctgtgtctttaaatctctctctccttatagagagagattatagtcatatagaatttagaacccaccttcatctactatgacctcattttctcttgatggcatctttaaagaccctatttccaaataaagtctcatgtgcaggtaccaggatttaggactttaatgtaaccttcgaggaggtcataatttaaccctttgcacccttatataccaagaagagtacctgggacttggaaatgctctgtaatttgctcaggagaacacagcttaggtgttactgggctgagactggcaccctagccatgccaatcccaaatctccatgtacatcaaccctatggtgttgaagtaggaggcgcgacttgactccagaggtgggggttggacaccagaccagattgagggctagctaaaacagggcagaccaaagcagctttcagtcagacacgcccatcagtgtgccatgtcaatttaccattgccatggcaacacccaggagttaccacctctttccatggcaatgacccaataactcaacgattactacgctttccctagaaatttctgcataacccgcaccttaatctgcatgcaattaaaaatgggtatatattttgggaggccgaggcgggcagatcatttgaggtcaggagtttgagaccagcctgaccaatatggtgaaaccctgtctttactaaaaatacaaaaaaaaattagctgggtgtggtggagcatgcttgtagtctcagctactcaggaggctgaggcaggagaattgcttgaacccgggaggcagaggttgcagtgagccaagatcgtgccactgtgctccagcctgggagacagagtgaggcacggtctccaacaaggaaaaaaatacaaataaaaataaatgggtataaatatgacttcaaaaaaaatatgccctgagctgctactctctgcctgcagggtagccctgttctgcaagagcagtcacggagctataacactgtcacttcaataaagcagttttcttctacctctggtttgcccctaaattctttcccgagctaagccaagaacacttgtgggctaagccccactttgagactcacttgtcctccaggagtgtctctcaaaggtgcaaccccaggagtaacataatcatgtgtgttcgtcaatttgcaattgcaaaaatgtggaacaagcccaaatgcccatcaatcaatgagtggatacagaaattatggtatatatatgtacaatggaatattactcagccatgaaaatgaatgaattaatggcatttgcagcaacctggatgggtttggagagtaagcgaagtcagtcagaaacagaaaaccaaacatcgtatgttctcactcataagtgggagctaagctatgaggatgcaaaggcctaagagtgacacagtggactctggggactctggaggaaagggtgggaagggggtgagggataaaagactacaaattgagtgcagtgtatactgctcagtgatgggtgcaccaaaatctcacatatcaccactgaagaacttactcatgtaaccaaacaccacccgttcccccaaaacctatggaactaaaaaaaaaattagaaaattatgtgtgtttgacttatttcaatggactgatactgttgccttgtctttactaaggagtaatatgaatgtgtcaggtgaaatacaaataactgtcttaatattaactattaaacaaggatatctttttcctaagtgatttggggcaaccatattagaccttatttgtccacaaaagaattccttacaaaggctgagcatttttctgccactctttgttctaagatctctaaaacatcttcgttttctcatcactcttaggaggaggttcgttttgaatttagaataccctagaacagaatcttaggattttagcctgagaaataacttctgaaatcgttttctcaaatgctcttatatttgcagatgaagaacacagagtgtgaagacacgaagcggctttaatgagtctgcactgtaaagggagcaggaccatgaggtctgaacccaaggttgtcaaccccaaatgcaaggtccttctccctccctggctccggtccttccattttctttaaccacatggcaaggagaaggtagtagataaaagcaagctatgtacaaccaagggaacacgttcttttccacacagtggtgttcagaggtggaaagaatgttctctagggtttgacacaattggggtgaatgggaattgttcttcttgccagctaaatatctttggacatattccctaatctatctgtacttcaattgttccctctgtgaaatgcaactaaaaagtgtattaccagacttacaaagattaatggagataatatctgtaaaagactttgcacatagcgcataggcccataggtagctcttaataagtattatatttccttttctagtggttattttgaaaataccttaagattaaaattgaaagaatgtcatctatcaaaatgatacaaacctttgccattggtctaaacactccaaactcaatgcttaattaacctatcatgacccattgcatcgagaaaattaccttcacctgccttgtctatccgaggtggtcaatattttccatatgccccttaagcccttaattaacctttttccctaaatagaaagataaattatacaattcagtctgcaaatatagttacttaagggatgtctattatttcctcattctgaattatcctttaaataatttatattctttccttcgcattgaggaatacaagcctgattgagcactgcgtgtttttaatcattacatgaatttaaacactaggtggcatgctaatatagctgcctgcacagctagctccaaattcctaatatgataaatgtgtgcatttatttcatttttgtaaagatagcatacattttaactttattctcggaagaggaatttgaaaaggaaagacacctttttcaactcatattgtttgattgcatccagaaattcacctccacctactttatccatctgaggtggtcagtattttacataagctcctcaaacccttaatagctttgaaggaatggaatgcattgcctaaagtttcagacaggaataacagaaagcaaaaattagagaaacaaagacagaagggtagcgggggagagagacagaagtatcaaggtgcatcatttatcatctggagttttctaagcacatatattttaattacaactagcatgtgtgatccgtgctactcattcatcccccagagtgtgaacataaatggagaacctagaataatccaggcactggtctaaagttggagaaaagatacgtagtttcttctgtctcaagaccgtgttcggaggatgagtaaagcaacgtgaattagagttgagatgggccaacaataaataatctcaaaaggcttggctgaaagcagcacccgcacctcagatcttggctataatttagctaaggaagcagtgtatttagaagcctacttgcaatgattttttcaaatccaaatcttttatgaaatttgacttgggtggtacagggattcaagagcaaatcccaaattggatggacccacaaatggtaaagactcctagggttagggttatagggttttccttactcagatctgcaaatggcctcagaagccctgcctctggctggagcgggtttccttagcagtgttgtaaaaaaaagcgggagatacaggaagtacacattgcatggaagcacagtttgtatgggtggataccttggggtgatgttatggggcgatgattagttgcccggccacctcttggtgagggtaattgagcaatggacattttccagctgcggatggcaggatgacagtcagattctgcagaatagaaagcttggattctggttcagaaaaatcctgcctcttcaagtatgccttgtttgattttccattgcatttagacgacatgcaagtgaaacccccacttggaaaatgccaaatatccacccacatctccagcctgtatccattctttaaacagtaaagacttccttccttctttttttttttttttttctgagacagggtcttgctctgtcacccgggctgcagtgcagtgctgcaatcatctttcactgcagcctcgacctcccaggctcaagtgtcctcctgcgtcagcctcccaagcagttgggaccacaggtacgagccaccactccctcctaatttttgtatactttgtagagatggggtctcacgatgttgcccaggctggtctcaaattcctgggctcaagccatccgccctgcttggcctcccaaagtgctggaattacaggcatgagccaccatgcccagcctatttttgtttcttctaagcagaattttgatcagcaatccagattccctaactttaaccccaagagccgaatttaggtccttgccagagaaatgctatctatggtatagacttaggaaatatgcatatttaagaggaaacttttgaagaaacccactgttgctatcagtatgagtaataatgacttaagcaacctcagttcttggcatcattcctttgtggatagaaccaggtatatagtttgcaaggccgagtgcaaaatgaaaacgctcagctcttggggaaacaggtaaaagtaaaaataaaatggttatgtctgttaaagcaaactaaatatggcctgagaagtactccgtacttctatatttgagtccttgtggatgaagggtatcctagcttaataggcaaacaaaattgaaaacctaagttaatagcatgcatctgtaacaatagctgagtgttggccaatcccagcggccatacttcaaccactcatagactgctgagtgttcaaactgcgttcaaatcaggcaaacgccgagcagtaatccatttcactgtttccgtaccgcacttccgattcctgtacctctctttacctttttctttttttttttttgagacggagtctcactctgtcgccaggctggagtgcagtggtgcgatctcggctcaccgcaagctcggcctcccgggttcgtgccattctcctgcctcagcctcccgagtagctgggactacagtcccccgccatcacgcccggctaatttttttttttttttttgtatttttagtagagacggggtttcactgtgttagccaggatggtctcgatctcctgacctcgtgatccacccgtctcggcctcccaaagtgctgggattacaggcgtgagccactgcgctcggcccactttactttttttgtctataaatttgttccgaccatgaggcacccctgcagtctgtctgaatctgctgtgattctggaggctgcctgattcaatcaaatcttttctttgctcaattaaactccatcaaatttcacttgtctgaagttttcttttaacagctccttgttccaaaatgtttaagaatttcgatagggtgccagcagaacagaaggaaaaacaaccacaacaataataactttttcctctgtcctcctcagttctccagctactgctctggaaattaaactgtcaaaagaacaaaagaaaagcagaatttattaagacatgcagtgcatatacacatgtggtgaaactcagtgatgaataactcaaaagcatggttagaacttggggcgcatacaacaaatcagccaagaacaatacatttgtcaagaaggaaaaaggcaaaggaaaaaggccttttaagctcctaggagctgcaaactttgagaagacaaatacaggaggaaacaaatggaagataaaggcaaattgagtaaggtttgttatgtagattcctctaggcctgtgtctctggtaattaacagtctaagtctactttcaggcaaataggagagtgcagagagtttttttttttccccactcccttagctgacttgcttttattgtttgagttaaaaaagaacgagatcatgtcctttgcaggaacacagttggagctggaggccattatccttagcaaactagcacaggaccagaaaaccaaataccgcatgttctcacttacacataggagctgaatgatgagaacacacggacacaaagaggtgaacaacacacattggggcctttcggaaggtggagcgtgggaggagggagaggatcaggaaaaataactaatgggtatgtgaacccagaaagtctgagacaggtctcagttaacttactttcttttgccaaggttgaggacgcgccgtgacacagcctcaggaagtcctgacgacatgtgcccaaggtggttggggcacagcttcgttttatacattcagggagacatgagacatcaatcaatatatgtaagaagcacattgattcggtctagaaaggctggacagcttgaagcaaaggcaggaagactggaagcagggagggggtttccagggcacagataggtgagacacaaacagttgcattgttttgagtttctgatgagcctttccaaaggaggcgatcagatacgcatctctcagtgagcagagcggagactttgactagaatgggaggcagaggccctaagcagttcccagctggacttttccctttagcttagtgacttggagacctcaagatatattatcctttcacaggttctaagcttaatgcctgggtgatgaactaatctgtataacaaacccccatgagaggtttattctgttttcttttagcagctcttgcttctcatttgtcttcagctcaaaataacccttatgccaaagggctatcttttgggttgacctatcctgctctcccacaagagccttcagcaaagtttacagttgtcttgcagaagaccacccgggtggccaaatagtgtaatagaaaggagaggtttgtttttttattatactttaagttctagggtacatgtgcacaacgtgcaggttagttacgtatgtatacatgtgccatgctggtgtgctgcacccactaactcgtcatttacattaggtatatctcctaatgctatccctccccctccccccaccccacaacagtccccagagtgtgatgttccccttcctgtgtccaagtgttctcactgttcaattcccacctatgagtgagaacatgcggtgtttggttttttgtccttgctatagtttactgagaatgatgatttccatgttcatccatgcccctacaaaggacatgaactcatcattttttatggctgcatagtattccatggtgtatatgtgccacatgttcttaatccagtctatcattgttggacatttgggttggttccaagtctttgctattgtgaatagtgccgcaataaacatacgtgtgcatgtgtctttatagcagcatgatttatagtcttttgggtatgtacccagtaatgggatggctggatcaaatggtatttccagttctagatccctgaggaattgccacactgtcttccacaatggttgaactagtttacagtcccaccaacagtgtaaaagtgctcctatttctccacatcctctccagcacctgttgtttcctgactttttaatgattgccattctaactggtgtgagatggtatcttattgtggttttgatttgcatttctctgatggccagtgatggtgagcattttttcatgtgtcttttggctgcataaatgtcttcttttgagaagtgtctgttgatatccttcacccactttttgatggggttgtttgtttttttcttataaatttgtttgagttcattgtagattctggatattagccctttgtcagatgagtaggttgcaaaaattttctcccattttgtaggtttcctgttcactctgatggtagtttcttttgctgtgcagaagctctttagtttagttagatcctgtttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcgtgaattaatttttgtataaggtgtaaggaagggatccagtttcagctttctacatatggctagccagttttcccagcaccatttattaaatagggaatcctttccccattgcttgttttttcaggtttgtcaaagatcagatagttgtagatatgcagcgttatttctgagggctctgttctgttccattgatctatatctctgttttggtaccagtaccatgctgttttggttactgtagccttgtagtatagtttgaagtcaggtagcatgatgcctccagctttgttcttttggcttaggattgacttggctatgcgggctcttttttggttccatatgaattttaaagtagttttttccaattctgcgaagaaagtcattggtagcttgatggggatggcattgaatctataaattaccttgggcagtatggccattttcacgatattgattcttcctacccatgagcatggaaaaaggagagttttattggtgatgtcagtttgcaaactgggtagtaagtgtccctggcataaacagaaggtgctctctctctgaagagggaaaagagagattggatctcatgcctcatagggatcatattacacaatagagtcatgcatattcagcagatttgggggagaagctatgcatatttatgaggggagctgagtgcatgcccaatgggtaaacatatatgtaacatatgtcccatgttcactttggggctatgttttagcattaaaatgaggcaggtgtggtggctcatgcctgtaatcctagcactttgggaggccaaggcaggaggatcacttgagctcagcctgggcaacagggtgaaaccacgtctctacaaaaaataaaaataaaagagccaggcatggtgacacacacctgtggtcccaactatttgggaggctaagttgggagaatcggttgagcccaggagattgaggctgcagtaagccatgactgcaccactgcactccagcctgggtgacaaagtgggactgtgtatccaaaaaaaaaaaaaaaaaaaaaaaatgagatgggatttggctcttcatatgaagaggtgaactataggacacaaagacagtttgtgtgaagcctctatgagctggtgaaacttgagtaaggtctgcagttgcttatcagaaaagaatgtgtgtatagctgctcctctgtctgaatagtagtctgggttgtcaagacttagaaggggctgggcacagtggatcatgcctgcaatcccagcactttgggaagcagatgcaggcaaattgcttgtactcaggagtttgagaacagcctgggcaacatggtgaaactccatctctacaaaaaatacacacacaaaaattagctgagcatggtggcatgaacctgtggtcccagctactcaggaggctgaagtgagaggactgcttgagcccaggaggtcaaggctgcagtgagccatgatcataccactgcactccagcttgggctatacagtgagaccttgtttaaaaaaaagtgttagaagggtctgataatttgcctgggtagcttgtcttcttacggaatttagcaagagtgttgtttttcttatagccgtaggaatttaggaagttgccaccctagcctctctgtgaactcagcctgtagcaaacttttctttccttaaccttagggtctgttttagttgctaaaggggcatttattttggtctctctgatgacagggccttgtgcaacagtggaggtccttcatcttgaagttcaccctgaacatgggtaatatcacccagacaacacctggagccttcacggtaacttagggcaagtgtcactggttttccaaaacccagccgaaatttcaggtctcactagacaggcacggccctcttcttagactgttcatgtttaaggcaagagctatatttaagctgagcaccaaaagatgcgtcgaattcagtttagcctaaagctgccccctgacatattttaaggtttgcctaaaggtttctccgtacgcagtgcactgaaacctaactggatgtgtaaacaggctggaacctacttttgtgccaatcacaaagttttgtccgaaggaagtcaactgtccaaaccatgctcaaatgaggccaatggtgagctggaacgaatttggctatttctgtacctcacttctgttttctgcaccccactttcctttttctgtccacagatcttctctcaacatgagacagtgctggggtctctctgaaccgactctggttccatgggctatccaatttgtgaatcgttctctgctcagttaaactctggtaaatttattttacttatatattgttatttttctttttttttcagagacaggttctcactctgtcacccaaactggggtgcagtggcagcatcatagctcactgcagcctcccacctcagcctcccaaatagctaagagtacagatgtcccccacctgcctcagccacccgagtagctgggaccataggtgtaagcctgttttttctttttttttttttggctttagctgctagaggaatcctggtgccactggcagatctgatggaagaacctatgcattgcaaaccctgggttggagatgccactgagatacctcaggggaaatgccgaggaaggagtggaaggctggatgacaggagactgttggtctgcatgtgagacagaggtactaggggatcctggtttcagccacactgggtggttttctttaaatttacatctcatactagttcaagtcatatctggccttctggggacacagtcccaacatgtttcttttgttgttgttttttgttttactcctctgatgctacaaaggctcgaatgtatacttcttttaaggtgccctggctcatgcctgtgggccgaggtactcaggaggctgaggcaggaagatggcttgagcccgggagttcgaggctgcagtgaactatgaatgcacgactgtactccagcctgggtgacagagtgagaccctatctcaaaaaaaaaaagaaaaaaataaacaagatagtgcatttcaatgaaagaacattctcttaaaacggaatagaaaacactttcgatggatgggcagggtggctcatgcctataatcctagcactttgggaggccgaggcaggaggattgcttgagcccaagagttagaaactagcctgggcaacatggcaaaacgctgtctcgaactcctggcttcaagtgttctgcccacctcagcctcccaaagtgttgggattacctgtgtgaggtactgcgcccgtccagataccttgtctctacaaaaaacacaaaaatcagctgggcatggtggtagtgcatgctgtcccagctactcaagaggctgaggtgggagaatagcttgagcctgggagatggagattgcagtcagtcgagattgtgccacagcactccaagctgggtaacagactgagaccctgtctgaaaaaaaaaccaaacaaacaaactaataaacaaaaaaacccaaaacgggccgagtgcggtggctcacacctgtaatcccagcactttgggaggccgaggcaggcggatcacaaggtcaggagtttgagaccagcctggccaacatggtgaaaccccatctctactaaaaatacaaaaaattagccaggactggtggcgcatgcctgtaataccagctacttgggaggctgaggcaggagaatcgcttgaacctggaatgtggaggttgcagtgagctgagatcgcaccattgcactccagcctgggtgacagagaaaaactctgtcttgagaaaacaaacaaacaaaacaacaacaacaagccaacaaacaaaacaaacaaaaacagagtaagccaggcttggtggctcagcctgtaatcccagcatgttgggaggcaaaggtgggagaatcacttgagcccaggaatttgagatctgcctggacaccatagtgagactccatttctatttatattaaaaaataaaaattaaaaaaacagagtacctcagagtcacatgtcatcagtgtagatacaattattacccacaaggggaagaagtgtgtccccagcaaagtgagaattgatgatatctcttcagatgtttaatctcatgaatcaacatcagttttgttgattcaatggtacaaatataaagttccatgaaggaaaacagtcctaatgttagataggtcaggagggtgactatagtttacagtaatctattacatgttcaaaattgctggaagaaaagaattcaaatggttctagtacaaggaaaagacaaatgtctacggtgatgaagatcccaagtactcatttgatttttacaaattatgtgaatctattcaattattacatgtatccccaaactatgtagatccattatgcatcgattaaaaaaaaaaaagaaaactccaaaaaacccatgagctttgaagtagatttcaatatgtttcatattgaatatttacatattgaatattcacatatcggcatatttacatattgaatatttacatattggcaaatttacatattacatattcaaaaagcatgtaatgagtggagaataccccgagggaacatgctagcagtgtggttaccatatttgtctttctcttatgttttagtggagagagaaataacagtactagttcctacttcattagtaccaggaggagtgtttggcagtagaaataaaggaacgttagaggaaattccccaagtttggaaaggaaggaaggatttcccgagaaagtgatgtttgaaggaaaatctgatgggtgagtagggtaaggggtggtaatatggagcattgggtccttcctggtagagtttagcaaggaatggagtagggaaactgtaaccatgagatcaggttgaaccagttcaactcaattgtttaagctgttatacagttgaaacagaaccaacattgcatgttgtgtagcctgggcacaggcaaagggaaaaagctttgacctccaatcacactggaaactgatgatgcttccctatggaaccaaagacagctggacatgaccagaaccaggatgcagaaacccattcagaagcaaaaggtctactctcccagaagacattgtgctgaaatccaccattccataccttattataatagccaaggttaaagccctttgattaaaacttgccgcaccagcacttccacatacttctttttcttttcttttcttttctttctttttttttttttttttacacggtcttgctctttcgcccaggctggagtacagtggcgtgatcatggtgcactgcagccttgacctcctgggcttaattgatcctcccacatccacctcctgggtgggtagctgggaccacaggcatgcaccatcacacctggctagtttttgtattttttgtagaaatatggtttcgctatgttgcccagactggtcttgaactcctgtcctccagcaatcctcctgcctcggcctcccaaagtgccatcattataggcatgagccactgtgcccagccacatacttcttaacccataaacatttgagctaactccccagatcagggagacagatttgagccctgcctcctgtctccttgccagttgacctcacaataaagtcttaaaaagaaagaaaaaagaaaaaaaaaccggtaccctacagcacggcgtggtggctcacacttgtaatccaagcactttggaggctgaggcaggtggattgcttccgctcaggagttggagaccagcgtgggaaacagcaaaacccagtctctacccaaaaatacaaaaattaactaggcatggtgatgtgtgcctgtggtcgcagctactcggggggctgagatgggaggattacttgagcctgggaggcagaagctgcgctgagtcaagatcgtgccactgcactccatcccgggcaacagagtgagaccctgtcttaaacaataacaacaaaatccccaaagcaatgccctagtattggcttatatacatgtcaagcagcaagcccattgctcagtaacaaaatgggtgacgcaaccctgaagagcagtaagaactgcagtgtggctgggagacacagaatgaggtaaacgatggcaaacattgaggacggagaggtagcaggaaagaagcaacaagtacagatgattcagacctcgtggtccgagatgaggagcttcttctttatcccaggaacagtggaaaaccatgaaatgggtctacacagaacacagcgtggtcaggtctataatctcatcttctactgtgtccagagggttttggactagagaagaataaggctgggaattgaggcggtacaagttagtggggtgttgcaatcaagaaaggaagagatgatgaaatcttccacctggctcctaacattatgagagctggcacgatgtagactggtccaggagctatttagggtcaagccacaagacaggaagattaaatgattcatgattaaatgatattcgcagcctccaataaatcaacttcactattattcatccttgttttcttgttccagaccaccatctctgagaaagaagtaggattattgtcagaagtcttctttgatcttttgttctttccttttttaggggttggggagaaagtctcactgtcacccaggctggagtgtagtgacgtgatgttggctcactgcaacttccacctcccagtttcaagcaattctcctgtctcggcctcctgagtagctggtattacaggtgtgcaccaccacgcccaggtaatttttgtatttttcatagagatggagttttgccatgtaggccaggctggtctcaaacttctggcttcaagtgatccacccacctccgcctcccacaaagctgagattacaggtgtgggccatcactcctggttgctctatccttgaagggctataatggaaccaaccaaggaaagaacatagcagcaaatggccactcctcaccttggtatttctgggaattttatgaggctactgtagaaaaatggtttgatgaaatgaagcctgtgatcacctagtaaattgtagagaaatggcttccacatgtgaggttgtcctttcccgaatacatgaccttaaggtgaaatggataaaacttctggcttggaaaggtagttagtataattaggaccatatttatttttcaaatacagagttgaggacccctgtcgttttctgtaatgcaagtctaagtgggctcggagggactgtgaactctggtcctggaactgatttcataacctggggcacgttcatggaaatatacggttggaagggagcttggacaggtctctacagatcccactgctgattggttttgatagaagaaatcacttacgtgcctctgtagttgactccattttaataagacagcgcagcttcctctcttctcagctttgaacatctgtggagacagagaataaggattctcatgccatcttttaatgatgcttttataaaacttttgactagatcgcagggcttgcctctacttttctcaagatgcattaagcattctttcttcccatttgcattcaccaacccccttagcttctctgtgtcctctccaaccaaatatttttttaaaaataggcatctacacttgaccaaaagttgaatacatgtctacctgaggatactaaaagagttctatcttgattttcatacctctgacctatatgttattttgtcttgttaataatcgtaacttccaggccaggcacagtggctcatgcctgtaatcccagcactttgggaggccaaggcaggaggatcacttgaggtaaggagttcaagaccagcctggccaacatggggaaaccctgtctctactaaaaattcaaaaattagccaggcgtggtggcacacgcctgtaattccagctacttgggaggctgaggcacgagaatggcttgaaactgggaggcggaggttgcagtgagccgagattgtaccattgtactccagcttgggtgacagagtgagagtctgtctcaaaacacacaaaaaaaaccaaacaaaacaaaaaactacattgtaaagatattccatgaatggggtcatactattagtaaatgtttggatcaacatctgtagtccttttaggaagtaataagaaggtataagaggagaggaaagagatctttcattgcaatctatgtgaggctttgggtgtgagctaggtttctggggttttctcagagagaaacagcaagagagagagaggcatgcttatattccatgctgccgagagtggcaaagatatgacagcattgcttcagcagtagtggtgacattgagagggagatggtcgtaggaagtgaagaaggagaattttcccagtggagcactttttttttttttttaatagagaaggggtcttgctatgctgtccagtctggtcttgaacttccggcctcaagtgatcctcccacattggcctctcaaagtggtgggattacaggtatgagtcaccatgcctgacccacagtggagcaccttggtgcttggctataaaagttatattcccaagaagcccaaagatggagaaaaaaatgtttgttgtgtttaccaaaaacaaggtgtctgctttgtatataaccccaagagagatcacctggcggcccctcccaaatatttggagaagaatttgcagaaagttccaagtccttcaagagtaaagacacaagagtaaaagaacacaccaacattcatgatttcaaagtttgatttgctcccgaatcgaaagccagttttttcattttgattcagatctatacgttcacaaaagccatgctcattttgcaaaactcttatgctaaaaagagcgatgcttcctccttctaaacagaaacccctgtctctacaagtgtctacttttcctactttctgataaagggaagacaatctaccctgtctgtttaattttttacatgcagcctctctgacacgtggaattgggagactggagtgccaaatccgtttttttcagtgtgtaattttatagctttccccagagcaaaagaggacaagtcaggcaagctgtaaagcagaggggaggaatttcatgggacaattttattatgccatgaaatcaagacagagtttgatgccaatgaccatcttggacaggcaggatgcagagagagatgaagcccgtgacctgcagaagcgcacttcgaagaaggcatgctgcaccccagccgttctctttgccctgaatggttcctgccttatgggaccaaggaaacgggtattgctaaaaaggcaaaattggcagcttccaggaaaacttctggaggaatgtactgaggcccctaacaaattaacatacgttgggtggctaaaaataacaagactttattctcccccagttcagaacacccgagcctgagatcaaagcatctcagggccacgattctccagaggctctaggggaggctccgtcctgcctctcccggctcctgggggctccaggcatccctgggcttgtggccgcaccactccagtctctgcctccgtctccacatggcctgctcctctgtgtctgtgtctgtgttacctcttctgtctcttattttattgcatttatttatgtattttctgcatcaaatcatccattgctcttctgtctcttatagggacacctctcatttgatttagaaatcactgtgatccagtatgatttcatgtcaagatccttaactaattacatctgcaaagaccctatttccaaataaggtctcattccagattctaggctttaggatatggacagatctttctgggggccactgtttagtccactacatttgtattcacttccttccggaggctctaggggaggatgcttcctgcctcttccagcttctgggggctcctggcatccctgggtttgtggccacatcactccagtctctgttcccatctccgcatggcccttctcctctgtgtctgtctctgagaatggcaaaggtctgacagcattgcttctacagtaggggtgacattgagagggagatggtggtagcaaatgaaagaggagaattttcccagtggagcactgtttaaaacaatagagatggggtcttgctatgttgtccagtctggtcttgaacttctggcctcaagtgatcctcccacattggcatctcaaagtggtgggattacagttatgagccaccatgcctgacccccagtggagcactttgatgcttggctataaaagttatactcccaagaaaaagcccaaagatggagaaaaaaaagtgtgttgtgttcacgaagaacaaggggtctgctttgcatatgacccgaagaggacacctcttagaaagacactggtcattggatttagggcccatccagataatccaagatgatcccatcttgagatccttaacttgattccatctgcaaagaccctatttccagataaggtcctattcccaggttctgaggttaagatgtgaactcatattttaaatgtctccattcaacctactacagcttccatgggacatatttgcccagcatccagtgatgtaaactggatttctgtgtgttttaagagctgtaaaggaaggaataattatcattcctgaaatacccttggtattttagcaaaataaaagttccccagatttgcttaatgaatctttacaataagtagcagggaattaagtatcatgggtgtgatttgagacttggatgaattaagggaaaaacttaaaagttgttaaaaccttactacctcctgccagctcaccagacacctttaatgcttcaggagcagcacacgaaatataatttttgaaggaggagagttccatgtccacatctacgccaatggaaaaaatagctgggtggaaaagactaggaaaatgaacagagagtaattttcaagatttcctttcattaaaaaacaaaacttgctggttcagagataaaagaaagtgaagcacttttttttgtaaaggaaagaattataagatttgaagtgaaacattaatatgagcagtaaatgaatagctgaaaatataaggtaaccttagtggaaagggattttgaaattattctttgaaactccctctttcatatgccttgttaatccgatttatttacgtgcatttaacgtgagcacagggactcatgcttttacttatgttatgcaggatttggtgtacaaagaaatatgtctacctatactgattttggtaatttgtaaaattaaatgaagattattggttatcatgtcttcctggatttgcaaatacttggtatacacccagtttcaattgtggggaagtatattatggggaaactcatgaatcactgcttattttttcaaagcacgtggaaattccactcacatgaaaaaacatacttccacttaaaatagcataagtccaatgggtgcttttgaaacaaatgaatcaaatcagaatcaaaattctctagctctctgatcttcagttgtagagttaaaatattaagggaaattgcttaaatgttgaaaaaattttgaacagatggctaccacataaccatatggaatcaatgacactccccaaatgcatgagaaagccattttaaaaattgatgatgcaactatagttggaatacacacacgtaaacacacacaaaatgacctatggcaagttttatttataccatgcaaatgttaagttaatcatcgcctctagttaatgcatatcccagattttctgacactgtggatgaaatctagacccacttgttgtttttgcagagttacatggaaatgttgattaaatccaaatggaatcacagtttagctgaattaaatgccaaatggctccgatcacttcctggagtgagagagaggggaaatcattgcaaatgcaacctacacaatgccttctgttgaaaatttagtggatacttggtttcacatggtcacctccaagcagtagcttagaaaagtggtgaaactttacagacagacagacagggagagagagagagagagagagaggataaattagacagatagatagatgagatagatagagatgacaaataggtgagatacctaattagatagacaaatagagatagatagacaggtgatagatatagatagaggaataagtgacagactagatagataagatagataattagacaaagatagacaggtgacagatgagatggataattaatagatgagataaatataatagatgagatagatagatagatagatagatagatagataaaataggtaggtacctaggtagaaagaaaaaggaaagaaagaaagaagaaagaaagaaagaaaagaaagaaagaaagagagaaagaaagaaaagaaagaaagagagagaaaggaaagaaagaatacatggatggatagataggtggtagctaggtatgtagataaatagatgatagataaacagacagaatatatgggtgaatatttagatagatggatggaatacatagatgaaattgatggatggatggatggatggatggataggtaggtagctaagtagttaggtggctagctggatagtgatatagtttggctgtgtccccacccaaatctcatcttgaattgtaactcccacaattgccatgtgttgtgggatgaacctagtgggaggtgactgaattacgggggcaggtctttcctgccctgttctcatgatagtgaatgagtctcaccagatctgatggttttaaaaaggggagttttcctgcacaagctccttctctttgcctgctgccatccacgtaagacgtgatttgctcctcctccccttccaccgtgattgtgaggcttcctcaggcacgtggaactgtaagtccaatactctccttttcccgtataaattacccagtcttgggtatgtctttatcagcagcctgaaaacagactaatacagatagacgcatagatagatagaaacattaattcatacatacatacatagatgatagatgatagataaatagatacatagatatatagatagaaataaatagaaagaataaacggtctggacagcaggataaagaacagaatttattgaacctaaattctccatatgcgtctgaaacagtgctagccaaagcccttctcagatacaagagagggccccttgattttcattcccttgttcctcacactgatacctccttgttctcagcagcgaggtgctctgtttagcactaggagtcactgtcccagctcctaatgcaagagacatctgcaggttagcactcaaccttaaagaaagaacgtgaaagctgtcaacgctgtggaatgggatgaagcgggagagcaggtgacagccaccattacaagtccgctggctccatcagtgctctgtgtgacttcagtcctactcaaggcagccctcacctgtgggctctgcacagttctttttggcttacaagagcatgcagggatggcgagagaggattaaggcttctgcttgcctctgtccaaccttgacccaaccttgagaaaagaacagtttaatgatgtcagagacagcacaaagaacaggacttgcaagccagttagacctgcattttaatcttagctttaaagctcagtcaagatatgatcttcccaccttcctgcacctctgagatatcctgttacacgatgggcgttgttcttcgcaacatcatttgcatgtcaataagactgcagtgcacacattcaaatacaggaaggctttgtttcacacagacatcactttgagtgagccaggattgagcctctgacacagctcaatttacacaaatagcaatttactccaaaaattaactgattttttaaataaggtgttgacttactttacagttttgtttttcagatgaaaatattgagaggttttttttttctcttgtattctttacacttagagttggtttatcacacggtagacatcaagaatttgttgagtgagtcaacaaagaatctaaaattaatgatgttaatacctggtgttgtttgccatatgatataagacacggatttttttttttttttttgaggcagggtctggatctgttgcccaggctggagggcagtggtgtgatcttggatcactgcaacctccacctcccaggctcaagtgatcctcccacctcagtctcccgagtagctgggactccaggcacatgccatcaccacaacccactaatgttttttgtagtttttttgggtagagatgggtttttgccatgttgccaaggctggtcttgaacttctgggttcaagcaatctgtctgcctgagcctcctaaagtgctaagattacaggcgtgagccaccatacctcgccaagagtttttaatatacatcaaagtttccatagatcatatagttgttgtttattattattattggtagtagtagtagtagtaatttatttttcaaggtgagatcttgctttgttgcccagaatggagtgtagtgttgtgatcatgggtcactgaaatcttgacctcctggggtcaagcaatccatccacctcagtctcctgagtagctgggaatacaggtgcacgtcaccatgcccaacaaatttttctattttatgtagagatagggtctcatcatcttgccaaggctggtcttgaactatgagcctcaagcaatccttccgccttattattattattattattttgtgaaggagtcttactctgtcacccaggctggagtgcaatggcatgatctcggttcactgcaacctccgcctcctgggttcaggtgattcttgtgcctcagcttcccaagtagctgggactacaggcatgcatcaccacgcctgactaattttttttatttttagtagagacagggtttcgccatgttggccaggctggtcttgaacttctgacctcaggtgatctgcccacctcggcctcctaaagtgctgggattacaggcatgagccaccacattattatttttaatagacctttatttttagagcagttttaggtttacagcaaaatcgagtggaaagtacagagactatccacatactctgtgcccccagacacgcacagcctcctccactgtcaacatcccccactagagtggcgcatttgctgcaatccatgggcctacattgacacatcatcatgacccaaagtccatagtttaagttcctggttggtgttgcgcattctgagggttttgacaaatccataatgacatgcatcccacactatactatcacacagcatagtttcacttttcctaaaatcctctgtgctccacctatttatatccctcctcccccaacctgtatcaacaaccgatctttttattgtctccgtagttttgttttttccagaatgtcatataattgaaagcatgcagcagagagttaactttaaaaaataacattctgaattatttcttttggaaagaaaacattattttttagtcaagatgaagtttaaataactactctgtgtcagacattgtatataccttacctaatttagttgttaacatctttgtgaataaagtgttcgcatcctcattttacactacagctcagagaacccaaattcaggcagggtatgcatgtgagcttctttgcttttgagccctttgctgttgactctacatttgtttttggaaactccaggtctgccattggccatcagaataccttgatcttgactttgaccttaggcttcatttatttctatccaggtaccattaaacaggttgaagccaccacgaagttgagatttcctacacacaaaatgttcttatgagcaggctgggcacggtggctcacgcctgtaatcccagcactttgggaggccgaggtgggcagataacttgaggtcaggagttcaagaccagcctagccaacatagcaaaaccctgtctctactaaaagtacaaaaattagctgggcgtggtggcatgcacctgtaatcccagctactcgagaggctgaagcaagagatttgcttgaaccctggaggcggaagttgcagtgagccgagattgcaccactgcactccagcctgggtgacagaatgagcccctgtctcaataaataaataaataaataaacaaaccaataaacaaataaataaaagttcttatgagtgatcatctctttgaggaataagggaaaggccattcttataaacaattcatgttttattatcactggtcttctgttttattgcatatttgatgggcaagtgaagaagaagaccaaaagaattttggagaaatgcctcgtgtagatagagttagtagttagagaaatcaaatgagagagaggaccttatttagaaatgaaagtctacctgggttacctagatatattagagaagttttggtttttcacttggtagaatactggtaaataattctttcctttccctttaacatcttaatgtgaattttattgcaattttcttattgggaaaatcaaagtaaaaccataagaggttgtgggtctcgtgaaactctacttaacataaagcagaaagtattgagatacacggagaagctctgaggggctcagtgggtctctctttccctggactgtgttacatgcatgaattcacactggaattccagatacagcatcctttttgttgaaatgcttttcaggcaggctctgtagggacctttctcagaatcaatgactggtgacacctcttcgtagcctgcacttatatttggaatccatataacctccttgcatgcaaatacacaaagatggaaatgccacatctagccgtaattaaagagagtgaaaggtggataattgctgctgtaatcaattgtgtttctatgaaaatgcttaggcataattttaccaaattaatattacagtaactatgtacttgagtcaacttctactcagttcatttgggtttaaaagaaacacagagatgagccagtttttaccgagaaaggcacacacagtaatatttttagttcttacagctggtcatgaagaaaagaggttctggattctatgatccaccttgaaaaaaaagaaattctagtttctatggggaaaatttaactgctatggagaaattctaatttcttgggggagaatgaggtgccaaagacaggaagggaggaggagttcagacagaagacattcatgcaggaagtacaacacacacacacacacacacacacatgcacacgcacatacattcacacaaacacaagaggagtagggtggacacttcaataaaagcaaggactagaatgaaaaaatgcagacctggcacggtggctcttgcctgtaatcccagcactttgggaggccaaggcgagaagattgcttgagcccaggagtttgagaccagcccgggcaacatggtgaaacaccgtctctacaaaaaatgcaaaaaaattagctgggcatggtgacacatacctgtggtcctggatagtcgtgaggctgaggtgggaggatcttctgagcttgggaagttgatgctgcagtgagccaagattgcaccactgcactccagcctggctgacagagggagactctcaacaaaacaaaaaacaaaacgaaaaaatgcagaagaaaaatatttgtataggatagcaaaaaggagcatccacttaattgaaatagccatagtatgccaaaaagtttacaggtggtgaagacagattaaaataaagcagagaaagttgttagcttgggggtggtcctcataatatgcagacaatcaaggtaagttgctgtgtgatgataatggaaatgtggatgtgaaggtcaacaaaaaacaacgacatcacctgttttgcaattgcccacttctggtgtctaatggtcaccaaatgcttccataggcaataggagatgaagggtgggtgggaaaaataaaatggcaataagaaactatccaaagacatgagggtaacctccaggcattgctgagagtgagggtagaaaacaacagtgctaaaatgcacacatgattaccattttggattctcaacaaagactggggttttcatttgtaaagactgttaactaatgtgctcttgaattccgtcatccctgctgcccagatctcctgcactgccaaaaatttagccagaaaatccgtgcgagtcatcctgctagtctccatagactagaaataaaagttaacttgttccaaaacttttctaattagattgattgaattgtactgtgcctcaaagtcatttcttttccagctcattaagctcatcctataaaaacatatgacattgttcatattcattgcaagtggattaattatccagtatgaattgtaggttccaaatgcattgaatcatatcatcatggtgggtgtagttttttaaaatcacttccaaaagagagacatttatttttgtcggtttctttgagcctctcctcatctaaatgctgtaaagacagaaaaaaatcccgacacaatttttataactagtgtaagtatgttgataaatcccacgataattccctccactgttattagttaagaattaaactttgttatgcaaatgaatcaatattgagacatacatgtcaaatagggaacaaaatgtcttaaaacttattttttctgcagagttttctttttccaaagtgtacaaaagtctatcattcttggatgttttcttaagtttattaataactttgaacaccacctttatcgatttttagaattgttaaccaggatttcttgacaaacaggttatgctgatttgaatcaggccatcaattgaaaaaaatgcctaaagttttaatatttaagtgtgctgaaataaactggtgtcaccctaagtaacagagaaagcctctgtaaaagaaaagatatttatttgggaatgtagcattgcagtggaaattcgcatgccataggaaactatgtgcatatttggtgggggaaggaagacaaagattttttgtaagagaagtattacttaattgttttgaaataattatctgtggctacaaagatcgataacaaagatgggacaggcacggtggctcacacctatagtcccagcactttgggaagccaaggcaggaggattacgtgagcccaggagttcaagatcagccagggcaatatagtgagaccctgtctctacaaaaaaaaaaaaaagaaaagaaaagaaaggaaagaaacaaagacaggaaagaaagaaacaagcaaaaaataacaaagaaaggagagacaaaaaagaaagaaagagaagaaagaagaagaaaggagaagaagaagaaggaggaggaggaggaagaagaaggaggaggaggtgggggaggaagaggaaggagggaaaaagacaaagaaaggagagaaagaaaaagaaagaaagaaaagaaaaagaaagaaaggaaaaaaatagaaggaaagaggacagacagagaaaaaaaagaaagaaaaagaaagacaagggtgaaaaaggaagtgtgtctttctcaggagagtaacaggaagtgtgtcctgcacaggacaagaatagaaattgtgtgctgcacagggtaggaacagtaagtgtgtcctgcgaagaagagacacaggaagcgtgtctcacaaagaggaggaacaggaagtgtgttctgtacagggagaaacaagaagtgtatcctgcacaagagaggaacagaaagtgtgtgctgcacaggggagaaataggaagtgtgtcctgcacaagggcgacacaggaaatgtgtccagtgcaggggagacacaggaagtgtttcctgaaaaggggaggtataggaagtgtgtcctgaacaaaggatgaacagaaggtgtgtcctgtacaggagaggaacagaaagtgtgtgcttcactgataggagtaagaagtgtgtcctgcaaaaacgaagtgcaggaggtgtgtcctgcacagggaaagaacaggaaatttgtcatgcacaggagagacacaaaaagtgcatcctacacaggggagaaacaggaagagtgagtctcatgagagtaacaggaagtgtgtcctgcacaggggagataaggaagtgtgtccttcacacgggagacacaggaagtgtgtcctgcacagaggaggaacaggaagtgtatccttcacaggggagatacaggaagtgtgtcctgcacagagtgggaccaagaagtgtgtctcaggagagtaacaggaagtgagtccttcacaggaaagacacaggaagtgtgtcttgcacaggggaggtacaggaagtgtgtctgtctcaggagagtaacaagaagtctgtcctgcagagggaaggaacagaaagtgtgtctgccttaggagagtaacaagaagtctgtcctgcagagggaaggaacagaaagtgtatgttccacaggggaggaacaggaagtgtgtcctgcaaggggagacacggaacgtgtgtcctgcacagggcaggaacgggaagtgtgtcttgcacagaggataaacaggatgtttctcctgcacatgggagtcacaagaagtgtgtcctgcacagaaaagaaacaggaagtgtatgccatacaggggagaaagaggaaatttgttttttacagaagagaaatagaaagtgtattctgcacaggggaggaacagaaaatgtgtccttcacagggggacacaggaagtgtgtcctgcacaggggaggaacagaaagtttgtcccttacaggagagaaaaaggtagtggcccatgttggtctcgaactcctgactcaagggatcctccagccttggcctcccaaaatgcaggaattacaggcataagccactgttcctgaccctcagatcatttctttatggccagtttttacttggaaaggcaggtggagggaattagagttatatttttaggttttatgcttggctttggggaaaagggggtcttgtttctaggactcgccttggggaggagggtttctaatttctaccgtgccttgggtcagagtgggactgagatactcaagatggcgagtaaagtgatgtctgatcgtcctcactgctacactcctaccagcgccatgacagtttacaaatgccatggcaacgtcaggtagttaccccatacagtggaaaaagaggagacaggaataatccaccccttgtttagcatatcatcaagaaataaccataaaaatgggcaaccagcagccctcagggctattcttgtctatggagtagccgttcttttgttcctttactttcgtaataaacttgctttcactttactctatagactcgccccgaattctttcttgcgccagatccaagaaccctctcttggggtctgtttcctggacccctttcctgtaacaatatttgttcaaaataaatctcttcaaatattttacagactttgactcttttcattgacattcctgtgagtcaggggtgagaaaaataatgacgtttttgggaagagagaaaaaacctgtacctgatggaacacaaggatttgttttctctctcatcctgggcccgttggctttttaagtatagctaccccaggtatttgtgcgtgctctctctctctctccttttctttctctctctctcatacacattccccccttttccttccccccttcctttttccctctcttttctctacctgtcttcctcccttgtctctccttactttctttcttctctctctctgcttctcttttctccctggtctctctctctctctctctctctccctctcttcttcctatcctctctcttctctctctgtctctaactttgtttctcatattctcttctctctctctccactttttctctcctttctgacttccttactctttctttcccctctgtccttctccttttcttccccatctcctcctcttcctcctttcttctccttctttcttcttctctttctcctccttttcttttcctctcttgtcttcctctctctttctctttctcttcttttccctctctcttctctctgtctctcatttttcttattctctctctgtctctctctgtcttcctctctcccgctcacctctccttttccattaaagtctgcaaagagttcccatttcttctagcaattgagatttctagacatcaccagggtggctcatatataccctaggatgtgattacctatttgggctgttgaaggagtgaaggatgtgccttcccaaaatatgctggattggtatcttgcatattttgagttgaaaacactagagaaattgtagtttcagaaagtgctagccgacctgtttcttcctgtaggcagcaagccataaagattcctttgggaggggactcctccccgtaccagggtgagaaaatagctctcatcaccagagactgggctttggaacctgcagtggacctcaacaaatgcacttcccactagtttaacccctcctatatatctccttgtgactttcccagaaattcactgcccctagccagatcccctttgtttttcatttcttctcaaatttgtcattctttgtttaaaaagcataaaagcatcttggtttggtcacctctttgaacatcacgcttaggaagatccccatggtccgtggaaaatgaacaaaatctgtatgttttcctttgttaatctgcctagcatcgacttggtttctagttgcagctacagagctcactaagagctaaaggaggttgaaggggacctctggctccccctcccccatgccatgcacacaagggagctgacccactgaccccctggacgactcatggacagctcagtgggacgggagctttggaggtcataggagtgtttatgcagaccccagagtggcttcctaggaggaacaggattcagcagatcaaagtttcccagcatctgtgatagtctgaggccagcaggagggaaggaaaacaaagactctcaaccccagccccaggtgtcatgaacattcatgggggagaaagggagcagagagtgttgagtctctgaagaggggacagtggaaaacagctctaagcagaaattgccggcttcacttcacttctgtgccttttccctctgctgtctcctgaattacatttgtttttccacaaaagaaaaagaaagaaagaaagaaagaaagagaaggattcttctgcctttggtaaccatgcatgagaatgttcacatttcttcttctcttctcctccctctccttttcctctctcctcctcctcctcctccctcttccttcttcttctttttcttcctcttcttcttcttcttcttcttcttcttcttcttcttcttcttcttcttcttcttcttcttcttctcctcctcctcctcctcctcctctccctcctcctcttcctcatccttcttcttcttaagacagggtctcactctgtcacccaggctggacaatcatagctcactgcagcttcaacctcctgggctcaagcaatcctcccacctcaacctcccaagtagctgggactacaggtatatgccactacgcccagctaatttttgtattttttttgtatagataagaccttgctatgttgtccaggctgttcttgaactcctggccttaagtgatcctcctgcctcagcctcccgaagtgctgggattacaggcatgagccaccacacctggcaaggatgtctagagttctaagagcctgtggacaagctctaagaagaaatctcttttgttctctggcacaaattgccacaggtcccttttcccacgacttatgtttctgtccttagcactaatggtttccaccttgtgaggggtgaggctgttttctcccaaccatatgggaatatgcatgttaggacttttcgtggtataagctctaatgggatttccaagtaagaaaaaatttgctagtctcaggattttagttttgttgttacaccttttcacgtttctgtggggtggtgaggtaggaggaatgtctctttttcccttttaatttttgaaactgccttttcttctttttaaggatgagtgttcacaaattgtaaaaacttccatgaagcatgaacaaggtgagtcacagcctcgtgagtctctatagttgccagcgttgactgaagtgattgtagggagagtaagagcacctgtcttcatcccttactgctccattctgaaagctccattttattttccaaaaatgtaccccataattcactgctcccttctccattggagccttgcagtatcaaaacataatttaatatttttgccactgtggtataaaaaaagaacagacaagtctgtgagtttgcaaggacactggactttttactctttccaatgcaacttgggagactgtcatctggattaggatgtgggcaaaatttggttttcatctctcgcaggggttacagaccttgggatcctggtaaacacacatagactctcacacacacacagtcacacacacacaaacatacacacacacacacacagtcacacacataccacaaacaatgtttttttctgcaagagacacttttctgttttattattctttttattgcttgttttttattttacttctattttcccaccagaaatagtggcttcaaagccataaggttaacacttgaaaaaacaaaaacaaagcatagagaacggtgcaaatttgattcatttttttttctttcaatcttccaaagtggatgtagaagggtataaaataaaagttgaggaactaaagttttcatcaaaacctgtggtgttagggtgtaggtttttattttattattttattttcctgaaaagagttaaaggaaatagtttttttctgggaagggtgaagtttctgtgagtgttttgtgggtttagagattgaataaatcaggaagacaacagatgtttggtgtgattagcaggtctgattgaatggaaccagctttgaagtctaattgaagacatttgacattaaaacgccaagattatttaggtgcttcacaaaataaaattaaaaatgagacccagtaaaggaaaaatacataatatgaaacatttgttggccaggtgagagactatgctgatgaaattattattggcatccgaagactccactttgattgaaatttatttaaattttccattctactcagtggtgttctgctgaaaacagtaaaaatttgtggaatatgaaaaataagcttaagtacctttttcaaaatcagtagatgtgactagaagaatttaaaacaagatacacaattaacaactatttggagaagaaagatgaagagggaggtgaatgggaaatgaatttcttatatttcagatttggaagtcaaaacatcctgcttaaaagagattggcatataaatacagctatcttgcataaaatttcagagactatcattcaagaatttaaaactgcctgggtacggtggctcatgcctgtaatcccagcactttgggaggctgaggtgggcagatcacctgaggtcaggagttcgagaccagcctggccaacatggtgaaaccccgtctctattaaaaatacaaaaaaattagctgggcgtgttggtgggtgcctgtaatcccaactactcaggaggctgaggcaggagaatcacttgaacccgggagacggaggttgcggtgagccaaggttgcgccattgcactccagcctgggtaacaagagtgaaactccatctcaaaaacaaaacaaaacaaaattaaaaactgaaaaggcaaaagggatttctatgacctcccatttgaccatatctagaaggggagagggaaatactttccacatatttttacctttgtgaactattgtgtttttatggctgtcttgcaggtatcaatgtttcaccttggaacagggaaccaaaatagtacataaagctctattatcacatgatccagcaacctcactactgggtgattgcccaaaggaaaagaaatcattatatcaaaaagatccctgcacacgtgtttatcacagcaccattcacaagagcaaagatatgaaatcaacctcagtgtccatcagtggatgattggataaatcgaatgtggtatatatacacaatggaacactacacagccatacaaaataaaatcatgtattttgcagcaacatggctagaacgggaggccattatcttaagtgaaataactcagaaacagaaagtcaaatactgcatgctttcactaataagtgggagataaataatgtgtccacatggacatccagcgtggaataatagacattggagactcagaagggcaggaggctgagggggtgagggatgagaaattatttaatgggtacaatgtacactattcaggtgatagatacattaaaagcccaaactttaccactatgcaatatatccatgtaactgcacttgtatcccttaaatttatacaaataaaaaaaataagcttctacatatactttgcaccaacccattgtattttacttcccatcagtagaaatacaattctctcttttacttgaggtaaaaaaaaaaaaaaaaaattcgttgttgttattgtttgttttgttttgtttctacgatgagaaataccagttcatggcattgctgaggggaggctacatgaacagtaagcagtcaaagctgcaacaaatagaataattaataagacttggtctacccaaagagacagcaggacccatgatggagaaggtgcgtgtgaatgaaatcaccccagcaaggcgtgtgcattggtttcctggagggctgccatcacaaattactacacactgcatggcttaaactaatggagatttattctctcagccttctggaggccagaagcatctgaaatcaagggatcagcaggatgggttccttctggatgctctaggaaacactctgtttatgacacttctgcttctggtggttgccagccattcttgacattctttgacttgtagatgcatcactccaatctccatctccatcttcacatggtctttttctttatatctctctgtgtcctctcctcttctgtttatttattttttcgagacccggttatgagactggctaatttttgtattctgtattttttgtacaaaagatgtttcaccatgttgcccagactggtttcaaactcctgggctcaagctatccagctgcctcagcctcccaaagtgcttggattacaggcatgagccaccacacccagtcctcctctcctcttcttataagggtgtcagtcattaaatttagggcctacttaacctgcaaagattctacttcccgataacgacacattgtgaagttccagatggccatgaattatgaattatcagtggagaatactacttagctcactacaacctgcaaaagtgcaagaacacaccttctgtaatcttctgtgaccagaggagggaaagagactcaaaaagattggaagggctgaggctgagaaatggagtgaatttcctatgggtgacttttccatttccaggaagtatgtggtaagattatgaaggggatcagaatatgccaccccaaaatatgacactttggtgcaagcattattttgagctaaaggctactgagtaaaagtagacacaggacaagctttctaccctcccactttctgcttaaaagcagggcatatgttttccatttgaaaagaaaattcatttgtaaagaaaaatttcatttataaaggtgttctctcatggatgattccagagatagagattatcacctgagatgacttgagtctatataataatctatacttaccaggcattttctagtcaccttctacaaacttacccctatcctagaagcttaaattccatttgcctttgtctagttctttatctaaactttgtcgccctgtgttaagatggtatataatcccctaggcccaagcacctctttggggttctcacttcttttccatgtgtctctccacgtgcacacaaaataaaccatttcttctgtaaacttgtcttttgtcagtttaatttgctgttctcagtaactaaatcaaaaaacgaaggttttatttttcccccttttacagttacctattaagagtgtgtttgtgtgttggggagatgggaggttggtgggattggcagtggaagggtctaatgttagaagacagcagagagttaaacattgattttgtcaatggcaaagagcaggatgacaaggcagtttggagacctggttggaattagggacctaactgtgctgtggcaccagcattgttagtggagaccagccccctggataggaaggggatctctggcatttgggctcactcctttgagtgagctaccatcattatggtagttttctaggtaaatgtttgcatagacaatggggcaaataattaaacattgtggagaattcctcaggtgttggaccatggaatttaagttgggtgggtagcaaaatggaggaagcagcactagtgaagaaggattaggcaaaagagtcaatgaattcgagagtctacctttgcaaatatggttgtgtttttctctctcctttcaaaggattatcaacatcctcatttagcggtattggtatgagcaacaatatttcctagcacaatctgtgaagtattcagtctgaggatgacttcagcaagtcaagaaaccttagaagaacaaacattttctttttttgagacagggtctcactgtgtcattcaggctggaatgcaatggtgtgatcctggctcactgaagcctcaacctcctgggctcaagcaatgctcctacctcagcgtcccgagtagctgggaccacaagcgtgtgtcaccatacctcgctaacgtttgaatttttgtagagacagggtttcactatgttggccaggctagtctcaaactcctgggctcaagcaatcctcccacctaggcctctcaaagtgctgggattacaagtatgagccaccatgcctcgccaaaatttgtctttaaaaccatctttaaccatatgacccgatcactccatttcctaggtatatattaaggagaactgaaaacaagtactgaagcaaaaacttggtatgcacatattgaatgcagttctgtgcccaagacacggaaggtggaaaccaccccaaattccatcagtggttccatgaataaacagaacgtgggccatccagacagcagagtaccattcaggggctgggggaggaaagaatggaaatgtctccttaatgggtacgggatttcttttgtggtgatggaaatgttctggaactaggtagaggtaatggttgcatatcattgtgaatgtgcgaaatgtcactgaattgttctccttaacatggttagtttttcttatgtgaatttcacgtctataagaaaaatgaaaaaataattcctctctgctctttcttgttatgagtatatacccaaaggaatagaaatcattctattataaagacacatgctctcttatgttcattgcagcactattcacaataacaaagacataaaatcaacctaaatgcccatcaatgacagattggataaagaaaatgtggtccatatacaccatggaatactgttcagtcattaaaaggaacgcgatgatgtcctttgcagggacatggatgtagctagagtccattagccttagcaaactaacacaggaacagaaaaccaaatactgcatgttctcacctataagtgggaggtaaatgatgagaacacattgacacatggaagggggaatacatactagggcctgtcagagggtgggggatgggaggagggagagcatcaggaagaatagctaatagatgctgggcctaatacctgggtgatgggatgatctgtgcagcaaaccagcatggcacacgtttactcatgtaacaaacctgcacatcctgcacaggaatccctgaacttaaaatgaaagttgggaattaaaacaatataaagaaatattccatattcttaaaaaaggaaaaataaaagaaaacattttgatacatattaaatggtccataggatcacaaatatgctatctattacatgatttccctactagtgtttctgcggaaaaacaacttctgaatgaaacaaccggaaaagcacaatcttcaggcaagacacgtttgacaggggctttttctgtcactttgttcagaaaatagttttgtccttgaatattatagggaggacagttgaaacataaaatgaatggttgttaaagtgcagcataataaaatctttcattttatacattgctgtctaaactcttgaatcaatactttacattggaaggttctaccttagagaattaatttattctaactgtactgtaaaataaaaagactggggacccaactaagaaaaacaaaattaaccagccaatttatactgtcctgaaagtgaaggcaaccaagtatttctgccttatccctggaggttttatccaaagggaatgtattagtccattctcacactgttataaagaaatatctgagactgggtaacttattaaaaaaagaggtttaattggctcatggtcctgcagggtgtacaggatgcatggcagcttttgcttctggggaggcctcagaaaacttacaatcatggcagaaggggaagctggtgtcttacatggctggagcaagagggagagagaggcagggagatgctacacacttttaaacaatcagatttcatgagcactctatcatgagaacagcactagaaggatggtgctaaaccattagaaaccgtccccatgattcaatcacctcccaccaggcctcacttcccaaattgggggttacgattcaacatgagatttgggtggggacacagattcaaaccatataattccacctctggcctctccaaatatcatggtcttctcatactgcaaaatacaatcacgtattctcaatagtccccccaaagtcttaattcatgccagcattaactcaaaagtccagtccattgtctcatatgaaagaaggcaagttccttctgcctatgggtttgtaaaatcaaaaacaagttagttacttccaagatacaatgggagtataggcattgggtaaatactcccatttcaagagggagaaatctgccaacagaaaggagctacaggtcccatgcaagtctgaaactcagcagggcagtcatcaaatcttaaagctccaaaataatctcttttgactccgtgtctcccatccagggcaccccagtgcaaggggtgggctcccaaggccttgggcaggggaggtctcagagaaaaaatcatgctgcagttaccctctgtgtgaatcaaagaaatttattttgcttttttttttttctaattttctcattatagaccttattttaaagctgtgagttgaacactggttcactgtgtgggaaaaaactgaagaaccctatcaatttacacactttatagggactgcttatggagccccttgctattctaaccacccggaaggtaggatctcagtggatgaaacacttggaaaaacaaatcattattctttcctattcatgcttatgttttgtttgaataatgattttgttttacttacaggttttttttttttaacttggctttacctacggagtcatttataatgtgtcagacatcctcgttcaatgggaagtctgctgtataggactcaatagtagttgctcaagaaggggaagttaatagtgtgtcagaagtcagtgagaagccagacatcttcctcccccatggagaggcacaattatatgcaattacatcttccttttcatgcctagggaagtcactgatatatccactcataaaataccagactttgggtgtctatttagaagtttttacagctcaaaaacaaattttaaagacagtctcaaactcaatgtcttaggaaggtcaaccttaaaatgaatagaagaccttaagttgtaaaatgtagggctcatttaatttatagccatggatctgtgtatttcagacacacatggggaggagggaaagtacaatgtcatgcagggctaagaatcacctagtccaagaatcccgcaaaacctctcaaccttgttttcccaatggccaatgttgctgtgaacatgaaaattgaggcagtttcaggcactcactatagtataaattgggttctcttgcaggcaacactgaggccagcattctgaatgtgcaactttggactaagcacattgcacatttaggaatgtaatctaagcaaatactttcagttgtggatgcaattatatttattgtaatgttgataacgttatagtaaagaaaaacaatgtgaatatatgtcagtgagagattggacaaatcaccttgaataaatatatgcaacagcatattatatagctgtgaaaatggacaaggtatttatttacattgtcaaatgaaaagatgatagagaattgagtagcaaagtagttccaaatagtatctgtaatataatgtcttttatgttaaaattacatgttaatagatgcactaaacattttcccagtgaaatggtatatgttgctataactgaagttacaagaatgtaaagacatggaaaggcttacatttgttcttaccctttcatgcagtctgtatttttatctatctatctatctatatctatctatatctatctatctatctatctatctatctatctatctatctatctatcatctatcatctatctatctatctgtatctatctatctatctatctatctatctatctatctatctatctatctatctatctatgtagagaccgagtcttgctatattgcccaagctggattcaaacacctgggctcaagcaatcctccagcctcagcttctggagtagctgtaattacagaggtgcaccactgcacgtagctattttttaaataataaacatttttaacacatttatctaaaacatagtgagaaaagaaaacagagaaacataatatttggaatactggggaatagcgtctgtcacttctgtcctgtctgttgctattttataaaaagccttaagaaccagcagtttacacgtagttttcaggcaatcagacatatatctgctatgagaccattttttaaatgatgaaataactgtgtgcgtgtttgtatgctttgtatatcagtttacagcagatagctattcaattcttctttgagatgtaaaaggaaaaaaaaacttccccaaggtgttgtgttacagactgaatgtctgtgtcttcacaaaatgcatgtgttgaaatcctcccttcaaagtgatggtgttatgaactggggcctttgggaggtgatgaggtcatgaggatggagcctaatgaatgggaagattgcccttataaaagagaccccagagggttccctcaccctttccaccatgggaggacacagtgagaaggcgccgtctatgaactaggaaatgagtccttaccagacatagaatctgccatgccttgatcatgcgtctccagcctccagagctgtgcatgatcagtgtgttatttataagccatccagtcttaggtattttgttatagcagactcaatggacaagaaaaaaaaactttggcttcaagcaaagtgagcttgctcctctgtccttaatagacacaaacaaatggacaaagatgactgcatcatcccaacccataaatcaaagattttcaacccagaagcaaagatccaactgacataagcaaagctcctgtctgtacagggataaacagaaagtgtgcagatcacaggtagcctctcctatttgtgcaaacccctttgtgaaactccacagattcatggcagaatcatcactttggtaaccaaaaggaaccttgcaatttgtacagtaattcatctataggtgcattctgacaaaccaagatattcttggcattgcgcttgtcattgtccatccagtgaagagcaggatggattcatcaactttcatgagctacatactagaagaaagcgctgagaagttagtgggcattggctacccctggtacaggttgcatggggatagatgacatagatgtaatcttaaggtgggaatggagtgatcagaggaggcttcctgatgcctgtgcaccttctgagcccttgccgatgaatgacaagtggaaaggctaccttgagcaaaagaagaagggagtaggggttcctagcaggaaggtggggttcctgcttggggtttctagcagaaagatgccccagtgccttggcttataggcaaaaaatagcagatattggggaactaaaattggttagcattggctggtgtgcagcaggtactgaagaggcaggtaacagtggtcaggtaatgatgaatttacagatgaaggtgtggaaataaatgaaggccacccacatgaaaacaagcaaggtgtttattcagagcttgctgtagcaaaggaatcagccatcatcactcacgtctggccgagattcaaaggccggcagagccatggggaatccttatagtggggaaaaagggaaaacttaggtgtgttctgattggaggcagttggtggttcactagaagtgaggcatcctttgtgactggttagggggaaaatttgggtttctctgtttggtcctgagttggaagtaggggaaaaattagggaagctcatagttattgatcaagttctggacattttgggctggttgctacagggcttcctattggcttcctggatgagttactacagtttataggttagacctctctctttatatatagtctagtcaccgtccatttgtatattacttctctcaatgataaggatttgagaacatatgctaggaacaatagttatttaagtgttttgacctcagggaatttttattctattacttgtttcgtcattctttctcctgcatcttttcatttttttgcacactgtgatgtgtgagtatcgcattgctgctctcccaaatatgtcattcaagttttttgccttttcctccatggtttttatttctgtattgttactctgagtttcagatatttcttccatttactcttctagttcagggattggcaaatgctttcagcaaagggtcaaatagtaaatgtttttggcctggggagccattcagtctctgttgcaactacacaactgtatcattatactgcaaaagcagtcatgcacaatatataaatgtataggtgtggctgtgtttaaataaaactttatttacacaaacaggctgtgggccagatttggcttttgggacaaaattttatgacttcttttctaggttacttagttaagtctcaacagatgtgtccctgaatcagtgaatacaatgacaaatacaaatgcataatttgttaaataaaattgtataaagtatatgtgtgtgttatatctccctaaatactctgaaaggcatcagactatgtcatctccaaatatgccactttggtgtgagaattatttttagctgaggtggaaggatggcttgaacccagaagttcaagtttgcagtgagctgagatcacatcacctcaatctagcctggatgacagagtgagattctgactcaaaaaaaaaaaaaaaaaaaaagaaaagaagaaagaaagaaagaaagaaagaataaagcaaaataatagaggtgcagaggagatgcaaattccacatatggtcagataaacttgttgaatgagaaacacaattttccaacttagaaaataatgaaatcgaaagttgaagagggtgtattcaccgagaggaagtgggagagtcaatgactggcatttccatgagttcagatggcaggtcctgtggggatcactgagagctggaattgcaggaagagccacttgtgttgtgcgtcttgagtgatgacaggcaaatagtggttctggaagtgccttatggaatcaggatggctggggaggttaatcatggaactgggaggccagtgtgtccaacacgttatgcatgcagaaggggagactctgatggggttcagcacacactaccccaaaatacagcattttggcatttgaaaaaaagaaaacaacaacaacagcagaaggagaaaacctactctcacctatccctcagccctttccctcagccctttcccctgaaacatgttgcccaggctggtctcgaaccccaccttcctgctaggaacctctactcccttcttcttttgctcactgtagcctttccacctgccactcatcagcaagagttcagcagatgcacaggcatcaggaagcctcctctgatcactctgctccctgaagcaagtcaagaaaccggggaagagttctctaacctttccctgaagcaggtcctaggaccttgattcaagaagtgccctgtctatctccagagagaaagaacatctttatttctgaagacacagacacagagaagaatcctaacatgcagcccttgctaggttccccccaccccagtttattcccgttagatcacgccctgttgtccctcaatcacacttctgtgtgatcgcccacaaaaatatagttttctggctggtcatggtggctcacgcctctaatcccaacactttgggaggctgaggcagggtggattgcctgagttcaggagttcgagaccagcctggacagcatggtgaaaccctgtctctacaaaatatttatatataaattagccgggtgaggtggtgcatgcctgtagtctccactactcgagaggctgaggtgggaggatgatttgatccctggaggcagatgttgcagtaagccaagattgcaccactgcactccagcctgggagacagagccagacactatctctctatatatagttttccctgggtctttaggtttttatcctaaaagctcctgtatcacatacaatttatactacgtaaatatgtatgctttcttgtatctggctaatctgtcttttcttatcagggtctcagccattaaccttgcgatgggtgaggaaaagatcttactttttctctcctacaatgtgtaggagttagggagtttataaaccgtgcaacaagactacggaggagacctgaggaatggaacgccctctgaagagttgcctcagaggcagagacaacacagagcagaacggacttggggattgtgggtgggactaggggcatagactatcagaggcaagtgatgaggttactgggtgtgtggcttatctagagaactgctcccagagagtatgcgtttttggggaagcacagggctaaccaagatttgcactctttgtacctcagaaggctttctgggctctggaaatggagcgaatcagctgaatctgtgatggccattctggctccagaaagagactgcatgtccaagttccctagtaagctcctggggaattaccaggatctggctagagacagaagctgcccctcttggtgaccttgagactcgttgcctcctagtattttgcaggacagaaatgtgagctgcctttgtgtcttgctgtgtagggttattttctgcaaattggctgagattggcgtggcacctcccaaaacttcattttgaggactctccccaaagactggaattcccttagcaaagatcattttttaatgcaaaccatctgcttcaatgaaaaagaaaaagaacaagaaaaagaaagaagtaaaaagaaatcatgacctcagttttctgcaaaacagacgaatccttggttttcaccaaaaggcaaaacgctaattaatttttaaaatgctgacctcctttgaattattttagtcctttagatgaaaaacatgtgtcatgattgcatgtgtttttattcttccacaggcttggaactctgggtgtttggggaggctttctatatgcctcaaagcccttaatacctcattgtgaactggcatctcaggttacttctctcatgagtgacagaacaaagacctgcattgtgagcaggggagaggcaagggtgaattttaaagcataaagtggttgaatttagaggcagaagaagttggagagggggagagaaatttacttagtttataaatttgtctggagctggccaacgtatgccaattatatgaccagttcaggtagaagtcagacctagaaaaagaagaaaaacaatatacaaatgaacacatgtgaggtgatattagagcattggcaatggggatttaggggctatggttgattttaagagtgtgtgtgtgtaattggtgatcaagaattattggtactcaaaaataatattaattcacaatatagttcgatttgaataaagagtggcttgtgatagggaggatatataacttacttctccttaagcttggcagttatattgttttctgggggaaaaaaccagtagaggtattttagaatagggtagaaaataaaagtagagtcctgaaagtagatctatgccctcaccacacacaagcatactcctttgtaacacatctccacagtaactatatcttcttcacaaggaattaaatgagaagaaaaccatagactactatgcacacacaagctattaatatcttctttctgcaatttttacagattttctcaacaccattgatttataggatcgtgagcaagaagcactgatggccatgaagatgaataagcaaggaaaagtggtcttagttagtgaaattgatgatgatttcatgtcttctttatcataggggatgcctaagttctacaattcatattatcagatctgatgaattagaaactcatccacttcttgcttgcactagaaaaaatgccagacactgtgaggccaagcaaatcatgactaactaaaatttttgaagaacaggaactccaacacataatgagatcatgtttggttttcccagaattgttttttgactaaatggaaagcaaaaagaaaaaggaatttgttaaagaagctacaatgtctacatcaaagccaaaaatacttggagctctaaaaatacacttaacattttaacccagggggaaacgtttgtctttcaaaagtgaattagggctgggtgctgtgtctgacacctgtaaccccagcactttgggaggcgaaaggctcacttgaacccaggagctcgagagggcaacatggcaaaaccccatctctacaaaaaaaaaaaaaaaaaaaaatagctgaccatgaaggtatgtgcctgtaatctcagctacttgggaggctgagatgtgagatttcacttgagccctggaggtcgaggctgaagtgagccatggtcataccactgtactccagcctggtcaacagagtaaggctctgtctgaaaaaaaaaaagtgaattaggaagatcaatgatttaagaaaataaaatttgactgagatttggggaatgtgcattattcagaaaaaaattgcaaaatgttattccgttgtaaagatatgctggtgttatttaaatattaacattctcaaaggtgctatatcttagaaaaagaacaggaagagtgctttcagggctgaataatggctttggcaatttgaactgatcaaattgaccagatagttaccaaacttcacctgattttgcacgtatatgtgatgaccatgtccaggaaaactggaatgatggaactatctatcatatatatggtagactctatgtccacctgggccactggccccaggacatatactatcatacatacagtaggctgcacttccacttggaggcctggaaaggggacaggtattattatacatatggtagatttcatgtccacctggaagagtgtagccaggacatatactattatatataaaataaaatccactttcggccaggtgcggtaactcacgcctgtaatcccagcactttgggaggccgaggtgggcagatcatgaggtaaagagatcgagaccatcctggccaacatggtgaaaccccgtctctactaaaaatacaaaaaattagccggacgtggtggtgcacccttgtagtcccagctactcggaggctgaggcaggagaattgtttgaaccagagaggtggaggttgcagtgaaaaaaaaaaaaattcactttcacccgaaggactggagccagggcatatactagcatatacacagtaggcctcattttcacccgaagtattggacccagtacgtatactgctatatatatggtaaattccaattccaactggaggatggcagggggcttatattatcatctatgtggtagatttctttttttttaatatatattttatatatatatatttttgagacggagtctcgctctgtagaccaggctagagtgcagtggcatgatctcggctcactgcaagctctgcttcctgcgttcacgccattctcctgcctcagcctcctgagtagctgggactacaggcgccccccacaaggcctggctaaatgtttgtatttttagtagagatggggtttcaccgtgttagccaggatggtttccatctcctgaccttgtgatccactcgcctccgcctcccaaagtgctgggattacaggtgtgagccactgcgcctggccatagtatatattatctgtgtatgttaaacttcccttccacctggagaactgaagccagggtatatattatcatatatatggtagactcctcttccaccaggaggacccagtgtgatgggtaatactgaatgtcaacttgattggattgaaggatacaaagtattgatcctgggtgtgtctgtgaggatgttaccaaagaagattaacatttgagtcagtgggctgggaaaagcaggcctccccttaatctgggtgggcacaatctaatcagctgccagcttggctagaatataagcagggagaaaaatgtgaaaagagagactggcctagcctcccagcctacatctttctcctgtgctgggtgcttcctgcttttgaacattggactccaagttcttcagttttgggactgggactggctctccttgctcctcagcctgcagacggcctatcgtgggactttgtgatcgtgtgagttaatacttaataaacttccatatatatatatattccattagttctgtccctctagagaaccctaatatacccagggcatatattgtcatatatatggtagactccccttccacctggaggactagagccgggacatatattattatatacatgatagactccccttcctcctgcagccaggacatatattatcttacatacagctgtagactcatgtccacagtgacatcattaaatccacccagtgaggttttctactgtagtgttgactgcatggggatttggtcagcaagtccccataacctccaaatctactggatgtcctcccatgctaaagctcactgacttggaaaactctcaagttgtgaaatagattcatataaaaatggaccctccgctccacatctggaattccataattctgaatgtgtcctccttttcaggcacttccttggaccatgttttgaatgccttgcctgcacagcttacctcttccttggacactgccagtgctaccatatttgagatgatgggtcggtcgtttttgttttgcagtggtagtcagggttctccagagaaacagaaacaataggatatagaagtacgtagagatttgttttatggaattggcacacgattgtgggagctggaaagtctaaaatcttcaagacatggtggtaggctggagattcaggtaagattgatgttgcaacctcgactcctaattctgtagggcattgggccagaaactcaggcgtaatttctataccttagtcttgaggcagaatttgttcttctttggaaaaacccagtctttattttgttgttgttgagacagagtctcactctgttgcccaggctggagtgcagtggtgcgatatcagctcactgcaacctctgcttcccgggttcaagcagttctcatgcctcagcctccccggtacctgggattaaaggcaagggccatcaagcctggctaatttttgtattttaagtagagatggggttttgccatgttgcccaggttggaccccagtctttattcttaaggcttttaaccggttggatgaggctctacatgatagagggtcatgtcctttatttcaagtcaactgattgtagacgttaatcacatctacaaaataacttcacagcaacaccaagactggtttgagtaaacaattggataccatagcccactgaaggtgacatataaaattaaccaatacatcccaagggcactcaataggtccagtccttctggtggaagaagagtctaccatatataagataatatatgccctggctccagtcctccaggtggaaggggagtctaccatatatatgataaaatatgccctgggtctattcttccacgtggaagaggagtctaccatatatcaggtaaaatatgcctgggtctattcctccaggtgaaaggggagtctaccatatatatgataacatatatgccctgggtctatcatctatgtatcttatctatcatctatctatgtacctctctatcaatcatctatctatgtatctatctactaaacaaaaaaatcagggctaagcatggagactcatacctgtaatcccaggacttttggaagccaaggcggggggattgcttgagcccaagtgttcaagatcggcgtgggcaagatggtgagaccctgtctctatttaaaaaataaaaaaaaaccttaaaaaaaggaaaaatcaggcttttaaataattagttttattcagtatcttactgaagattgcaatcccggaatctttcagagtttctgttagactgctccaaaacagtgtttcaacccacagcttatacacaggtggtagaagttctgcaggtgctcagaagttacaacaaatgtgctcagaagtcatagaagtcacaacacatgttctcagaagtcacctcagatgtgctcaggtgttgcattagagccagttctcatcaaggtttgagcgccagggaacaactgtgtatagattacagaggcacagtcattaatcctgtcggacattatgtgtgggaaggggcagggactaggagcactgaaaccatcttttctaaaaatgcagcgattcaggcaagagatgtgggaacctgtgctcgatttatcccatttatcgccctcagggcattcttccacagggctgggctatgtcactcagtcagggattttgtgacattcccctggcaaacagaaggcactaacatagcttgttacacttgcgactttgtatcacatatctctctatctggtcctagttcctattggtagtttctctggagaactctggctaacacaggaagcacttcctcctgagaatagcatccaatgataacattttgcaacttatgtatcttacaactggaggaagaagtggctgtgtaaaggagaaacagggatagaatgcccttcaatttttggcttcctgatccctggaaagattggacaggtgagagcaagcatacacaaggaaggatttggatggagacagagaagctttgtctggtgaacatcattttgataaagtaattactatcaatcatgaaagtttaccagccgttaatcaggacgccatcccttttacaaaaaatactgctacaaatatgacccgatgctcgttaaggtcttcattattcttggtgattactagtatcctcatttgcaaatttattttgccagtaaaaaggtgaaggcttacagaggggaacaagtggccccagcgtggccaaatgttttgtctgcaagctggaaatggattacattttcatgtggcctcctgattagtcacagtctcttagaagaaagagggttctgtttatacatcgaaactctctgttttcttttttaatgaatagtttcctttttgttatacagacccagaaagaaaggtgactggactggatgtcaaattttagtcggtctgcttttatgaataaggaatattcataaggcaaagaggagacacatcacatcactttgtagggagcaaaaagttgtttgcaagcgtctctctgagtcaacaagcttcagttagaaagcagtgttcctaactgaagtagattatcacctaaggatgaaaatgaagccacataaaagtattgaatccttgggttgggttacttcagacttctggtcttttttttgtgtgctgacctcccgtggacttttcaggcagcccccacggtgagcaggaagagaaccatggggcttaatcatgcacgaaatcctccatcagtgcaagggctggggaaggagggctattatttgcacatggggaggcatgagcatcattaaactgtttcgctgcagagaatctacatgtaccagagatgaagagtgagagtaactcagtatcttcatttgtaagctaagttttctagtaaaaatacaagtacacaaataaagagcattcatttttcttgttttggtttgctttaagataatagactttatttttaggcatttttaggcttacagaaaaataaccagaaaatacagagaggtcttatatagccttgttgttgaaaaaaagtcaaactctgtaaaatatttgaaaaaatttatactgagtcaaatatgagtgattaatggcccatgacactgttacagaaaaggggtcctgatccagaccccaagagaaggtttttagacctcatacaagaaagaattgagggtgagttcatagagtaaggtgaaagcaagtttattaagaaactaaaggaataaaagaatggctactgcgtaggcagagcagcggtgtgagctgcttaactgcttacacttcttgttattaagacttcttggttatatgctaaacaaggggtgagttattcatgagttttctgggaaaggggtgggcatttcccagacctgtgttcctccccttttgggaccatatagggtagcttcccgatgttgccatggcatgtgtaagctgtcagggtgctggtgagagtgtcttttagccactaatgcgttataattagtgtataatgagcactgaagacaaccagatgtcaatctcattgccatcttggttttggtgggatttggctggcttctttacattatgctgttttatcagcaaggtctttgtgacctatatcgtgtgccgacctcctatctcttcctgtgacttagaataccttaacttcctgggaatgcagccgagtaggtctcaaccttattttacccagcccctattcaagatggagttgctccggtacaaacacccctgataacacaacgttcaggagatcctgaggacatgcatccaaggtggctggggcacaggctaattttatattttagggagacatgagacattaatcaaatacatgtaagatgtacatttgttcaattcagaaaggcagggcaactccaagctggggcggcttccaggtcataggtagatttaaaaattttctgattggcaattgattgaaagagttatcaatagaaaggaatgtctgggttatgatgataaaagattgtgaacaccaaggttttattaatatcatgtggatgaagcctccaggtagcaggcttcagagagaatagattgtaaatatttcttaccaaacttaaggtctgtggtgatgttaatgctaggcagtttttcctgaattccaaaaaggaggagggtataacgaagcttgtctgaccttcccttcccgccatcgcctgaaccagtttttcaggttaacttagaaagcccttgtccaagaggaggggtccattcagatgattgggggtgggaggcttagaatgttttctttttttttttttgagacagtctctcgctttgtcacctgggctggagtgcagtggcgcgatctcggctcactgcaacctctgccccccaggttcaagcgattctcctgcctcagcctcccgagtagctgggattacaggtgtgcaccaccacacctggctaattttttatatttttcgtagatacggggtttcaccatgttggccaggctggtcttgacctcctgacctcaagtgatccactgcctcagccttccaaagtgttggaattacaggtgtgagacattgtgcctggctgggacgcttagaattttatttttcatttataccctctcattctatccattttccagtctcaaattagtgtaatacatttgtcacaattgctaaagcaatgttgacactttgaaccaaaatatctaagaggggtctcagtcaatttagaaagtttattttgccaaggttaagcacacactggtgacacaacctcaagaagtcctgatgatttttgtccaaggtggtcagggcacaacttggttttatacattttagggaaacatgagacatcaatcaatatatgtaagatgtacattggtttagactggaaaggcgggacaactctaagggggagcggacttgcagatcatagtagataacagaaaaaatggttacattcttttgagtttctgattagcctttcactgaatgcaaaatttataggaattagtcacttatgcctcagtctggcttagtgaaacaatagggcagatgaaaccatctgatatacattggtctcacaggagccaagggatgactttgagttccttctgccctttgtccacaaggaatttcctcgtgggcaaattgtgaggaagggatgtatgttcgttatctttgcagttatcttatttaggaatagaattttgtctggattgatgggttcttggtctcgctgacttcaagaatgaagctgcggaccctcttaaaggtggcgcgtctggagttgttccctcctcccagtgggttcatggtctcgatggcctcaggagtgaagctgcagaccttcacggtgagtgttacagttcataaaggtggcgcgtccagagttgttcgttcctcccgtccggagttgtttgtccctcctggtgggttcgtgatctcgctggcttcaggagtgaagctgcagacctctgtggtgagtgtggtggcacagacccaaagagtgagcagcaacaagatttattgtgaagagcaagaacaaagctttcacaccgtggaagggggacccaagcaggttgccgttgttggctcgggtggcctgcttttattcccttatttggccctacccacatcctgctgattggtccattttacagagcactgattggtccattttacagagtgctgattggtctgttttacagagtgctaattggtctgtttcacagagtgcttattggtgcgtttccaatcctttagctagacacaaaagttctgcaagtccccacccaattagctagacacagagtgctgattggtgcgtttacaaacctttagctagacacagagtgctgattggtgcatttacaatcctttagctagacagaaaagttctccaagtccccacctgacccagaagcccagctggcttcacatctcagaatgggaggcaggtttgcccgacacagttcccagcttgacttttctcttcgggttagtaattttgggatcatgagatgtattttcctttcataatacattattttttaactaaagtccatagtttctatcaggtttaccacttacattgtacactctctgggttttgacaagtgcatatatgttactatatcattataacaccattgcagatgtaagatgatccagataatgtatgcagaattgatttagaattccagactgcatgatagtatgtttttgtttggttggttttgtttaagatggagtctcgctctgtcacccaggctggagtgcagtggtgcaatctcggctcactgccaccttcgcctcaaagattcaagtgattctcttgcctcagcctcctgagtagctgggactacaggtgtgcaccaccacccttggctaacttttgtatttttagtagagataggattttgccatgttgcccaggctgatctcgaactcctgacctcaggtgatctgccctcctcggcctcccaaagtgctggtattacaggcgtgagccaccttgctgggccactatgtattttttaaacccccaattcaatttctctgcatcaattaagaaataaatccatctgttctaataaaatacaaagaattgaaggtttcttgttgctcactgtattagtgcattctcacagtgctataaagaactacctgagactgggtaatttataaagaaaagaggtttaattggctcatggttctgcaggctgtacaggaagcacggctggggaggcctcaggaaacttacaatcatggcagaaggtgaaggggaagcaggagtcttacacagccagagtaggagcaagacagagagagaagaggtgccacacacttttaaacatccagatttcccgagaactctatcgcgagagcagtactaagaggatagtgctaaaccattagaaactgcccccataatccaatcacctcgcgccaggccccacctccagcattggggattacgattaaacttgagatttgggcagggacacagatccaagccgtatcactcactgtaaaggaagcaatgtcagagacacgaaggccataagaaaaaacggtgtccctattgggagtgtgctatctattaagaacatacattgataagcaccagacgtttgtaatatacgtgggagcataatgcagtttaagaaaacaaagacaagatcgttctgcaacaccaaaagctggaggattgtcatggagcaaaccgaagttcagggaggaaaaaaagcttttttttattttaaataccgaattatgactgcagctctatttttgacttccatgagaggcaattccaaattgacaaactttgtttcccagttttgagaatggactttacctgtggggtgatggagaaagaggataccacaaattctcactgcatagagtagtgtttgaccagttgagcaaaggaaagggtttagtctctattttaagaaattttaggcttcccaggattttctctaggccttgccttgtttgcacaaacacgataaagcaactgtttcgttgatgtcctggtgaaaccacctttgtaaaattgtgactgagacagtgaaagaggtctaacctaaccaagtccatcttgcttctaacctctaagctgtcctttttcactcctgggcgtaggctgaactaactttgggagaaacttagtttatagtttaaaacaaagatgataacggccctttccaaagcagaccttcttcttgcctggggactagactgcctttttaggactaacattagtgcaagattagaaattgtggtttaggagtcatgcagctggaggctacaagattctggccctccctaaactgctcttaagatcagtgcttgagatatcttgcagaccctgcacttgatggatcagctggcaccacccagatcaataaactggcccccatccaggaaccgattcagctccctgaccaatcagcactcccggctcactggcttccccagacccaccaagttgtccttaaaaactcagatcccggaatgctcaggcagactgatttgagcaataataaaactctagcctcccgcacagcctgctctgcgtgaattactgtttctctattgcaattcccctatcttgataaatccactctgtctaggtagcaggcaaggtgaaccctttgagcggttaccttgggcttcttgagggaactaattttcagctttttggcttttttgtctctctgttggggaggtttcatttctagtctgtgtgaaccctccatcttctgcgatgtcaagcagttgctagggaattagttcatatttattactctggctgcagtttctgtcttcaggtctaggactttgagatttcatttttaagtgactatgttttttaacctgcatttccatgtgtcaatggtaagagtaagcgtgagtgcatttgctcagccacttgtgtcactaggagggaaccacagtgatcatttaaaagataaataggggctgggttcacgcctgtaatcccagcactttgggaggccgaggcaggtggatcatttgaggtcaggagttcgagaccagcctggccaatatggtgaaaccccatctctactaaaaatacaaaaattagccaggcgtggtggcgcgtacttgtaatcccagttacttgggaggctgaggcgggagaattgcttgaacccgggaggcggaggctgcagtgagctgagattgtgccactgcactccagcctgggtgacagagagagattccgtctcaaaaaaaaaaaaaaaagataaataggatggtgtaaaatatcatttccctgtttttaaaacagccatttatagactttaataaagtaggattgattcactcttttacaaaagctatatatatatatatatatatatatatatattttttttttttttttttttagatggagtctcgctctgtcacccaggctggagtgcagtggtgcgatgtcagctcactgcaacctccaccttccaggctcaagcaatcctcttgcctcagcctccccagtagctgggaccacaggtgcacatcaccacccaattaatttttgtattttttttttttagagagggggtctcactatgttgtccaggcttgtctcaaactcccaggctcaagtgattatcccacctcagcctcccaagtacctgggactacaggtgcacaccataatgcccagctaatttttgtatttttgatagagatagggttttgttttgccatgttgcccgggctggtctcaaattcctgagttcaggtgattttcccaccttgatctcccaaagtgttgggaatacaggcatgagccactgcacctggccccaaaccagtatttttttaaagaattttccaaaatgttaacattgactttctgggttgtgagatcacagatactatatgtcatagtatattctttaattatatcagtaattttaccattttgagcaataaaaaaataataatatttgggctgggcacggtgtctcacgccagtaatcccgacacactgggaggctgaggtgggaggactgcttaaaccaggagtttgagaccagactgagcaacatggagaaaccccatctcttcaaaaaaatacaaaaattagctgggcgtagtggcacgtgcctgtagtcccagctacttgggaggctgaagtaggagaatcacctgagcccaggaagtgaaggctgtagtgagctgtgactgcaccactgcatttcagaccctgcctcagtaatacataattacataattaaaataataataatatttaaaaaacacagtggatactattgcctggaaattataagacctttagctgagtatcacatgagagtagccaaaattgattactcaaaattacgttatttggccataggtaaggacatgtaaatttgggaagaatttatgaaaaagagaatgagatatttgatcaaagatgaagatccctgcttctgttggaaaatatcaaagaacaaccggacacattcattgcgattcaggaaaggttttaatgggatgacttcaaagaggaagacatattttcaattgcagaaatggcaagggcacattgttggtgtgaaggcctgagtcggtgggaaataaatgagctaatctaagacactgacataaagcttccaggaaagaaatatggacagtggtgcagtcgtgagaaatgtgtttgatcttgcagaagtggtgtcatttgtgagagtgacaggcagattcacacaagcgcatagaatgcaccctacagacacagagccgacacacctcgcttaaaggggagctggaatttaggatgcataatttagggagaagatgataaaataatggctaaccaaacagcacacacacaaactcacgtgcacgcatggacacacacacacacacacacgaatctactatatcaaagaaaatagaaacagcctgaatttttggtgcacaattttaaaagcagataccgtaaaagtaaatttgagctgcgcgctgtggctcatgcctgtaatcccagcactgtgggaggccgaggcaggtggataacttgaggccagaagttagagactaacctggcacacatggtgagaccccgtctgtactacaaatacaaaaattagcctggtgcggtggttcacgcctgtcattccagctgctccggtggctgacgcatgagaatcgcttggacctgggaggcggaggttgcagtgagctgagatgataccactgcactccagcctgggtgacagagtgagactctctctcaaaaagaaaaagaaaagaaaaaagaaaagggggatggaaaagtatgataaatagagaaaattaatgaaaatgtgaggacctcgaaagctgtatatcattacaggttagggattaactgattaagcaatattcaatctcttttcttttcttttctttttttttttttttttagagacaggatcttagtctatcacccaggctggagtgcagtggtataatcacagctcactgcagcctctaaatcctaggctggagtgatcctcctgcctcagcctcttgagtagctgggactacagctgtgcatcaccatgcccagctaagtttttaattttttgtagagattgggtgggggaggtctcactatgttgcataggctggggtcaaactcctggcctcgagccatcctttcacctcggcctcccaaggctctgagattacagatatgagccactgtgcctggcctgttatttttttaacatatcagttgcacaagactcccacctacagcgaagcaggatgaaaagagattaagctctgatgagaagccattcagtgtggtgtgttaccttctttgtaggatcctgaacagatcaccttatctctagatttcagctttttcagcttcaaaacaaaaagtcggacctgagttatcttgactgttcttactgaaattctctgagtcctgtatgagaaaaaaactacataattttcccctattttgttttgtaatatagaaagagtttcttcctttctattctttgtttagaatacaactttatgttttgttttcaataaatctttgagaatgaggtgttgacttctacgggtcattcaaggtgaattttcattcaggcatttaaaaaaaagaatgattcactcttgggaaatgtcagctgactgagctgccgctcctttttaagtcaggaataagtagtaaagtgcgtttttatacagaatattacctattccatgtaaatctttaataaggcatgctagagggttttaaaagaaatccagacttcatgaaatgagaatatccagagggaaaaatgattgaatttaaagagagagagagagaaaaaaaaagaaggaaccttcagtggtaactgtattcagccaaggggatctgctgatggaattatgaaatccagtttgggaagtgaagtgaactttcccagccaccgactcaaagcacaagatcctaaagtgcttaatgaacagtgaaggctgacctgtgaaggattaggaatttcagacatgtgttacttaagcttctcattcccagaaccaaaattcctcgcaataaaagaaagaaagaagtcagcatgatggctccatcgctgggctgacctcagatcgtgctggtctcagtgatgaacggaaggaatgagaaatcttctaacagattccacatttctggtattgtttttgactcctctgactttgtctttaccccaattaccctgtagcctgatctcactatttcccctgaaatacaacaatttttctctgaaatacaacaatctgtgttaccttaatcagcagatcattgttccatggcaaagtaattattgaggaaagctgtgaaagaaaaaaagactcttgtatatgcctgccaattaattactctgttattgttctgattttcttttctttcttgattttaaccaatctaccccttgttttagggaacggttttgcatggagctgaaatcaaaatttgtttttaaccaaattgtcgttcttcacagaatgtcaatgcaataataccttcaggctcttggagaagatatagtttacaaagggccatttttgtatatgggatcttctcctatacatcttcaacagcttgagttgagccactgcatgcaaactgatgaccttgctaatgacgctggttggttctactacttcactgatcccctttgtcttggtgaatgaatgaaggggtttaagataagaccactggccaatcctgtagctgacttacaaacacctggaaaagtggtgagatgggatcagttatcactggataagcttcatacagaaccttagagaaaatgtcctaaaatctttttaatccagaaaatcacgtttttactgttagattatgtttttgtttaatccagagaattatattttaggttaactgtacacattctatttacctgtactgagtagggtcaaaattatgtttttagtttgttgaattccatgatacttcctcatgctgaattcattgaattgcatgcaaaagattctgaatgacaaccaaaatgtcagctatatgtttattcaaattcatttgtaatgttaattcagtaaaccttttaactgctaggcatcaacctaaggcaatcgtcttctccaattaagaagtatatatgcaaagctacattataattagggagagaatttttgagtttacagagtcataaaacataagtggattgggagataatttttgagtttacagagtcataaaacttaagtgaactgaatgtttcctgactcaaatggatttaagagttcttttctataaaaagaggcgcatgtccttggaaatacagtcttctctcagctgagtagggtgttttctcctctaactcctataaccaatagatatggcagcttggacttaggtcttttatttgctttgtttcatttcattagatgcttgtgtgacacactgcacgtatctggatatgttcacacctccattcaagtcagcatttgttgtatgagtcactgtctttacttaaggcaacgatcactatctctttcggtactgaatatattatattttggtttacattttcccttttgcaattcctcattttcaagttttacatgtaggctgcccatggtctcaaaaaaagcaaataactacataaatgctctgtcttattctcagtaatgacaaccgcatatttgaagatttctggaagattttcctacatggaaatatgtcaatgttgtggggccactgggttatttattcataactatatatctaaaatcaaggggagaggtcagggatgttcttatgagaaataataagaagagtacaatctctgactctgatggtgggtggtgatgttatgatttcagggaaaagtaatctatgaccgaatggtgggtcatgagcatctccatccaggaaaagcaatctatgactgagatgttaagacatgggcatctcagcccaggagaaacagtctatgaacaggacaaagagcgctgatgatcatattcctggttttattagaacaggtctttgcaatgttccactttagcctctagttcaagaatgacttgctgattaacaggctcaagctttcttgacagagtggagtcttggcaaaaatgctgagtagagagtagtagaagcttgtttgggagcctctggtagctgtttctttcagtaatcaggcttcctcaaaaacacaatcctctggcctcactctgcccacgtcagatgtcccacagtgcctgtgctatgtgagcaagtctttcctattttagaaatgtttccttctggtagcacacagtagctcatgtctgtaattctaacactttgggaggctaaggagggagaatggcttgagtccgggaattcaagaccaccagcctgggcaacatagggagacaccatctctgcaaaaaaaaaaaataaataaataaaatagttaactgagcgtggtggtgcacatgcctgtggtcctagctacttgggaagaaaagacaggaggattactcgagcccaggagttcaaaaccagcctgggcaacatagcaagaccccatctctgcaaaaaataaaataattagccaggcatggtagtgagtatttgtgaagctgaggcaggaggatccttgagcccaggagatcgaggctgcagtgagctgtgatggtaccactgcactctagcctgggtgacagagagacaccttgtctaaaaaaaaaagagagagaaatgtttcttttccttactgaggtcaaatcctacatgttccattgttgcttttctgggcatctcccaaatcagtgtaacacattctcattagtggttctggcggttcctctatcaatgtctaggcattcctgcctctaatgctggaaatgcattgtctaggctagccatgaggtgtaggtggtaaaacaaaacaaaacaaaacaggaacacatctgaactgctcctggagtctcaccatgcaaatgctcctacccctctaacaattccacaaccccctactgtatgtagtccattttcatgagctgaattgaagtggacagttctgctttaaactggtggacaggattgaatttggaggaagacactgagttttttttttctctctctctgaatataacgtcttttttttttttttttttcagatggagtctcagtctattgcccagcctggggtgcagtggtgtgatctcggctcactgaaacctccacctgccaggttcaagcaatcctcctgcctcagcctcccaagtacctgagattacaggtgtgcaccaccatgcccagctaattttgtatttttagtagatatgggatttcaccatgttggccaggctggtctcaaagtcctgacctcaagtgatccacttgcctcagcttcccaaaatgctgagattacatgcctgagccactgcacctggccaggatatatgttttctttaaattaaaaaagaatcacgtgaacttcaagttttgaagacaacgtcaaagaacagacacagtccaggactaagcctggagaagagctatttttctcagctctgcaggaagcagtgcacaactacatggcaggaatgggggtctcaggaaacagtaaaggggcccaggtgggatggtgggagaagtttggcacaccaaggaaggctcttggaggatgggcatgagagatgggcatgaatctctttcacctgtcagtacttgcaacatagtctttggtgtctgttttgttttttgagacagggtctcactctgtggcccaggatagagtgcagcggtgtaatcatagttcgttgcagcctcaaactcctgggttcaagcagttgtcctgcctcagccccctgagtagctaggaccacaggcatgtgccaccacatctgactaatttttgtatttttagtagagatggggttttctcacgttggccaagctggtctcgaactcctggcctcaagtgatccgcctgcctcggcctcccaaagtgatgggattacaggcatgagccatcatgcccagctgcccaacataatctttggagttcagaagaatcctggagatttgacttatgagacaaagcaaagcatcattccatattcctaagctgactttacatttggacatacaccctggaacaaagttgacatttaagaaaatacccataaatacaattatctatttattacttacgttagttttgtggaggattcttagcagagcagatgttaagatgtctatgccaatatttatttcactacagagatgtataaaagaatggagagtgcctaaaaaagaaaaggtaatgaaagatatcaaaatagtgtttataagaaagtcaggctgggtgcagtgactctatgcctgtggtcctagtattctgggaggccagggtcgggggattgcttgaggccagaagtttgtgactagcttgggcaacatactgagacctcatctctatgaaaaattaaatattaaacaattaactaggcatggtgacactcacctgtagtctcagctactcaggaggctgaggcaggaggatcgctcccaagcctgggagattgaggctgcattgagctgtgatcgcaccactgcactcctgcttaggggacagagtgagaccctgtctctaaaaacaaaaagaaaaaaaaaagaaattcggcttagtggaggtctttttcaactattatttcatttggaaaaaaacttcactttaatattggtaaataacacacatacatgtagacaaagtttaaattcccagggccagacgcggtggctgacgcctgtaatctcagcactttgggaggccgaggcaagaagatcatctgaggttaggacttcgagaccagcctggccaacatagtgaaaccctgtctctactaaaaatacaaaaaaattagctgggtgtggtggcgggcacctgtagtcccagctactagggaggctgaggcaggagaatggtgtgaacccgggaggtggagcttgcagtgagccgagatcgcaccatgtgccactgcactccagcctgggtgacagagcaagactccatctcaaaaaaaaataaaaaaaaaaattaggtgtggtggctcacgcctgtaatcccagctactcaggaggctgaggcagaagaatcacttgaaccccagaggcgaaggttgcagtgagcagagatcgtgccactgcactccagcctgggagctagaatgagactctgtctcaaagaaaaaaaaattgttcaaattcccaatcattgggaataataataataaatcttcactcttcaagctctggtccttctcttagggatgctctttgtacagagaggattgaaagcatagagtctcatgtccatcctgagagtaacatggcctgagctaccagcctctccacacccctggctgctgaaagccaccctgtgaaacctcaaatctggcttggaattccttctccagccacagatggaaataccagacatgtgttcactgtagataattcagatataaataagttttctaccagaaacgaaatattgtgatgtatgcaattctatcacttggtgtaattaccaatgttcttctttaaggacaacacatggttatggtttgaatagtgacctcctgtcccccaaattcacatgataaaatgctaatccccaatacctgtgaaagtgatcttctttggaagtgaggtctctgtagatgtcatcaagttaaaatgaagtcatttgggtgggtcctaaatccaacgactagtgtcctaataaaaagatggaatttgggctgggtgcagtggcccatgcctgtagtcccagcattttgggaggcccaggtgagtggatcacttgaggccaggagtttgagaccagcctgatcaacatggtgggaccccatttctatattcaaggaaaaaaaaaggatgggggacaattaggacacagacacacacccagggaatatgccatggggagatgaaggctgagataggactgatgtttctgaaaccaaagagtgctcaagatctcaggaaaccaccagaagagagggaggaagcatgagacagtctctccttcggagactcagaggaactgacatggtttggctctgtgtccccacccaaatctcatctccagttgtaatccccataatccccacaggtcaagggcaggaccaggtggaggcaattgtatcatggaggtggtttctcccatatgctgttcttgtgatagtgagtgagttctcacgagatctgatggtattgtaagagtctggcatttcccgtttgcactaactccatcctgccgccctgtgacgaagatgtctgcttctctttcaccttctgccatgattgtaagtttcctgaggccttcccagccatgcagaattgactgtgagtcaattaaatctctttcctctataaattacccagtcttgggtatttcttcataacagtgtgagaacagactaatacaggaaccaaccctgtcaacttttttccatatatatatatatatatatatataatgtgtatatatacacatatgtatttatgtgtatgtatatatacataaaatatgtgtatgcataaaatttgtgtatatatacataaaatgtgtgtgtgtatatatatatatatacacatacttttttttcccataaaatctagaccctgcacaacctgccaaaccttgatctcagacttccctgctgacctgtgtatgtgacattacagccaaacattttctgtcctctctgcttttatagttgagcatctttctaggacaaaactgtaggattattttgcctactatgaacttctggaagagtttatctggatgaaatagaaggaaaaaaaataggagatagatcaaggggtgtgatctttcagcttgcgtcccaacccaggtgatatggtttggctgtgcccccacccaaatctcattttgaattgtagctccggtaatacccatgtgctgtgggagggacccagtgagagataattaaatcatgggggtggtttcctccatactgttctcatgatagtgaataagtcttacaagatctgctggttttataaggggtttcctcttccacttgactctcattgtctcttgcctgctgccatgtaagatgtgccttttgccttccaccatgattgtgaagcctccccagccatgtggaactgtgagttcattaaacctctttttctttataaattacccagtctgaggtatgttatatcagcagagtgaaaacggactaatacaccaggccagtggaaattgtgcaaaggagtttgaactcatcttctttgctttgtgtagaagaaatctcagtatagaggcagaatctgcctccctcgagattaagacagcagggaagagaggcagccccccttccctgaaggcaggtcagaatgaggacatactcagtttgggacccaactttctcaagagaaaaagtcattccttctcccctgggatgaggaaaagatgagcatgagagttgaagaggtttcttgggagaagtggaggggtttctcctatactttttcccctggagagtaaaataaccacactctccctaggaaaacattcatttttttcctacagcacgtcagatctgttaacgaatgttttactttgaactcgggccattgcaaaatcatcagcctgaaagagcggatactcttgcattggaattcactaatgttcagtttgtttacaatgtggctttcctgtccagtgttttaaaattccacatgtataactgaccctcggagaacagttccattgcttagagaacttagcagggtaaccccattgggcagcaggatgacagtagctttgcacactgaaaaagaaacaaaacagattaataaatagggaaaggctttgatgatgagctcaccaatagaggtggagagaagggagggagagtttaaaaagtgctggaggcttctatcctggggctggggagactttgatgaggacacaggctcagttgggttctgtttggcagatacacttaaggaggaactaggaaaaaaccaaaaaggccctggaggcttccaaggaaatgtctctgttgcaatactttggctgcaagatattttcttctgtccccagccagaaggagcaatcctggtgcttaaataaaaaggcatgaaggcccaaagtggctcttgacttgccaaggcagtattacagagaattaagccctaccttagggcatgccaggagcctgctggaggtgtcagtgttactggaaaagaggcccaacccagaccccaagagaaggttcttggaactcgtacaagaaagaattctgggtgagtccataaagtaaagtgaaagcaagtttattaagaaagtaaaggaataaatgaatggctactccacagacagagcagccccgagggcgagggctgctggttgcccatttgtatggtgatttcttgatgatatgctaaacaaggggtggatcattcatgcctcccccttttagagctcatagggtaacttcctgaccttgccgtggcattggtaaactgtcatggtgctggtggatgtatagcagtgaggatgcccagaggtcagtctcgtcggcatcttggttttggtgggctttggccggcttctttgctaccatctgttttatcagccaggtccttacgacctgtatctcatgctgacctccaatctcatattgtgacttagaatgtcttaacttcctgggaatgcagtccagcaggtcttagccttattttacccagcccctattcaagatggagttgctctggttcaaacacctccgacaggtgcagcagagaatgtttacagcagggaaactgttctgtatgaggctatactggtggatacatgtgattatgtatttgtcaaaacctatagaatgtgcaacacagtaaaccttaatgtaaattctgggcttttggggttatgttatgaacccagtgtgtgttcatcattgtaacaaatgttcattgtaacaaatgtactgctctagtcggggatgttcatagtgggggaggctgtttgggaagagggcagagagtatctgagaaatctttgtatcttccgctcacttttgccgtgaacctaaaactgctctaaaaaaacagtcttttaaaaaagaaagaaaagaaaagaaaaagagtgcagacatgttatagcatgggtgatccccaaaagagaatgcttagtcaaagaagccagtcacaaaatgtgtccagagttggttccttctggtgggttcgtggtctcacttcaagaatgaagccgcggaccttcgcggtgagtgttacagctcttaaagatggcacggaccaaaagagtgagtggtagcaaggttattgtgaagaggaggtcgaggctgctgtgagccatgttcacatccagcctgggcaacagagcaagaccctgtctcaaaataattatgataataataataagattagctttgcatagtttatcagacaagaaaactacaaataagtaactacagcacatattctcagagagagagagttcttttgcggggagatgtctttcgtggtttttgttatttgccaactggaaggcccagtaggctggaagaatttaccctaaaggggttcagaggacaagtatactgctatgttctttttaggaggcttttggagaattaattcttcaaatttagagttatttctagtttatgtttttgttttgttttgtttttgagacaaagtctccctccctccccaggctggagtgcagtggcgtgatcttggctcactgcagcctcaaactcctgggctccaacgattctcccacctcagcctcccaagtggctgggaccacaggcatgcactaccatgctaaaaaaataattttttgtattttttgtagagacagggtctcactgtgttgcctagactggtctcaaactcctagccttaagcgatcctcccaactcagcctcccaaattgctggaagtataggcatgagccactgtgtacagccagccgtttttagttatttcacagtaactaaaaagttgattctgaaaatacatgagagtttgcttttaaggtgttggctttgaggtacagttatgcttgctgcgttgagcacacgtgcacttgtattgttacctgaggagcagcaatactaatgtggccatggaaaacgtagaggtggtcttcccaacctaggccacctgccaacaggacccttcttccactccctagggtgggttccctctgtccttcctcccctggttcctgtgaaaatggtcagaggagaaaaaggggttactgtatgggtgcaggatcttctttgctgcgtgttttagggggcgctgcagacatctcagtatggtccatgttctcctgcacatttagggcttcggaggggtgattgccacagctcaggctagagtgcatcacccaaagtaactctcagcctataaactgcacttttacaagcagattatagacccgtagcattggcatgtttgatacgtctgaacacagaactctgatagtaaaatctcaacatgattcttgctggacaggccagttctctctgtgtatattctaggttttgagaaaccacaaccagagccccctggctccacgtccaccatggtttttcccttgaatggtgctcccagaagctttctgggttacacactagtggtgtctctggatttagtcgtgaagttcctggaaaaaattccttttccctaggctactggtgtgagttaaattctactaggagttcctctgggctgtttcacttcgttatttaaattttaaaaaatattttaattttttgtaacttttatgttttttaaatgttgttttagattcaggggcacacatgcagctttgttacatggttatattgtctgacagtgagttttgggattctagtgtacccatggtctgaatagtgtacattgtacccatgaagtaatttttcatccttcacctccttcccacccttctgagtctgcagtgtctattattccactctctgtgtctatgtgcatgcctatttacctcccacttagaagcagaaacctgcagtggctcttatttccatctttatgtccatgtgtacccagtgtttagcttctacttacacatgaaaacgtatggcatttcatttactgcttctgagtcatttcacttagaataatggcctccagctccatccgtgttgctgcaaaagacatggttttattcttttttatggctgtgtagtattccatggtgcttgaatgtacatatgtatgtacatgggtgcacagatgtatgtacatacatgcaccatggaataccacgcagccataacaaataataaattttaaaaatatctatctctatacctctatatatctatacatctatatatccatacatatctatatatctatacttctatatatctatacatatctatatatctatgcctctatatatctatatatctatacatatctatatatctgtacctctatatacctgttattaggttggtgcaaaagtaattgtggctttttctgttacttttaatgtgaaaaactgcaattacttttgcatcaacctaatatacatgtatgcatatctatgtctgtctatatacatacacaccacattttcttgatccaatcatctgctaatggacacttaggttgattccatgactttgctattacgaattgtgctgtgataaacataagagtgaaggtgtctttttgatataatgattactcttcttttgcatagataaaagtcctagaaaaaactcttccatgttttaacatccaatcctgtctcaccaaccgtggctcagaaaccactattgctttctggattagaaaaactcatccagttcttgtggattacacactaggaaccagttttctgcaaaaagcaaactactccagagaacagtcctcttggtatcgttccagttcatgaacagccattgaaaatgatgacgaaggtggtcatttcaacgccagcttgctgtggtttcgaaacagcagagcacgaatgaagcccaactaagccctcggtgtgttaatccaatgatgatgtcttcaccccacatcaccttctttatcccaacaatattcccgaggcaatacaagaaaaaaggtgtatccgtttcctggccattcgtgggtatattttagcctcaaaaggggcatgtggacatgaaaataggctctttcagagtaggggaatttatcttcactaaaaatttggatcttttgttaatcacaatttttttcattcactttgattttttatgatatggaattaaagtatttcatattttgaccactgaagttttggtgcccactgaaattttgtgctcaaagcagttggctcaatttccccaccctagccctgtcctgggcaccactgctggctaaaaattctatttatacatacatatatattatgtttttagacatatagcgtttgtacatataaaaaattatgtatatgtgtatgcatgtatgtacatatatagatggtccctcatttaagatgggttcaacttacagttcattttttattattttttttaagacaggatcttcctttgtggcccaggctagagtgcagtggtgcaatgatggctcactgcagactcaacttgctgagctcagggatcctcctgcctcaacctctcaagtagctggggctgcaggtgtgagccaccatgcctggctaaatttttattttttgtagagacaggatctcactatatggcccagaccagtctcaaactcctggtctcaagcaatcctcctgactctgcctctcaaaacaataggattacaagtgtgagttaccacacctggcccagatattcttaacatttttgttttttaaatagagatgaggtcttcctatgttatccagactggtcttgaactcctggcctcaagcaatcttcctgccttggcatctcaaagcactgggattacaggcatgagccaccacacccagccaatttaggacttttttgtttttatgataggtttatcaggatgtaaccctattgttaaacatgtaaccctattgttaaacaaacagtatctggacttaacgaaggttcaaattacaatatttcaactttataatggttttatcaatgcgttaccccattgtaaatctaggagcttctgtatacatctgtgtatatatatatatatatatatatatatatatatatatacacacagattaaaaattacatatatatacatgttatattttatgcatatacatatgtctatcttatatagttgcttaaaatgttatacataaataaaagatatatatatataaattaaatatcatgtatagagttggttaaaattttatatgtgcatgtaaactacattttatatatatatatatacactatatatataatattttaatattatcgtcagctgtggtgcctagggcagggctagaatgtctaatgacacaatctcatcaggcacaaatttcaggaggtaccaaaaaactgaaactaaactccatagtcacgatactgataaatattcaagacgtatataatgttttaattatacacacacatacagacagtgctaagagaccattagcttttttctcataatttagacaaaaccacttttgcagtgggccctgctgtgaaagtaaagggttaatgttgctcaaagaggggtggggcatttgcccccagctcctgagaggtgcacactagccttggaatgtcctgcctagtaggaatgtgtttatgtactgggggacctggggtaactggacaatctagcaatgtgatttagggtagagggggctattcatagcagagatttttagagtatgagatggacatactaggtgttaacaatatggttaagggtgggagctttgggtcttgaagtatcagctcagacctctggagaggctacagattgaggtcaactctgtgggccattgactgtggagccccagctgaagactctgaacactggggtttgggctagctaccctggttggcaatgcttcaggcattctgcacaagctaagactgtgaggctccgtgctgtccacaactccacaaggaaaggacagaaggagctctgtgtctgcaacttttcctggattctatctgtcccacatccctcttctcttggctgctatgtcaatctgtatccttgccacgtaataaaccataaccatgagtgtaatggtgaggtctgtcatcctatccaaagagccaaactgagggttgtcttggggaccccaaaatttgcagttgatgtcagaacagtgggtggtcatatggggattgtcccctctaacaatgaacttgaccaacccttacacctaccctgtcttagttggaatgcatgaaatggagactttagacattcctttcaatcttggatgttatgattttatcaaaacaaagtctattatttttctttgcaggtgacagagagagagagagagagagagagagagagagaaagaaacagagagaaagaaaaagaaaaaaaagaaaaagcaagtaagaaaacatgagattgggcaagacagagcccatctcatttctctgtgatttggaggtatcgaataagattctaataagaactgtgtggtatgattggaattcaaactatcaaccttgaagttgatgacagtgcataacgggcttttggtttgcacatctttctggtaatttatcctctttagttccttgtctccacacatctgcttgtgcttagatccaaaggaagagacattaggaggctataatttatttttcagggaggaattaggaagtgaaccaatgtcccattacatttgcatcagtttttgattaaaacacacacacgccacacacatttctcacactgtgagcaccccacactcttgtgtgggtatttttgttgttaattaaatttgtttctaaatagacttccatcctaacctggctttcatgcttagaaagacaagtgataaactgcaataaccctttcacatactttgatacaaatggttttaaacagttgggaagattaagaacaaagaaagcttttaaaaaaaatttctgaacctccaaaggttttgaccatttcctcattattattttgtctgctttgcacatgatgaaatcagaaatgggttataaggtagaactgtagttctgactttccaagaaaaatagtggacaaaacctgaagacaattttcagatgcaggatttttgtgggtgatgcagtgtgcgagggttatggcaccattaatccttgtactgtgggctggtgggggccagcatggtctggcgattgccaggtggattgaaaccacagtctcagatttcagggaatggcttctttcagtaacgcctacacccacatgccatgtggctggaagagctgcggaggggcagaataaaccattttttaatttgctgccttgagaaagatgcacacatccacttcaataccatcgtttttataaacccaggcaaatatttcagaagtgtgtggagcgtaggcgacaagttgcattcatggctgagttactgatgttttaatagagccaatgttgacttggcataatttttatgcttcataaacacaatttattttaccgacaaaatggagtcctgcaacaattttgctctggaggaatctgctgggtgaagcaatacaaattctgagcctcttgcattgaataaatcttggagatttgaaaattcttatgatttgaccatttttattcattcaaaaaaaatggtggcttatgcctgtaatcccagcactttgggaggctgatgtaggtagaacacttgaggtcaggagttcaagaccagcctggccagcatggtgaaaccccttctctactaaaaacacaaaaattagcaggtcgtggtggtgcatgtccgtaatctcagctacttgggaggctgaggcaggagaatcgcttgaacccaggaagtggaggttacagtgagccgagattgtaccactgcattccagcctgggcaacagaacgagattctgtctcaaaaaaaaaaaaattgccacataaacataatcaagtatttgtttttttttcacaatggcgagggagacatttccaacacagcatgtatcttttatatttttactggcttctgaatttttcccacaacaaagacatcttgttagactctactctcatgaaagtatattatgcttgacaaggtgccattgaagacctttgcagctgtatcattaaatgatacatttattacaattcctgaagtctctgcaacctcagatacaataacctagcacattggttgctcaaaagtaaattgacgtccaaatgctgagttagcactttgagaagattacttattcgttaatcttagaggggaggacttagttattggcattcataagcgtcctttcaagtaatcaatgcagcattttgacatgaaaaacggattatggaattttccatgagaaagtgtgaagaaggatttgattttcttaagtgcatctaaagaagctaacattggtttggaatcgatcctcttaaccacaaatatgattgctttattacaacttagggaaattaaaagaaaaataaaatacgtctcccaaaacaatagcatggcttgagagaaaatctgagcgcaacaaatttcattagtcttctcaggttttgaatgacttcttaaatatttgaatcttcattagtttattactgtggttgggaaacaatgcctttataatgttaattgagcacactgtttctggaattctgtaagctaagaagccaagttggtggaggatgacatcttgcaaatgactcaaggagactggacacaaaaacattcatgcattagaaatcaggggttcaacatgcatgcatatgttcattgcagcactgttcttaatagcaaagacatggaatcaacctaaatgcccatcaatggtagactggataaagaaaatgtggtacatacgtaccatgagatgcatatacagccataaaagagaatgagatgctttgctgggagatggaaggagctggaggccattatccttagcaaactagcacaggaccagaaaaccaaatgctgcatgctctcacttgtaagtgggagctaaaggatgagaacacatggacacatagaggggaacaacacacactggggtcttttggagggaggagggagaggatcaggaaaaacaactaatgggtactaggcttaatatctgggtgacaaaataatctgtacaacaaatccccatgatattagtttatctatgtaacaaacctgcacttttacccctgaacccttaagtaggccttggcatctgttgttcccttctttgtgcccatatattctcaacgtttagctccgcttctaagagagaacgtgtggtatttggttttctgcgcctgtgttaatttactaaggacaatggcctctagctccatccaggttgctgcaaaggacatgattttgttcttttttgtggctgcatagtattccatggtgtatatgtaccacattttccttatccagtctaccattgatgggcatttagattgactccatgtctttgctattgtgaatagtgctgcaatgaacatacacgtgtacttgtctttatggtagaacaatttatattcctttgggtatatacccaataatgggattgctgggtgcaatggtagttctgttttaagttctttgagaaatcaccagactgctatccaccagtggctgaaccaatttatattcccagcaacagtgtataagtgtcctcttttccctaccacctcaccagcatctgctggtttattttattttatttttatttttttaactttgtagtaatgaccattctgactggtatgagatggtatctcattgtggtttcaatttgcattttctctgataattagtgatgttgagcttttaaaaatagatttgttggctgtttgtatgtcttcttttgagaaatgtcctgttcatgtcttttccctactttttaatggatgatatggtggggctctgtgtccccacccaaatctcatcttgaattgtatttcaaattgggttgagggagggacctggtaggaggtgactgaatcatgggaatggcttcccccatgctgttcttgagatagtgagtgaattctcatgagatctgatggttttataaatagcagttttccctgctcttgctctctctcctgctgccttgtgaggaaggtgcctgcttcccctttcccttccaccataattgtaagtttcctgaggcttccccagccttgcggcactgtgagtcaatttaatctcttttccttataaattacccagtctaggatagtatccttatagcagtgtgaaaacagagtaatacaatggagttatttgttttttgcctgttaatttaagttccttttggattctggatgttagacttttgtcagatgcatagtttgctaatatttccttcctttctgtaacagcctgttctgttctacagatgagtccacaattctacatctgttggggaataatgaagagaaacaaggggcacattatttttcaccctgtatggaaactatggtgtacttcttgctctttcaccttcaggcaaaatctgataaaatgtatcagaggacatttagttgcctagaaaattatcttgctcctccagctgtctgagatatataatgagataccaactcacaccagtcagaatggctattactacaaagttaaaaaaacaacagtagctcataattaacttttatgcaaaacataatatgaactccattgagattgaggtgaaatttttaaaattgtcatttttatgaaacctcagttcttgcacagtttgtatttcttttgagtactttttttcttctgtggtttggaaatgtcttatttgtttgaaagattatatttgttctctaagatgtagaatgattccacaaaagaggtggtgcagttaaggtactggtcaggaatttacactcagtggtcatgagtcttcactttggaatatgtttaagtgttttaaaaatctattatttgatgttagcatgtattatctcatctaaagacaatatgctgaaattattattgggcaaaggactttacaactggaagaaaaggggaaggaagggagggggaaggagaaagaaaagagagttaaaggaaggaaggagggagggcagaaaggagggatggaggaaggaaaaagaaagaagggaaggaagggagggaggaaggaaagaggaagaaagggagggagagtgaggaagaaaagaaaggaaggaggaagaaaaaagaaagaaagaaaagaaagaaggaaagaaagaaaaagaaagaaagaaagaaaggaaggaaggagggagggagagagagaagggaaaggaagaagggagggaaagaacgagggaaggaaggaagaaagcaagaaaggaaggaagaagggagggagggaggaaggtgatgatgttaaagagaataagaaagaaaccctattaccacaagaaccattaacaaatctaattttttttttttatcataggaggtgctggccattccaggtaccatgaggccaatgaaatcaatgttctgtcctttccttcatggtactgactgaagatctttatctgatgtgttggatcacaggcacaggcagggacaagagacaacttctacacatgtcccagcctctgcttcactgggaacaagaagttgctctgaaggtaggtaggagaatagattagagaaggatgggcagccataagagaaacaggcattgatgtggttgaaatgtttttaaaaatatgcttatgctgtacacacatgttcacagaagcatccttcacaacagtcaaaaaatagaaacaaccaatgtgcatagacgaatgaatatgtgaacaaaatgtgatccatccatacaatggaatgttattcagccttaaaaaagaagagaatcctaacatattctacagcatggatgaaccttgaggatgttttcctgagtgaagtaagccaaccacaaaaaggacaaataccatatgattcctcatatatgagagccttagagtagtcaaattgttaggggtagaaagtagaatgttgattgccagaggccagggggagaggaattggggcattagtgtttaatggggacagagtttcagttttgcaacatgaactgttctgcagatggatattggtgatggttgcacagcaatgtgcctatacctaataccactgaactgtgcacttaaaaatggctaaaagagtaaatttcatgttacacatattttacacaatttaaaaaaatgcttatgatgtggagtcaatagtcatttttgagataattttcaagatcaaaatgaaaaagaagaaatccagtcatcaggattgagttccgaactgatcaactgggtaatgagatgaagaacttatttatttttacctcaacagctgggccacttggcttcttcctgacatttgcagagagcatctcactgtttcatttgctcctggtaaaaacccctagaactctttctagacaaagcaggaaccaccctggggtggtgaggtggggacttctatcatgggagttaggacaacaaggagacagaagtccaggatgaattcagatctcccccgtggacttagagggcaaaggaaagttggcttcgatctgtggagtaatgcgctctaaaccctgtgactccagaagaacaccctcttattttggctgttgtggtggttctgagctgaacagcctgcctcagcccttacctagagggacacgtagagttagataggctctggtttgcagagtctttcgctgggctgtctccccatcagcaagagaaagagctctccaaaactgccagggaagcctgagcctcctaggtgttctaatctgcctagaaaaataattccacaatgtaagtaaaccgccagatagttgagggaaattaacagtatgaaccagttctaaaatgaacaaacagaaggtctgactctcatgagaggtgcaaggttggagataaccagttccatgcataattgtgtctttccacaatgtcagtcttttattgacgctattgcaattacaaaggccacaagctgcatggagttcccaaggaggcaattctccttagtgcttcctgttcacttggtagtcagagctgcgggcacacaggttcaagccactccacatgtcagttgatattgcaaaccatacataatgattatatattcaataaataaatgttacggattaaacattccatggcaaacaaagtaacatggaacatcaagaggaaaaagagataggagaaatggctaacaaagctgggctcggtgcctcacacctgtaatcccagcacttttgagagactgaggtgagaggatcccttgagttcaggagtttgagaccagcctggccaacatggcaaaacactgtctctacaaaaaaaaaaaaaaaaaaaaaattaaccaggcatggtggtgtggtgtgcgcctgtagtcccaactactcaggaggctgaggcaagaggatgtcttgagtccgggaggaggaggttgcagtaagcaaagatggtgccactgctcttcagcctagacaacacagtgagacccctgtgaaaaaaaaagaaagaaaagaaatggctaagaaaccagtctaaatagagtgatgtggacaagaagaatgtcatggtctgggcctggctgtgcatcagtctcgcaaggcaaaggctttgatgtggcacagcctttggtggctgatgccaagttcttttcaggagtgacagcaagacagttgtcagttaagacaactgttttgagttgctgaagtcctgctctttttatgaccacagaatcctctgttgagggttgatggtagaagaatgtgcttggttatgtccttatctggttggatgcagtctttatttttttgtttgtttgtttattaagcaaaacctcttatccttctttgcacagggccctgtgaaacatcaaatggagtctttttctaagatgcagttagttatgccaagggtgtttgatatggtttggctgtgtccccatccaaatctcatcttgaattgtagctcccacaattccctcgagtcatgggagggagctggtggaaggtaatgggatcatgaaggcaggtttttcttgtgctagtctcatggtactgaataagtctcatgagatctgatggttttctaaacggcagttcccctgcacacgccctcttgcctgctgccatgtaagacatgcctttgctcctccttcaccttctgctgtgattctgaggccttcctggccatgtgggagtgtgagtccactaaacctctttttctttataaattactcagtctcgggcatttcttcatagcaatatgaaaatggactaatacagtgctgtatacaagaaccctcctggaagaaatgtaggtcatgcagaagaaacaaaaagaattcagagaactgaattagtaccctgaagcctctgcactccagcctgggagacagagtgagaccctgacttgaaaaaaaaaaaaatgccccaaatgtcagtagtattgaggttgagaaaccctggatgagattcataaaagccaatgtctccttagtaagcatttcaaaacatagaggaaaaagacagtgattaaaagaatataatccaagaaattatgtgtgtatatatgtatgtaaatataaatgtatattttctacataagtataaatatataacattaaacttaattatttataaatatgtataatttctttgaccacatatacatatatgtatatgtctattttataacaaaatctattaattttatgaatataaataaaacatttaaacatgattagatatgcaactttataaatattaacatttaaatacatctatttctacaattaatttacagtagacccctgagcaacacaggtatatgaggattttcctccgcctcggccacccctgagacagcaagatcaatccttcctcttcctcctcttcctccacctcctcaatgtgaagatgatgagaatgaagaccttgatgatgatccacttccacttaatgaatagtgaatccatttcctcctccttatgattttcctaaaagcattttcttttctctagcttgctttattagaagaataccatatataatacatataaacatacacgatatgtattaatttactgtttataatattggtgaggtttctggccaagatttcttcccagttctgacattaaaaaatgcttcctgaacacatgttgttcaaggatccactgtatattaattatataatgtatatatttataaagtataaattaatataactatattatgaattaaaaatttataatataataaagtaataatttatagaaaataataataaattcataacaaatcaatattatgatattgtatatcaatatgtaatatagtatattaatattatattaatatattatagtataatatttaaatattataaattataacataactgtatattaattataaaatgttttatatgtatgtacatgttaatatttatgtagttatatagctaatgtttacatgttttatttatatttataaaattaaaatatttcattataaaatagacatatacatgtatgtatatgtggtcaaagagattatatatgtatatatgaataggttgtttgtatttaagttttgagggagtccagagttacaggtggatcttcaactgtgcaggggtcagtgcttctaacccccccacattgttcaagagtaaactataataattaatatattgattatacatcatatatttagtatatattaatagatacataacttacggaaaacatccacttacatctttgaattgaaaagtgttactaaatgatactaagaaaaaaacatgctaagaggctgactaccatagattgcagaaaagtccaccattcttatgacacaatgcatcaagaggtagagtcgcttccctctccactgagtgtgggcttgccctgggatgtgctttgaccttgaaatccggggaaagcaaggtcatgctgattccaagccttgctgcaacaggtttgcagcttcctttctcgctgaatttggaatccagccaccatgtgaagaagtgcaaccccacctgctgtgtgacgagacaagggacacatttcccctattctcccataagcggggccacctagctgaccagcctgctgaccacagaaaagtgagtgccccactgagccctgcccaaattacccacccagagaactgagagctaagcaaatcagtgttgtttgaagccactcaaattcagggtggtttgttactcaacatgaactaactgttgcactggtaccagtgaagatctttcttctccaagatgaaaataaaattaagttacccaagttgcaaccacaatcagaaatcatgaaacttctcaacagcaatagtggatgctatgagacaatgttgcaaggcatgcagcttcctgtgagaacaatatttttttcttctagaattccaaatctggccagacttgtgaatcagtatgagggaagaaaaaaggaagagtttttcatctgcgaaaggttagaaagttttcattccaaagctcttttctgaaaacaagacaaaacaaaaagtaaatacttgatatattccagattaagaggaaataagtggtaaaattcaaaaagcagctggattaatccacttggattaaggtagaacaggaaatcacagggctcccagaagaattttgtcagggaggaattgcatatctctaggctagagggggattcaaaagtttttttacgtagagatgaaagcctgtgcttcttcaacaaaaggaagataatctctgggaaagaaaaaattacttgctgttcaagaagcaaaccaaaatgtggtaggtcttttttgtttttttattttttcaatgattaatcaaatgtaagaaacagtaattctagaaaaaaacaaaacaaaacagaattcttccttggccaggcaattcccaaagaaagaaaaacccctttgaatatattaaattctctttggattaatagcagagtttcaattaaaataatttcctcgtgttgggtgtagtgatttcccactttattagatatattaaattttcttagaggatcatcttcagcctttaaatattttcttctttaaaaaaagtttaaagaaatttttttcttcaactttaaaatttaaagcttttaattttttcttcttttttaaaaaaattttaaccgagtgcttgttggattgtttatttagatatcaattcagccttatagttttaaaatcaaagataaaaactgtattttgctttttgaaaatgctaagctcataaaacattgtatagttttaaaaactcactattttcagagttttaaactttttttcttaacataattgtaggcattgttgttttccttagcaacattgattactacatatctcattttgtgatattcagtttaggtatttttctttccattcaataacatatattttcctttaaaataaaaaaaaacagcattaacagttataatttctgaatgaagcaatgagggacaattttaattttcttcttatactttttgatttcatgaattttgtctataatttttcaactagaagaaagcaataatcaaaattgcatcatggaaggtttccattgtcttagagagggagaattgagtttacctctggggcagactttcatctggcatctaacttcccattgatgaaatgcaggctccacgccaaacgtgagtctatctcccttatgtaaaagggatgcaatgagaaggggtttggggtgcaggctggactctcatgactttgcagggacctcaaccctaatgatgttgccaacaccataatcattgctgttgctcttggagcttccatatttatttgctagattttcatgcacttatttctgtgtcaaattgtctcctggcttcactgtttcctctgctagaccatcaatgttgtctacagctgtatttctggtttcatcttttaatgagaagaccattgttaaagcaatgacccatggtgtatgatttcccagtctagaggcctctcccaagctcacttttcttgaggtctctctcatgcaatgatcaatcatcactgtcctgtttgttcttcttgacaaatgatcactctttggctgggcatggtggctcctgcctgtaacctcagtgttttgggaggccgaggtgggaggattgcttgaggtcaggagtttgagactagcctggacaacgtagtaagaccccatctctaccaaaaatattcccaccctttgtcattcagtccaagggatgctttctctgtacttatcttccaacagccacatctctgtccttgaatgaatttagaccttctgtttttatctgacagcacattgtggagaggctaaacatcttatctaaatgctgcagacaataaaaagtctagaaatgaattcaatgctgcagtcggcatgatcaatgtggttgtcacagagctcactattggatgtgcctgtatctggttccagactatagggtctgcacaaacaaaaattatgtttgggatgatttggatttcttccatcagttctagctgaaactgacgtaaaatatcaacctaacaaattcacacaataaggatgcacgtgatgagaaggtactaggcatggactgatgagactctggctcttaatgttaattctgcctacatactagctcctctgatgctctttagatagaaaccagatgtcccaagcaagtctgacagtatctgcaggtgacaacaaagagagagggaacattttttttttcttttgagacagagtctcgttcttttacccaagctgcagtgcagtggccccatcttggctcactgcaacttctgcctcttgggatcaaatgatcctccagcctcagccttccgagtagctgggactacagccacatgccactgtgcttggctaatttttgtattttttctagaaatggggttttgccatgttgcccaggctgttctcaaactcctgagctcaagcaatcctcctgcctcagtctcccaaagtgctgggattacaggtgtgagccaccatgcccaggtaggagaggaaacatttgctaatagcacctgatatggtttagctgtatccccaaccaaatctcaccttgaattgtaattatctccatgtgttgtgagagggacctggtgggagatgattgaatcgtgggggcgggtttttcccctcctgttctctttagagtgaataagtctcacgagatcggatggttttataaaaaagcagttcccctgcacatgccctcttgcctgccaccatgtaagatatgtcttgcttccctttcgcattctgccgtgattttgaggcctccccagccatgtagagctgtgagtccattgaacctctttcctttataaattacccagtctcgggtatgtatttattagccgcatgagaacagactaatagagcaccccagaaaatgtaaccttatgtgtctttagacaaagtggtgttgtatgcctgtgctcaacccacacgtggcacaagaaatggaaccgctcatggttagctttgatcgaccagcatctgatcaaaagcctctcttggaatatatgacctcagagaagtagaatgttacccctccaaataaacttggaccctgccagcaacaattatgtagaaacaggatgtaggttggtatcagtggctcagtaagagtttcccaaatgtatgtagtatcgtatcctcaaaattatactcatgtacaattactttgctgaggagctacaaggaccagaacacccaagctttttctaggacacatacagttgactgggaagaatcaacagagcttcttttttttccttctctatttagaaattctttgacctatttccattttctttcttgtgtaacctgttaatattagccagaacttctgtcagggcgcttgccttgggtaatttcgaaatactgtgcatccaacatcatgaaaattgcagttcatattagcttgaataaatgtagtccacacagagagggaacgttagtgctggaattcctttgagtcccatttccacagttcttggatctttaaatccatttggtttcaatgatagtcactatcttttgtcagaaccgacgtttaggcagctagcccagctctgaggtcaggctttggtgcaaagataatgggagatgaagattcaaatttcctttgtatgaaacatgaaccctttagcaatgtcctatgactttctatagtgatttctatttggtcacattttgcataggcaagaagaatctctatacttcatagcaatattatctttggataaggatgggggcagagttcatcttttcaaggtttgaaagaaaatgattttctgcttctaagtgaaaattcctgctgaggtataggaatagccttatcacacatagtaatacaaaaacagtacttcacgtgatcagaaaccccccaagtaattccatctttatttgtgtctcaatgcttgagattaaattatgcaattatttggatattttgtgtttaaaaattgaaggaaaaattggattttattgtcagtaaagcttgttagtctacaatgttaattgatacgtattgaaatctcagttatatgttacatatgtggtcatatgtggtacatgttagagaccataaaaatacaatctgaatgtttaaaaaaagaaagctgcaatatattttaattctgggaggctgtgggttatgttttataactctcccaaattaatcagggtccacattgactaaatacttgtgggttaattatttccttatatccttattattgtttttacaggcatattttctgctttcatgtgatttctttataactcctgataaaattaagcacaagataaatcctcgatgtaatgactaggagttcaatggagtacaataattaatacctgtgtccttataccttatagggtgtcctatttcatttttttgaggcagagtctcactctgtcgcacaggctggagtgcagtgacgcaatcgcagctcactgcaacctctgctttctgggcgcaagttatcctccagcctcaggctcccaagtagctgagaatacagccatgcactaccatgcccagctaatttttgtatttttagtagaaatggggtttcactaggttgcccaggctggtgttgaactcctgggttcaactgatccgcccaccttggcctctcaaagcactgggattacaggtaagagtcaccacagctgtgtcttattaaatatccattatctttaagcttagttcttttttcatctcaggtgggaatattgtataacatttatcctcattagttcttaagtttgaattaagtttgaataaatttaaatacatacgtgtctatactacctagtttagtgagttgaacattgacagcctgttttcttgactgtaacatcctgattattgaaggaggagaactatattatcatatataaacctatatctcaggctctgcgattttcccctctcttatttgcagtagaaataagtataggaaaatcagagatcgtgacatattgacatttctgtgggctccactgtgggtgagcattgttgaatgcgttggaataagtggcttgacttttccatcatccacccagggtgatgagaaacatgtgctatttggaggatgcatgtggcatgaccgaggctcagaaccgccatagggctggtgatgattggttggttgtcgtcttttgttttgtgctcttcccctgagaaaaacagagggcaattgaggctctccacttctaagttctcatttaatggtacttctctttgaattactcttctaaaatgtcaggtttatggagccaaggcaacaatattttaggatccttctgtctctggaaaagaaattaatttttgatctgaaatgaaagcactgagtatttaaagtcaggagaaaagaaaatgtgaagtgactcatgtcccctgggcattggtaacagtccacccttggtttctttcctagcaatatggtggccatattttcccaaccaagctcaacccacacaccaagggcctgggagggtatgggagaaagacagatgttaaagccaggaaaactcacattggaggtgttgtcctggaactcatcttttatttctatgccatttgctttccagttaccctttaaacctgcatctcctcatctatagagtaagatttgttatatgtgcttgctactttttgttgtatgtctgatgtgacttaggattcaataaatgcacgtcttcattcctttctcttcctattccatctttctcttctttgagcaattcccatctttcctttttttctttttttcctccatgtgggtaaaatgagaagtttcttttttattttctttttgagacagggtcttgctgcatcacccaggctgaagtgcagtggtgtaatcacagctcactgcagcctagacctcctagactcaagtgatcctcccacctcagcctcccaaggagctgggactataggcatgcaccaccacgcccagctaattatttttaattttttttaagagatgagggctcactgtgttgcccagcctggtcttgagctcctgggctcaagctcctgcttttaagcaatcctcccaccttggcgtcccaaagtgctgggactacagatgtgagccaccaagccctgcctgagagaatattttaaatagggattgatctaaaacgttttagttatgtggccctcaaattagcagctactctgtctccttggcaggaaggagtttgggagaagtcttttgggttcctcaccatcaccatatagacccctgcccttgggctagaaaacatttatgaactgattttttataaacctaggtaggttgcatattatatttgaggatagagccatgcttataactggacccaaagagtttagcaataagcaaatgtgcttctatagagtgaaaatctcaactcaggcaggaaatgttctccacatcatagtcataaatagcaataagaaattggccctccatctgctgtacaggtagggggagcattgttaaaaattaccagctatgcttatcacatagtcctcacctaatagaaacagagagatttgcttttgattcaaccacctcctagagatactaaaatccatggatgctcaagttcttgatataaaattgtgtaatatttgcatataacctgtgcaaccctcttgtatactttaaatcatttctagattacctataataccgaatgcactgtaaatgctatgtaaatagtggctatactgtattatttatggaatgatgacaacaaaaagaaagtctgtacttgtttagtacagatgaattattttttttagtatttccgattcatgagtgtttgaatccacagaatggagggctgattgtgtaattacttcttgctattctctttttttttaaattttgaaccttctgtgggaggattgcttgagccaggagttcaggacctgcctggacaacatggtgaaactctatgtctaaaaaaaaaaaaaaaaatccagcagagaggtacacgcctttggtcccagctacctgggaggctgaagtgggaggattgctggagcccgggaggttgcggctgtggtgagccatgattgcaccactgcactccagcctgggtggcagagacagaccctgtcttaaaaaaaaattagatatagtctgataataactacaacatccctctgttagatccctaagatctttttctacattattcagagggaattattttgttagtagccttctattaatttcttaaagggcacacacgcacacaaaagattgaagaaggttaatgctagatccattattttaagtgatttaatctattcctttttttctctccagaccgtctcactattttccttctgaaagcatcactagtgaattcagtcacaggtacgatgccatcgaaaacaacgcatgcaattcatgcaaaataaattgggaaagccaggtggggaagtgtttgttgttcctgccagcttatttttcccactgtttccagaaggaaaatgaaagacggggtgaggtgttgcccaaggcacatcccgtgtcctggcttcattctgttcattaccacccacctggtcccccttagccagcccacagtctcctggccacacaagcttcatccaaaccaccctctgtcagctgttgcccttgtcacagccgtgctgctcttcctgtttccccaacacctagccagggcccacttgtcattgccactgtttctctctggtgctcctggtctccgacacgacctcagatgccctttgccacggaggaggaaggatgccttgcccaagcgtacaagacgtgaaacagcttcaccgctatgtcctctccatttctgggctccttttctatcttatgtttgccccctactcacagcccttccccattaagaaccaacctccaaccgcatgccagttgcaacatttctgatgatgaagtgtcaccgaagtgggcctgattgaagaaggtaaggaattggcacatggaataagaatttcaagtgttcataacaagaaggggagggtttttttttcttttcttttttgcaaagaattaataatgaaatggtgggatgcctctaactacacactttggcctcaccctgcattaactcctgaactcccagctatgtgcctgccttctccttgtactagagcctatgaacacttcataaggaagaaaaaatcagagcatccttagccatgctgagaaacagcaatgttccaagctttcctaaataggcacatagatatgagatatctatatctatctctatgtctatctagctatatatctacttatctgtctatcaatttatcaactatcattttattcgatcacctatttacccatctatcttctatgtatcccatctatctatccatctatcctatatatgtacctatccatctatatctatgtatctcatctatctatccatatattatatctatgtatgtatccatctactctttctatcatctatctatctatctatctatctatctatctatctatctatctgattcgtccttccatctgtccatccattcatctatctctcttctatccatctattatctatccaatcatctattaactatctcatctatctatctaatcatctacctataatctattgactcacctattatccttctcacctatctatctataatcaatatgccattcctagaaagtttcaaagggacaatttggaaatttgcaagtgttctctccactaaccggagaagtcagaatgggatgaaaccttcctttgtggcaactaatgagctgcctgacttcttggaaggaaaatgcgggtggtaaaatttattgtggctcaggcatagtgcataagccatcgctcaagaaagaacgacatttttctggaccacacagcctcatgtcaaatgcaattctgttttccaataatcagcatttgtaataagcatctggtgaactaaactccacctcagagcctgctttgaagagaactcaaccactcccaagtccaatctgcctctcccacagtccacctcacacactgctttctctcctgctaccccataactggagtctctcgtgtctccctacattctgatttgccatatgggaactgctgcatctgggttacaaattctcccattccttctgctgtccccaacttaaagcaagccatttccccagtcatctatgacaccttgttcataaccagctctgaattccaaagtcatgtattcagttgtaactcatgcacatcttctctctttgctcccagatattctctctcttcttttctaaatttctcttttaaaatccagtttaaatccctttagagttttcctctctaaagcatcccagagtaagctagtatctgtaccacatcagctctgaagccatataataaagtatagaaaatgaatcaatgcttacatttttcttatttttcttaaaatatgtattttattattagtttatatggctatctttattatttttaagacaggatctcactctgtcacccaggctgagtgcagtggtaccatcacagctcactgcagcctcacactctgaggctcaagcgatcttcccacttcagcctcccgagtagctgggaccacaggcatgcgccaccacgcccagctatttttttaaatttttggcagaggcaaggtctgtctatgtagccaagcctggtctcgaactcctaggctcaagtgatcctcccacctcagcctcccaaagtgctggaattacagatgcaagccactgcgcctggcttatatttttattattaaatgcaatagaaatatagataaatacgatgtgggctagggttagtgaattattagaaggcagacacaatgaaagaaatagaacttgaccagctctcgtgaaggcccttcatgtgtccatcccaatcaatttcagaacgtaaataggaagctggtagtattatggtaaatgcaaatccaactgcaaatgcatgtggacgtttcctggtgaagtgcatcagatattttggcaagtttttctaaaggccatgccctccgttctctctaaaggtgatttgaagctgacagctttcttgatacataacaatcctttctaaagttttacacgagcagacattttacatggttttcattttttccagccattattttcttagcttgaaggtgtctaagtagatgagaaacttcaaataccttatatttccacatgtttatcctaaaaaaattaatcaaagtcttattaataaaatgtattgttttagagaaatattcaactcacactgtcatactgagcattgaactggaataaacagagtggaaatagaaggacaattttctgggtactctgtgatttgggcagaatttcttcaacagaattagacttcacaagatgcatacatataacggaataaaaggttgcaagaatgctatagctatttacctttgtaaaaaatagttcgttctatttaattaacttatttatctatttaattttctttttaagagacagggtcttgctctgtcatccaggctggagtgcagtggcacaaccatagctcactgtagccttgaactcctgggctcaagcaatcctcctgcttcagccttctgagtagctggggctacaagtgtgatctagtttggatgtgtgttcctgcccaaatctcatgctgaactgtaattcccagtgttggaggtggagcctggtgggaggtgattggatcataggggtggtttctcatgaacgggttaccaccatccccttggtgctgtttgtgttatggtgagttctcacgagatctggttgtttgaaagtgtgtagcacctcccaccccgctcttgctcctgcttctgtcatttgagacgcctgcttcccctttccttccgccatgattgtaagtttcctgaggcctccccagaagcagaagccactatgctgcctgtacagcctgcagaaccgtaaaccaattaaacctcttttcttagaaattatccagtctcaggtatttctttatagcaatgtgagaatgggccaatacaaaacttgtgccaccatgcctggctatttttttaaaatttttttgtagagattaggtcttgccatgttaaccctgctggccttgaacttctggcttcgcacggttctcctgccttggcctcccagagtgctaggattacaggcatgaatcactatgcccagcatttgttctattttaaatgcagtatttgccatatacaaaatatgaagtatgtcaggcataataatataatgaactgtaaaatacctattgttcaacataataattacattagtaataatatcttgtatttatctgttttttccctgtttcatcccctattttgtttctacctggcattcaccactattctgaatttagattttatcatttccttgttttataaattgtgttactatatattctaataagtctaaactgtaagtgcgtgtgtattcatgtagatacatatatttgatcttaaattggacatacatctacactgttaataggtaatatagaatttgcttgatttgacacttaaaaaaatggtatcatagaactaccattccacccagcaatcccagtactgggtattttcccaaagggaaagaaatcatcatatcaaaaagacactgggcactcacatgtttattacagcatattcacaataggaaagatatagaatcaactttagtgtgcatcaatgcatgaatggataaagaaaatgtgatatatattttatatatatatatatgtacacacaatggaatactactcagtcaaaaaaaaagaagaaaataatttcttttacagcaacacagatggaactagacgccatctgtgtatcttgggtgaaacaacacagaaacagaaagccaaatactgcatgttttcacttataagtgggagccaaataatgtgtgcacatggacagagtgtggaataatagtcattggagacttggaagggtgggaggggagtgagggatgagaactcgcttaatgggtagaatgtaagtaattagggtgatggttacactaaaagccaatactttatcactatgcaatatgtccatgtaacaaaattttacttgtaccccttaaatttatacaaaaaaccatgctgggcttaatatctaggtgacgggttgataggtgcagcaaaccactatggcacccatttacctatgtaacaaacctgcacatccctgcacatgtaccccagaacttaaaataaaataaaatgaaataataaattatacaaaaaaccaaaacagaaaacaacaaaaatagtatcatacttcatagtagttttgtggacttcctttttcactcaattttcttttgcttacatttattcatatcgttgcatgtgtctgtatttcattctttttcttcttcttcttcttcttcttttttttttttttgggtacaaaatacccagttgagtgggtggaccacattatatttgtacattttcctgtcgatgggtatttggatcccttccaggattgactgtttaccaacagggacacaatgtagtacgtgtgtttggaggcgtgactgcaagtgtttacctacgatatccagtcaggagaggaagtgcggaagcataggcacgtggatttagctgacagatgatgcaaaaatcgttttcggctgggggcggtggttcacctgtaatcccagcactttgggaggcagaggcaggcggatgacttgaagtcaggagtcggagactagcctggccagcatggtcaaaccccgtctctactaaaaatacaaaaattagctgggtgtggtggcgcatgcttgtagtcccagctatttgggaggctgaggcaggagaatcgctcgaacccaggaggcagaggttgcagtgagctgagattgtgccactgcactccagcctgggggacagagtgagactctgtctcaaggaaaaaaaacatttccaaagaggtggtattaatttgcacaacagatagcgttatctaagcgttctctgttgatctagattctcttcaatgcttgacattttcagaatgttgaaactttcgctaattaaatggataagatatttatcacattgtggttttatcttccctgaattaacaaaatcaagcatcatttccaacgttttgaggtctcttgcgtgaaatgcctcctctttgactttctgagttttctaaggagttgtatcttttctatgtatctgaagctttgtatatgtccaggatataaatcgtttgatctcttcttttccaaagattttgcgcagtttttctcccatattggcatttccttttcattttatttatggagtctttagaaaaacaaaagttcttaagggtaagttgttagcatggcatttccttcaatggttaatatttttgtgtctttaaaaaagaatccttttggactccaagatgagagagatatttttcctatatttccttctagaggtttaactttaatccatctggaaatatgtgtatgtgtagtggagggagggttcatatggctttcattttttccatatggaaaaccaattgtcccagctctatttattgaatagttcctcatttgctcactgatctgtaatgtcacctccttcctgtattatattatagcacacgttgactctaatgcttccaacagggagtctctgtgctcctttgcttggagtctttatctgacccggggagcccgatagttggacatgtgtcagtcaagccatagtgctgagaatctaggagatcccacaaagaaccgccctcagctgaggactgatgaatgttgaagggcaagtactctcactcacctatcccacagctggaaagagtattctactctttccaaagcttgcagcactctgcatcctgatctcttcttatgagatgtcttagtccatttcaggctgttatcacagactaccatagactggatggcttgtaaacaacagacattgattctctcagggtcacggaagctagaagtctgagattaaggtgtgggcagggctgcttcctcctgaggcttccctgcttggcttgtagattgtaaacactgtcttctccctgtgtcctaatgtggttgttcctctgtgtgtgtgcagagggagaactctgaaatggtttcctcttcttataaagattaagacccctctcacgattttacctaaacccaatcatccccttaaaggctctgtcttcacataatctcacatgggggttttgggcttaaacccatgaatttggggcaaaagggcacagttcaattcatagtaattattcaaccaaagtagatgattggcttctggtgggaaagagggaataaaaatggagagagtattatattagagaaagagagatgagagcttcatgtaaaatttttgagaaataggggagcctgggaatggatgatttggagagtcgagatgatgcaatattatataatctttgtgctgagagtgcaggaccgtggctaggtggtttgaaatactcaagacgaagtttgaaattggagcttacttcagccggggtcttcaccctggttatccatggtggtcacctgcttggtaaacatcccattcaaggactttctccactctctagctcattattccactttctgttggtgcttcctggctcgccacccagataaactccttaatagaatctttgtatcaggattcagtaggttaggtgtattaaatgcattttagacttgcaattttgtttttttctttttttcttttttatttttttgagacagggtctcactctgttgcccaagctggaggacagtggtacaatcatagcttactgcagcctcaacctctggtactcaagtgatccttctgcctcagcctcccaagttggattacaggtgtgcaccaccatgcccagttaattgttttttcttttgtagagacagagtctcgatatgttgcacaggctggtctcaaacttctgggctcaagtgattctcccatttctgccttccgaagttctgggatttcaggtgtgagccactgtgtccagcctagacttacactattttcaacttataacaggtttattgggctgtagccctattgtgaaagtcgaggagcatgtgtactttgaacagccctggacacgagatacacattaaatgactgagaaactaaaaccctattttagatagcgtgtttctgttgctgtagaatgagtcacctcatctatcaagaccaagccatgaatgcacttgagttacattttttaatattttcatggactcctaaaaatctccagtgttcttagatctcaattccaagaagagccggcttgtagactcgcagctgagaggcaggctatggtgaactcagacctggagaagatggaaggagtccagggagaaatggaaaatgatgaaagctttggcaaaagggtggtaaattgttcaaagaatgtttaaagaaaaaaaaatgaacagcaacaacaactttagaaggaaatggaactgattaaaagagtcatttttattccacttctgcaccatggaatggagtcacgcataacttgcatataattgaacattaaaaaaaattctgtagctcaatcaacttctcttggcagtgagcccatagaaaactcagaagaatcttttcagaactatttatgagctgtgctacagttgatgaaggtctggttgaggatggtgacagaggagaggaacggtattggccacaggcttaaagaacagcatatccatccactaaggctgtcgtaacaaagtcccacagagctggtggctcaaacaacagacattgattctcccacagtccttgaagctggaagtccaagatcaaggtgtgggcaggggtggttcctcctgaggcctctcttctgggcttgtagatgccgtcttctccttgtgtcctcacagggtcatctctctgtgtgtgtctgtgtcctcatcttctcttcttatgagatatcttagttcatttcaggctgctacaagagactaccatagactgggtggcttataaacaacagacattgattctcccacaatccttgaagctgaacgtccaagatcaaagtgtgggcagggctggttcctcccgaggcctctccccttggcttggagaagctaccttctccctgtgtcctcacagggttgtccctctgtgtgtgtctgtgtcctcatctcctcttcttatgaggtgtcttagtccatttcaggctgctatcacagaataccatagactgggaggcttaaacaacagacatttactctcccacaatacaggaagctggacgtctgagatcaaggtgtgggcagggctggttcttcctgtggcctctctcgttggcttgtagatgtcaccttctctctgtgtcttcacatgtttgtccctctgtgtgtgtgcagggggagaactctgaaatcttttcctcttcttataaatttgccaggcgtatcagattaagacccctcccttatgattttacctaaacccaatcacctccctgaaggctctgtcttcacataatctcacgtgaggatttatggcttaaacccatgaatttggagcaaaagggcataattcagttcataataattattcaaccaaagtagctgattggcttctgatgggcaagagggaataaaatggagagattattatattagagaaagagatatgagagcttcatgtaaaatttttgagaaataggagagcctgggaatgcataatttggagagtcgagatgatgcaatatcataggttctttgtgttgagcgtgcaggacagtcgctaggtggtttgaaaactcaagaggaagtttgaaattggagcttactgtggaattcacaaagatggtagtcaaaaacatgggaaatattaatgatacagcagcatttttcccaggctgttctgcaagggactggttcttcaagatattaaaaagggctctagaaaaaaaaaggaaggcagggagcaaggaaggaaggaaataaggaaggaaggggaagggaagggagggaggtgaaggagaaaggcagaaagggagaaagaaaaaagagaaaacacaaaggaagaaagagaaagaaaggagggaaagaagaaaaaggaataaagagagggagaggaagaagaggaagaagaagaagacgaagaagaagaaaggaaggaaggaaagaaggaaaggagaaagagagataggggaaaggaataaaaaaaaggaagaagaaagaaagaaaaagaaagaagaaagaaaggaaagaagggagggaaaaagagagagggagaaagacagatagaggaaaggaagaaaaaagataggaaaaaggaagaggaaagaaagaaaaaagaagaaagaaaaagaaagaaggaaagaaaaaagaaaggaaggaaggaggaagggaggaaggaaaggaaggaaggaaggaaacaaggaaggcacaaaggaagggagagagggacaaagagagagagggagaaagagaggaaggggaaaggaagaaagaaagagaaaaaaggaagaggaaagaaaaaagagagagaaaaacaaaacagaaagagagagaaagaaaaagaaagaaagaaaaagaaagaaaggaaggaaggagaaagaaagaaaaagatattttgcgatcaaataagatcaggaaatgcatggtagctcctacatcaacttaaacacattagtaagctttgtgattatacatgggggaatgagaattgcacatactgtttctcctcttcttcactgcctcccctttttttttgcaggagcacctgatgtagttgaggcaggtgagaggcagctgccacctctgagggcagatgggggcaggagggggcagggaacggggattgaggaccggcaggcaggatgggaatgagaaaaaccagggagatgacacacctgtggggcagaacccagatcagttgggaactcgccgtggctctctccctgatcacaacgttgtcaccagaccttcgaagtccagccctggaagtgactcagggactccctcctgggatgattcccttttattcacctgggctgcagtgcaggaggctgactgggttcacccatctgccctggacaccctaggaaactcttagagtccaccattctggttcctgaccctatgttcactcatgcccatctcttggcgtctcccgggaagcttgggcaagccctgctctctgacgtctgagcccaaatctcaccctggaaccctgatctaccaaagctcccctactctatatgcccaggaaatccagggataccacagtgggaatagaagatgctcaaaatacgccacagtgcagaattccacctgctgcttgtcactttgcaaatccctgtgtgaacccaaccagatggctgatattaggttccaagtctgaagccgtatttacttgcagctactgagagcacatttgctatcagggtgtgttctcatttcctagagtgggcaacaaatgaccacaggctgggtaggttaacacaacgggaatgtactcacccagtcctagaggccaggagtctcacatcaaggtgtgcgcagggccaagctccctccagaggctctagtgggggatccttcctgcctctcccagctcctgggggctctaggcatccctgggcttgtggccgcatcactgcagtctctgcctccatctccatgtggccttctcctctgtttctgtgtctcctcttctgtctcttggaaggacacctgtcattgcatttagggcccatcctaatctaggatgatctcatctcaagatccgtctcctaattatatctgcaaaggctgtatttctaaatacaaggtcccatttacacgttcggaggcataggacatgaacacgtttggggtcgccattcaatccattacggttgtatccagttccctccagaggctctaggtgagggtccttcctccctctcccagctcctgggagctccaggcatccctgggcttgtggccacatcactccagtctctgcctccgtctcctcttctgtctcttaaaaggacacaggccattgggtttagggctcaccctactctaggacgatctcattttgagatccttaacttattacaaagaccctatttccaaataagatcccattcacagactctgggcattaggatgtggacagatctttccaggggccactatacagttgtacccagttccctctgaaagctctaggggaggctccttcctgcctctcccagctccgggggctccaggtgtccctgggcttgtggccacattgctctagtctctttctcactctccttgtggccttctcctctgagtgtctctgtgtctcttctctttatatggacactggtagatctggggtccacccagataatccactatgatttcatcccaaggtccttcgcttaatcacatctgcagataccttttttccaaataaggtgacattctgaggttctagggatttgacatagacatttctcttccgctattctatggtatggaaaagtggaaaaaagcaaatactaaaacttgttaataaggacctgtttcctctctgtgtagagcctcttctgaaactcctggtatgttcttgcatgaaaaatgcctagaccgcgatgaggactggtgtaaacggtagatatcatctctatagcaacacataaattagcattcagaaatgcagctttgcagagagaagaacctttctctgagttcctacactcaattctgtataagattcatttatttattattattttttctttttgagacagggtttagctctgccactcaggctagagtacagtggcacgatcagagctcactgcagcctcaaactcctgggctcaagtgatcctcccacctcagcgtcccaagtggctgggattacaggtgttctctgccatgtctggctacattttttatttttactagtgacgagatctcattatataatcccagcacttcgggaaactgaggcaggaggatctcttcagcccaggaattcaagaccagcgtggacaatgcagtgagacctcctctctactaaaaataatttaaaaaaattaggcaggcataatagtgcatgtccatagtcccagctactccagaggctgaaggagaatcagttgagcccaggagttccaggctgcagtgagctatgatcacaccactgcactccagcctggtgacagcaaactctgtctctaaaacaaaaaataaaataatacaattcaatgaaataaattaaaaaaacatgtggacttagagtctacttgtaatccccaccactggagaatcatttagtacagcaaagctgaaagaccaggaacggggactttccaacgtttctacaggacactctgaggcaggggggctgcgcttccttgaatgccatatctgtggataaaatcagcacattatcattagtacaggactggtctttttcttttctttacttttttttttttttctttgagactgagtcttgctctgttacccaggctggagtgcagtggctcactacaacctccaccgcctaggttcaagcgattctcctgccttagcctcctgagtagctgggattagaggcgcccaccactgtgcttggctaacttttgtatttttagtagagacagggtttcaccatgttggccaggctggtctcgaactcctaacctcaggtgatctgcctgccttggtcttctaaattactgggattacaggcgtgagccactgctcccagccagtacatgactattatttggaaaggtgcatggtagaagctgctcttggcagagaaacctgcgtaagaatcccccttgaagcttggagggatattactgggatcattgcttaagccatgggaaactggtttaaaaaatttgggagtggtttgcataatgtaaaacagggaagatgcactcagaggagaagttaaaacagccatggtaggtcagcctctgttgcagtcggggtagaaggagaacttggttgtcaaagtgtacgttgaattgagtttcggaagaacaggtcactgaaatttatcagcaaacttgatttaatggagattttcttgtgcattcgggaggtttttttccggtattccacgctgttaaaattaatgtttgagggcccagaatgagcacaagtgtttttgtaggcagaacctctgtggctccatgctgaagacatcagggtgtttacgttattatgtgggcaactaatgatggaaacagattttctactcctattttcttttactgattcatttgctaaagacatgtaatgtaagcagaattctccaaaggcatttaatcatagaagtgatggctaaaagaagccaacgattctgaaatgtcctaatgggatatttggccatttaggtgacttcactaccttcttgtgacagaatctttggacacagaacatcattctcacttcatattccatgagtacatcatcatctccacattatgctaaggcactcgttagtcacaaaatcaagaattcacttctgaaatattttaattccatgtagctctagtaaattttctttctttctttttccttttttttgagacagggtctcgccctgtcgcccaggctagagtgcagtggtgtgatctcagctcactgcagcctccgcctcccaggttcaagtgattctcgtgcctcagcctcctgagtagctagaattataggcacccgccaccacacctggctaatttttgtatttttagcagagacagcatttcatcatgttgcccaggctggcctcgacctcctgagctcaagcgatccgcccgccttggtctctgaaagttctgagattacaggtgtgagccaccttgcctggccctgaattttatttctaccatgctactccagaaatgtagacatgtcaaggatgtaaaatcatgaatagcatatgacctagcaatgaccttgtaaagtgattatatttatattacacataacatcctactaaacaattgtattacatttcaagatgtaaaaggaagaaaaataagccaatgttactcaaatatgttcaaagccacatggaaaagaaaatctgcgttatttcttctctggaagctcaaatgcctgttttctgccaaaagtgtaatttgaacagaaaaaaaaaaaaaagttggccaggcgcagtggctcacacctgtaatcccagcactctgggaggctgaggcaggtggatcacgaggtcaggagatcgagaccatcctggctaacacggtgaaaccccgtctctactgaaaatacaaaaaaaattagccgggcatggtggcaggcgcctgtagtcacagctacttgggaggctgaggcaggagaatggcgtgcacccaggagcggaggttgcagtgagcccagatcgcgccactgcactccagcccgggtgacagagcaagactctgtctcaaaaaaaaaaaaaaaaaaaaagttgagtgtgtttcagacagctgttgtcagactttggcaatggataagtggaaaaaactccacacaaggtcaagaacttcttaggatccttagtgagaaagtgattctgaaatcgtttgccatggacgttcaaagacccaccgacacacaagcaaatgaggtcgtgtttggaagagacacacacgcgttgatgtaaaaatagcagaacagtacaagagcagaatgcgatgacatttaacaaagtaagaattttttttttgtaaattctagaaagtgacactctaagtcagcgtgtttcttcaactggatgatcaagttcacagcccaagaatttgcccaacttccttagatgtcctcctctctaaacgatggtaaggatgatgttatgagattcctgaaagggaagccagattgcttatcaaagacgtgtgcccactgagcctttccaagtgctttactctgagatggtccaagaggtgtttctgagaaggctatttttattgtctttggtgacacattatgtgatgcagatgtggtttccatcaatccatctagaaagtctatgcatagggttatgtctcactttccctattagtgacctggaggaagcactgcatttttgtatgcaatgatacacccatgcatgccaacttccatttatcctctttgaagatgcatgacagtacttttccttggctcttcaaaactcccaaaggggaagcaggacatgcttcctggtggtttcacttgtgttgaatctagtctcaagcctctggcatcttctgcaccccaagcctctctggacctgtgtcctggagttgctgtaggggctggacccatcatcataatgaattacaatgtggggaactcaactggacccagaaaatgtccccaaagtgcatccttatggctgagtacctccagggttcacagaaggaatgaggacaagcaaactgtgaagcaagaccctgacacaaagacacagctcaaatttagcctctgatatggtttggctgtgtctttaccaaaatcccatcttgaattgtagctcccacaattcccatgtgttgtgggagggactcagtgggaggtaattgaatcatgggggcaggtctttcccgtgctagtctcatggtagtgaataaggctcagaagatctggtagttttataaaggtgagtttccctagacaagctctcttgtctgtcaccatgtgagccatggctttcaccttctgccatgatcgtgaggcctccccagccagatggaaccatgacttctttcttttgtaaattgcccagtctcaggtatgtctttatcagcagcgtgaaaatggactaatacagcctctctggtttaccagtgaacaccggatgggaccaggattcatgttagagaatgtcccctgtatttgaatccatgtggattctctcactcttctgacccagcttggtgttttaaatttctatccttaaagtccttttcttcccacaaatgtttgctgttgcaaagttcagtttactagtgtatggggaataaaacacatggtcatgatagcctaagctgtaccatgcaacagcaatggagacggctgtcctccctcccaacagcttaatgcaaagaaacttctgctgttgtagaactctctttttttttttttttgcctgatcctttgaagtcaagagttttattgttactattatgattcctcctccagtcatctgcaatcatagcttcaagaagaaaattcttagccaacctcagagtccctttatttgcatgttgcccatggtggcaacaggggatttttggtggtcagggtacatatctgcctcaaatcctagattcatgatcacagcaccccacaggatgacacacaggttttttgtttgtttgtttgtttgtttgttttgaaacaggatcttgctctgttgcccaggctggagtgcagtggcacgttcacggctcactacagcctcgacctcccaggctcaagtgattctcccaccttagccctctaagtagccggaactacaggtacctggcaccatgtccagctaatttttgtattcttagtagagactgccttttgccatgttgcccagactggtctcaaactcctgggctcaagtgatccaccagcctcagcctcccaaagtgctgggattctaggcatgagacactgtgccccgccagacccacaggtttgatttagtttttcaagagcagtttaagaagaagcaagactttttcattttaatgttttgctatttttagcctcaagaaggctgtgttccttgcagaagtggcatatcagctcaccctgggacaagtggcatctggtgagatgataggcagctgaggttattggtgttatttgcaagggatgggtgctgatgattgccattacatcgggtttccctgatgctcagttaactctaaaggagacatggggtgagggctatgagtagggatgtggggaaaccccatggctgggatgccaagagccccacctgggcttatgtccacttcagaatgcaccatctcatggaaagcaagacatcctccacctacacttagcattttcactaccacacactgagtttcccttatctgagatgcttgggaccagaagcagtgacagatttcagatttgttcagattctggaatatttgaatatgcatgagatgtcttgggaataagacataagtataagcataaaattaatttgtgttttatatacactttatacacatagtttattgtatagcctttcatatacaatactgttatttttgttgttatcatcattatacttttagagtcagggtctcactctgtcactggagctgcagtgcagtggtgcagtcacagctgactccagcctcagtctctcgggctcaagtgatcctcacaactcagcctccccagtagctgggactacaggcacgtgccaccatgcctggctattttttttctagaaatgggctcttgctgtgttgcccaggctgatctcgaactcctaagctaaggctgtcctccgccctcagcatcccaaagtgctaggattataggcattatccactgtgcccaacctatacaatattttaaaataattttgtgcatgagacaaagtttgtttacagcgaaccaacagaaagcaaaggttgaccaggtttggtggctcacacctgtaatcccagcacttcaggaggccaaggggggtggatcatttgagcccaggggttcaagaccagcctgggcaacatggcaaaaccttgtccctacaaaaaaatgcaaaaattagccgggtgtggtggcacacacctgtagtcccagctactcaggaggctgaggtgggaggatctcttgagcccaggaggtggagattgcagtgagccatggttgcaccactgcactccagccagggtgggcaatggagtgagaccctatctgaaaaaaagtaaaaaatagatagataaataaataaataagacaggaagcaaaggtgtcagttgtcagtctctcggtcatccatgcagaaaatctgacatcatgtgagcattccaaaagttaaagattttggaacattttggattttggattttcagatgaggaatgtccaccttgtactgagaaagccttcatttattggtaggagggaggaatctagggaaatctaaggaaagtactcatgtcagaagtgtttgaaccagggcgactctatcttgaataggggctgggtaaaatgaggccaagacctactggactgcattcccaggaggtgaggcattctaagtcacagaatgggataggaggctggcacaagatacaggtcttgctggtaaaacagcatgtggtaaagaagccagccaaaagccaccaaatccaagatggcaacaaaagcaacctctggtcattctcactaatcattatactctaattataatgcattagcatactaagagacactcccaccagcaccatgacagtttacagatgctatggcaacatctggaaattaccctatatggtctcaaagggagagaaaccctcagttccgggaattgtccactcctttcccagaaaaataatgaatatttcacctcttgtttagcatataatcaagaaataactataagtatcctttgtccggcagcccaagctgctgctgtacctatggaatagctattctttacttcttttctttttcttttcttttttttttttttttgagacaatcttgctctgttgcccaggctgcagtgcagtggcgcgatctcgactcactgcaacctccacctcccaagtttgagcaattcttctgcctcagcctcctgagtacctgggattacaggcatgaaccaccatgcccagctaatttttgtatttttagtagagacggggtttcaccatgttggccaggctggtctcgaactcctgacctctggtgatgtgcctgccttggcctcccaaagtgccgggattacaggcgtgagccaccgtgcctggccattcctttactttcttaataaacttgctttcactttgctctgtagattcaccctgaattctttcttgcacgaggtccaagaaccctctcttgggatctggatggggaccgctttgtggtaatactcagaacagaaaatgagtaattatggggatcttacttcttaaaccaaagcaagataaggtgtgtgtaatatcacactttcctcttaaactgtgtcccacatgtgtgacaatatctaaattcttaaaataaggccctaagggttctcctcaattacctaggagttccctggaaagcagataattatgaagtgctctaaccaaataactttatagagaaggaggtttgcttatcagccattctttcgtttttccttctggagtcctgtacttacatgtacacgcatacatcagccctatatcagctctggggaatgttgtgtttggaataagccagcgagtttgttgtgttcccataatttgtccggaggtgagcaggtgactcaatctaatctatgtttaaagattgaagagaggaaacctaggattggaggatggggaaacagggggagtaaggtgcaggagattgtcatggaaaccaacaagagtcctggcctcaatccacacctctggttactaatgtggatttgaatccacttccatccatgaatatgcaaatgaaaagtttctgagacaggtttcaagcaacttagaaagtttattttgccaaggttaagcatgcgcctatgacacagcctcaggagatcctgagaatgtgcgcccaaggtggtcgggctacagcttggttttacacattttagggagacatgagaaattaatcaatacatatcagatgtccattggttcggtccagaatggcaggacaacttgaagtggggacttccaggtcataggtagatttaaagattttccgattggcaattggttgaaagaattattatcaatagaaaggaatgtctgggttatggtcaggggctgtggagacctaggttttatgatgcagaggaagtctccaggtagcaggcttcagagaataaattgtaaatgttccttattagagtctgttctttcagtaattccaaaatgggggagggtatcatgagccatgcccaacttcaccttcatggcctgaacacatttttcagattacacctgaaaaatggaacgcccttgccaagaggaagagtccattcagatgatgggggcgtggggacttagaattttattttaaggcttgtagatacaaccattctatctatgcatacaaagaggtatctatcatacaagaagaactcccaatgggcagaacatcattgtgtacacatttgactctagaattcactcttctttttgtggctaaacgggcttctcatacaatccactaggctcagaaaggttcaccaaaaaatacaatgggttcttcgtaaaaggcaagagtcaaatgctaagttgatagctgtttttaatcatacaaagagctgtgtttaaattggataatgggtgtgtaataatacattctcttctttatgacttgacatcattatgaaatatgagctctggctaaagctcaggataatgtgggagagaattaagttgagaaaaccagtttctttcataatggacaactgagaaaagttttgggatttccattacagcagattttttgaagactcacttaatgttttctgcaggatggcttagcattcctaaattcagttgagtaccaggatattataaggcttttctgtttatttttgtaacaatctgttttcggagaaccttctctgacatagacattttgcttggggccaagaatacaatgatcacatggatgacacattcactctctttatgaagtttacagacacactgcaaataatgaagtagacgaagaattaatgtcagtaagaagactgactccagagaaaagtgctgattccttaactacctaggaagaagcaaatacagattccttttgtttgaagatgtgtttatatttggagatattcaggaaaacaggaagccctcaaaatagtacattgaaagtccactaacatggaaagtctccataagccagtcaatagcatttgtaatctgcattatataatgcactgttctgctttcttaactagactttttttttgctaagtaggtttgtgtattagtcagggttcaccagtgggacaaacctaataggatctatgtgtatatgaaagggagtttatgagggagcattggctcacatgatcacaaggtgaggttccacgataggccatctgcaagttgaggaagtaggaagccagtagtggctcagtccaaatcccaaagtctcaaaagtagggaagctgacagtgcagccttcagtctgtggccgaaggcctgagaccacctggcaagccactggtgtaagtccaagggtccaaaagctgaagaacctggggcctgatgtccaagggcatccagtacgggagaaagatgaagaccagaagcctcagcaagtctgctcttttcaacttctcctgcttgcttcattttagccgtgctggcagctgattggatggtgcccacccacactgagggtgggtcttcctctcctagtccaccgactcaatgtcagtctcctctggcaacaccctcacagacacacccagaaacaatactttaccagctatctaggcgtcctgcaatccaatcaagttgacacctaatattcaccatcacagttgataagcaacctagtttatgataatctgctatagctgcctgaaaaaaaaactaagtaggtcttagaccacgactttgccccatattatcaaaattaggacaaactttttttattatatgtctgggactgacaaaacaatcactcttagacaaaaattaaattgttagctatgatgaccagtgctgagaagatcacatgatggataccctaaaagccctgacttcaccactatgcaatctatgtctgtaacaaagttgcacttgtaccccataaatggacacaaataacataattgaatttgcttttcaatgatctttaagcatcattttcactcaagttagaaaatgttttgtgtcaagtagaaataactcacaaggatttagtaaaagcgtggtagatccaggctgacatctctgcccttggcaaatagcacccaaacatcttgtctttcctaatttagaggcctctcctgtaaccttgtcaatgagtgtagtccactatcaaagccaaagtgaaacaaaaccctttgctctctgcccatgggagctaaagtgtggaattgcaacgaggtccagagagaaatgcaagaaggtctgttagattcgtgaatcaatggatgcaagtaggtcactaatcaaagcctcagttgcaaaaacgactgcttgtctagcatgacttcagctgcaataacaaactgccaaagactgggtggcttataaaccacagaaattcatttttcatggttctggaggctagaagtccaagatcgagatgccagcggctctggtgtctggtgaagaaactctgtctggtttgtcgacagctatattctcattgtgtcctcgcatggcagagggtgggaggagagaaagggagggagggaggagagagagaggaagtgagagagagagaggaagagagagaaagagagagacagagagagagaggaagagagagaaggagagtgagaaagccccagaaagggggagacacaaacactcaatcaacatcacccacatttaaggtattggacatttgggtgctgatattttgagataattttacttctattcaaaattagatctgtcttctacacagaatccatgtattctttatttttatagattaagtcctggttcttctagagaaatgacagactcggagagcaggaaatgagtgtgtttacttaacaacacttaaaagtgatcccactcactgtgaaggtcaggcagagtacagtctttttgtaaattagtattattttgtatttttaatcacagatccaggttgtgcaacttttcaacccagcagtacttttacttggcattaggaaaaggccctttgaagtttgatgacgatgattttttttttttttttaaaaaggatgttgagaggttggatggactctcatgcaccacaaatgagctttttcttctttgcagaaaagcctgttgcttgaatgggtgtctttacctaaacttaaaagcaaatgctatcaacagtttagataaaacctttttaatcatagtccaagctgagctctgctttgctgtggatttgctgtccttgtgtgtgatttgccgcacttcacactgataaccttgaactatgttctcagtttattataacaaaaaacaatcaaattatgcaaaatcttattttgtaaaacgagtttgatgattgcttaaatcttagtcatgttttaatgttagtatactcttctctcagtgaagttatgcatttttaatatctaagaatagtattatatattattctacatgtttgctacccacacattgagtaacataaagatgacttcctaccgcccctgcattttcttctgtgcttacttttttttaaaaccgttaattagaatctatgttgctaaaaaacatgttgcaacacaaaaactggcctgtgttctcatttcagcacatgcattttaaaagagatgctttcttctccattggggaagaagatatggctgacactgactctatcttctctaacgcctttctttcaccccacttctcttatctcccttcttttaacttgaaagaacaggagttgagatttctctcaacacataacattccaaaggaaataaattcttaaatggaaacttaccaaacttctcattctctatttccttccaactttttcataaacacccagatgattttttttggtataaagtcatttttcatgggaaacctggaagagttgttgaaagaatatgcagtgctattttctctgtagctctgacttagtttctgcagtacattgaggttaaaaatgatagagttctaagggaggaagctgaggaagagaatgaactgaaacctaggaattacaaccattgtgtgaagtctgttttgagatgaacagaaactattaggttggtgcaaaagtcattgcggtttttggctggatgcagtggctcacgcctgtaatcccagcactttgggaggccgaggctggcagatcacttgaactcaggagttctaggccagcgtggccaacatggtgaatccccgtctctactaaaaatacaaaaactagccaggcatggtggctcacacgtgtaatctcagctactcaagtggttgaggcaggagaaccgcttgaacccagggggcagaggctgcagtgagccgagatcacaccactgcactccaacctgggtgacagagtgagaacgtgtctcaaaaaacaaacaaacaaaaacccttaatcctcagtgcaacagtgcgggggtggggcttttgggagatgtttaagtcatgagggcttcacctttatgagcagattaataaaataaatgagaggaagtgagtttggttcccctcttgctcttctccctttcaccatgggagaatgccacaagaaggcccttgcaagatgccaacatcctgatcttcgactttcctgcttctagaactgaaggaataaatttctgttctttataaattactcaagtcttgagtattctgctatagcagcacaaaacagacctaggccccatgccctccagtgtctccatccacaaagttatttgatggaatcttcatagatcagtcttcctaaattgctgttttgctcttgccagttctcatttccaaaatgttttagcaattccccgttgactaaaggatggaattgcagatgaaaattgagaactagaagacaccatagggctatactctctacccctgcacatagaaatgaagaaagtatcctgctagtgaaaattcctatttgttggctaatatgattatatcttgaaatttcttagtggtggtggatggtgcattactccatgtcacctggccccattgactttctgtgttcttccacattttactttttttccttttaaaagtcagggtctcactctgtcacccaggctaatgtgcagtggtgcaatcatagctcactggggcctggaactcctgggctcaagcaatcctcccacatcaggctcctgagtagctgggaccacaggctgacaccattgtcctcagctaaccttttctttaattctttgtagagatggagtttcactatcttgcccaggctggtctcaaactcctgggctcaagtgatcctcctgcctcggctccccaaagttctgggattacagacatgagccactgcacctggccttgtgttctctcacattttagcaactttggctgaaggtgtaacagcaataatgttcaaaaagtaacttttattaaaaataagcattaagcatcatagcatcaatgtattctcttttaataacattgactttctcccgttaattttccctttataaaacgtacgtaagggatataaacacatttgcaaaatcaaacctattttgtatttgtatcctaccaaacacaaaataataataatgataataataatagttataaataagaaataaataaaatatttctaaatattttatttagatttagatttatttatataattattctaaataattctacaataaaattattccatagcctcatatatttcaactcaaaagtgatcttggctggtgcagtggctcacgcctctaatgccaacactttgggagactgaggtgggagaatcgcttgagtgcaggagtttgtgaccagcctaggcaacataacgagatctcatgtctacaaaaaaaggttatctcacatgccacatgcccttcagaaactgatagactatattgataatcacctctaaattaacaacataaagaaggtgaatagtacaagttttccccaattcaatcaaataataatccaaaatctgaaattctgaaagaacaaagtagtcttgggcaccaagccatgatttacaaaatactcttagatggcttgaaaaatctatggctcttcttataatactagatttcttagataggtccagtagactggtagacttttttatggttttatgcattttctctttttaaaatttttatatttaatttgagatctggggtacatgtggaggatgtacgggtttgttacataggtaaacgtgtcccatggtagtttgccacacctatcaacccatcacctaggtattgagcccggcatgcattaactatttttcttggtgctctccctccccctgctcccctgataggctccagtgtgtgttgttcccctccctgtgtccatgtgttctcattgtttctctcccacttttaagtgagaacatgctgtgtttgattttctgttcctgcattcgtttgctgaggataatggcttccagctccatccatgtccctgcaaaggacatgatctcattccttttcagggctgcatagtattccatggtttatatgtaccatgttttctttatccagtctaccattgatgggcatttggattgattctatgtctttgctattgtgaatagtgttgcaatgaacatatgcacacatgtatctttgtaatagaatgatttatacttcttttggtatatacccagtaatgagattactggatcaaatggtatttctggttccagatctttgaggaatcgccaccctgtttgtgtgcattttttactgttgcataacaaattacaaacttggtggcttgaaactatccccatttatcatcttggagtgatataggtcagatatctggacatgttctggctgggttctctactcagggtctccccaggctgaaatcaaggtgttatcagggttgcagtgtcatctgaagctgggtgccttcttctcagctccctggttgttggcagaattgagttcctagaggctgaaggagtgtgtctctaacttgtttctagctgttagccaaagccatactcagcttctacaggtagctggccctatggccctttccacaacatggcagtttttttgtctgcaaggtcatcaggggaatttcactgctactttggatgtctgacttccctgtgtctgactctaggcccagttttagatggctcatgtgattaggtcaagcttccctttcttagggtccacctatttgggacattaatgatgtctgcaaaatcccatcacagcaacacccagatatgtgtttgactgaacaatgtgcgtgcttaccagggcccaaagtcttggcagccatcttggaattctgcttcctacaattgcctattcacacaacgaaatattacacagcagtcaggaagaatggatgagagccatcagcaggctggagacccagggaagggctgatgttgcagcttgagtttgaaggcattggaggcaacagtctctcttctgcagggacctcactcttttctcctaaagctgattggatgacgccagtccctacatgaaggtctagctatggattcaggagctttgaagggctcagaaccactttctctgttggagaccatgtagaggttggacacaataatttaaacatccacagtcatctatcattttgtatcataaatacctggtctaagtacagcatttatcgagctcgtaactggtgactgtctagcccatcagttggtgtgaccacagaaaggtgctagaatctaggagtggtgacctagaaggacaatggcaaacatcacctttcttcttgggtaatttgcaacagaaactgtttattcactgctctacctccctccctaccgcttatggactgacttgtgtccctgctaaatttataagttgaagcctaaaccccaggacctcatttaaatataggtttcaagtatgactaaaatgactgcatttgaacattgggtctttcaagaggtacttaaggtaaaatgaggtcactagagtgggccctgatccaatagaactggtgtcttataagaagaggaaatgaagacacagacacacacagagggctgatcacatgaggacacagggaaaagatgagtccacaagccaaggtaagaggtttcaagagcaaccagctctgcctacaccttgatctcagatttccagcttttagaaccataaaaagacagatttctgagttttaagccaccaagtctgtgaaactttgagacaactttagcagacgaatgtactaccctcaccagcaaaagacaagtctaagttcttggccaagtatggtgttgtggttgagtcctctgggactcatgagatggtgtagcctcataagtgggactagtgtctgtataaaagggaccccagagagctccctcaccctttccaccatgtgaggtcacagcgagaagacgccgtctatgaaccaggaagtgggtccccaccagacactgaatctgccacgccttgatcttggacttcccagcttctataactgtaagcaataagtttctgtttataagcaactcagtttatgataatctgctgtagtagctgaaaaaactaagaagcaggtcttaaaccatgactgccttatattatcaaaatttgaacaaatatttcttattatatgcctgggactgacaaaacaatctccattaaacaaaaattaaattgttagctataagaccagcgctgaggacggtgagggagtgggaagacaggatgcatgggaaacaacttaatgggtgccatgtacatcactcacatgatggatgccctaaaagccctgacttcaccactatgcaatctacgcctgtaacaaaattacacttgtaccccataaatggacacaaataacataattgaatttgcttttaaatgctctttaagcatcatttttaatattgtcttcactcaagttagaaaatgtttggtgtcaagttgaaataactcacaaggatgtggtaaaagcgtggtagatccaggctggtatctctgctctgtattttgttaactatctgtctttatgaaagccatttctattggcatcaatttttttcagctgcaacatgaaggcatgcattaaataatttttgagatgcattgcaactataaatcattgataatttttgtaacaagaagattcacagctgcgacatgaaggcatgcgtttagtaacttttaagatgcattgcaactatgaatcatcgataatttccaagattcacttggaattccatttcttgcatgaacttgcatttaattccatatgttagagggagttggagggggaaaatgagattttattccagggaaggatataaagggtgttaaacattttttgctatgtaaatatacaggtcagctttgcagaaattttaaacattttgcaatgggaagcacagggtccttggcatctcaagaaaacatctgtaaacctcaataatatgggaagaatcacagggttttcaggtttgtagttttaggaggcttagaagattatgatgagaatttctttaggctccagaaaaaattgtctctcttttttcacagctgctttttggtgtttcttgaggctttattttaacaaccatgtgcacatgtgattttattataagccacatcaaatcctttgattctatgtggaggcatatggagtgtaaattatgtataaatgagcagtgagcatacatttggctatcctaggcagttttgtggtttgtggcagaaaattgctgtgtgtgagagcacctaggaggagagatgtggcgtttgatgtccagagacagataggactcagtaactactatggacagatgagaaggaaggctcattatgttttctctttgaaacagctttcttgggatataatttgcataccacacaattcacccatttatttcttatttttattttttatagatagggtcttactctgtcacccaggctggagggcagtggcgcgattatggatcactgcagcctcagcatcctgggcttaagtgatcctcccacctcagcctctcaagaaactgggactaccagcatgtgccagcatgcttgcctgattttgttgttgttggggtcttgctatgttgccccagctggccttaaactcctggactcaggtgatcctcccacctcagcctcccaaagtactgggattacaggtgtgagctaccacatccagcccagttctcccattttaagtataacacgcaatcatttttaggacattcatagttgtgcaacaatcaccacaatcaactttagaacattctcatcaattcaacaagaaattccacactttttagctatccttgcattattcctccaattacccctgatcccacatcccttggcaaccagtaatctgctttctgtctatggatttgcttattctgaacatttcctataaatggaatcataccatatgtggtccttggtgacgagtttctttcactgagcttaatgttttcaaggttcttccacattgtagcgtgtgtcaaagcttctttcttttttaaggctgattaatattctattgtgtatggctagaacacattttcatgataacattcaaagagtcagaaacaagtctacaggctttccaggccaaattctaggtgtggtttctctcggcaaagcattctccctgaacccccagagctgattgctgtatcgggccctgtcctggtaaggacagagagtgacattaactcatctctctttcttgggcctcacagtcgtctgtgtgatcgctgccagcacaatgtggaagggaagtcttggtttggctaactgcaacgtactcatggctcagattctgaccaaaagagttatttcattaaagacagacagggcaggtagaaaagcaaagcgcttgtaaacaaaccatgatgggcttctcccttccccctctttgcttccttccttccttcctttccttcctttctttcctttcctccctccctttctccttccttctttccttccttcgttcctttccttcctttcctcccttccttctttccttctttccttccttccttccttccttccttccttccttccttccttcccttcccttccttccctccctctcactctccttcctccttccttccttttctttccttctttctctttctttctttctttctttctttcttttctttctttctttctttctttctttctttctttctttctttctttctctctctttctttctttccttccttcctctttctttctttctccctcctttcttctttctttctccctcctttcttctttctttctttttttctttctttctgtcttagagacggtttcactctgttctcacccaggctggagtacagtggtgtgatcatagctcactgcagactcaaactcatgggctcaagtgtccttccacctcatcctcccaagtaactggggctacaagtgtgtgctatcatgcctggctaatatttttatttttatttttgtagagacagggtttcaatatattgctcaggctggtctcgaactcctgggctccagtgatcctcccaccttggccttccaaaatgctgggattatagctgagaaccaccttgcctagacccctgtctttctgaaggactgaacacactacttgggtcagccaaggcagagagatgtcttaaggccagtaaaacaagcaacgaagtgagccctcagaggagggggctatttcacaagaccactctcacttcggacaccagttgcaggttgagaagagttcccaaaactaccctcaagtttagtagttccctagaaggactcacagaactcactggaagatgttacactcacatttgtggtttattacagtgagaggatgacagatcacagtcagccaatggaagaggtgcatgggatagaggtccaagccaagtaccaaacagagcttctattatcctctccccttggagtcagggaagtgttggtttctaggcatcagtgtatggcaatatgcatgaagtgttgccaacttgggtgtagtagtccattcctgccttgttataaagaataaatggagtctgggtaatttataaagaaaagaggtttaattggctcacagttctgcaggctgtacaggaagcatgatgctggcatctgcttctcaggaggcctcaggaggctttcagtcacggcatagggtgaagggagagtaggtgtctcacgtggtggaagcaggaatgagagagtgaggaggggctacacacttttaaatgaccagatctcatgagggcacactcactatcacaaggacagtacgaaggggaatggtgctaaactattcatgaaaaatccacccacaggatccaatcacctcccaccaggccccactgccaaccttgggaatcacatttcagcatgagatttgaagcatatccaaaccatatcactgggcatatcacctgagccttggggttcagtgtttactgaggcttcattgtgattgattaattgtctatgtggctgatcattctccagtctcactggaagtctaccaataccatggaacctgaatcccattgttactaatggatgtggctaccctgactccaaatcacactgttagactgcccagtgtgaaccaacacccctacagaaacaaatacactcctgtctttgtttggcacacattccaaaggcttagatgtcaagttttagagtcaacgccaaacccagacctctccttgagcaaagttaaattctagccaactccaaagcccagacctctccttgagcaacgttaaactctttacctccaggtctgcagaactgaacagatgtccacatcctaatcccccatgtgggagacagaataatgcccccaaagatgcccacattctaatccccatgtggtggaaaaaataatgtccccaaagatgtctgcatcctaatccccatgtaatagaatactggccccagagatgtccacatcctaatccccatgtggtagacagaataatggccccaaaggtgtccatgtccaatgaatatgttgatttacatggtaaagcagactttgcagatgagatcaagttaaaaatcttgagatggggagattattctggattatttgggtggattcaatgtagtctcagtggttcttatagaaggaaggcagggattcagaaaaagagaaagaggagatgtgacaaagagagtggaggttggcgtgatgcaggaagaaagaaggcaccacaagccaaggaatacagcaacctctagaagctggaaaaagcaaggaaacagattcatccatggagcatccagaagaaccattcttgcagacacccttatttcagcccagtgaggctcagttaaatttctgttttggccactgaaatgaagccccttcctttataaggcaaaatacctagaccagcagccagaggagtcatggtttaaggtcctcagtggcctgcgagtgtcaatgttgctacctttggctgtacctacagccagcagctgcaacccccactcatggcataagatgccaaaaactgcaaggtcacaggaacatgcagccagcactttacgcagcctccatggggctacacaagaaaccctgatattgcaaaacagctcagagttcattgtttctcagcatccttctcagggtctcctagatgatgactttgggcatttaaggagcaatttatgtgtgcccctccccacttggttaggagcccactgcaaagtctacagggggtttggggagaaataaggacttctgtctatcactgctccagttacaatggaaagagagcctgtcacatgacccaagcaggctccccctcctcctgcacatgagcctatgctactggatggaaggaaaagaagctcaaagctgccttctcttaatatccttctctgactcaatgattcctacctggaggtggaagatgctgagaggacacacacgtttttatggagggagagaaggagagagaagaatggaggaagagagagggagagaaggaaaggaaggaagagagagaagaaagaagaaagagagagggatgaaggaagagagaggaagaaagggagagaaagaaggaaggaaggagggagggagggagggaaggaaggaaggaaggaaagagagagaaagaaagagagagaaagggaaggaagggaaggggaggagaggagaggagaggaaagaaaagaggaaaggaaaggaaaaaaatgaaaagagggaggcagagtgagacagagagtcagagagagaaagaggaagaaagagagaggaaaggagagaataagaagggggaaatggagaaatataaaaaggaccaaaaaaagaagagaggggggagggaaggagagagaaagaaggaggaggaggagagagaaagaaagaaaaacaggaagcagaggggagaaagagaaggaagtaagagaaagagagggaaagagggtgagagagatagaggaacgaatggtaaatagagagaagggagaaatggagaaagggagaagagattaagagaaagagaaggagagcagacagagagagagatgagatagtcagagagatatgaatggaggaaggaaaggagaaagagagagagaaaagaaggagaaggaggaggaggaagaggaggaggaggaaagagaaagagaaagaaaagagggggagggagaaagagaaagaaggaaagagagccagacagaaaggaacaaatggataaacagaggaaggaagggatggagaaagagaggagaaaaggagagagagggaaggaaggagggagtcagggagaaagagagacactgtgtgcttgaagaaaagttacaggactggctatcatttcctccggaggccaacaaaactctccctgctcgctaagccccactgaatatatttgaaagagctagtaagagataaaataaaattgctttgtgattatactcaatgagtcatgcttgttcgacacaccagttacatatgctttccccctaagagccctcaagaaataccagtcctatagtgtaatagagttggatctccaagagctgtttaggagcaagaactcagccgacaggatttctggagaatttctcctggcttgtctctgatcaagcaacgtcaccaagaggcgattattaaccccattgatgttggattcctcacttagagaaatgacggaatgactccttgttcatcctcagagctccttttattttcaaagttctatctcctaggtaaagattaaatttctgtattttatactaaacaactccaggctctaaccgtgttcgtctgcccatgtgttcaagatgggcacgcacatcagaatatcttgaacttgctggaagaagttaaggagcattcatggtctccatcttaggtgttttggagggtctgtagaaggttggggctattgctgctacagagaccatgactgacttcatgaggcttgttctgattgttcacaacaatggggtttggacaagaagatgaaggtgatgtgacagggttagatcctggagaaactcaactcactttggacagataatgggtgtaatgtcccctgattgtctggacttgacagcagagggcagcccacacttggactggcattattcagcacatgtgccattacatgtcattaaccttaacatgaaactttcacctctcagcccagatgtcttacccaaaactttctgggtttgtgggttgatgggatatctcttggttgactggattgttggcttggtggctgggttttgcatctctgacactgtcttcatcttttgtcctcctggcttgaattttgggatgaggtattctgcagtaggcaggcctatgcaaacctttccccaaaagtccaagaaagctgagaagtcaaagagagaggctgacacatctagtttctcagaaaaaacaaacaaacaaaaaaaaccccaaaacatttcataggtacttaaaaacagaagccatgtttgtgtcttggatggcagagagagaagatggtggatctccacaccactacccccaaataacccaggacttatataccatggagtaaggggtgtgtaggatgattgtttaagggcaggatttatggcaagaacatgctcttacacaaggaacagtagatagaatagaaatcttagaggcatgcctggaactagggtcaatcagaagtcaacatggtggattagcattcaagatggagctactttagcctccacatgaagatactttgatgatgaatgatgcacctgttctaaaacatgggtgggctgacacctcagcactggccctggttttgtctccaggactctcagcaactgcagacctcacaactataggaacaagcttcctactcaggtcctctggctctccagagcctctctgtttctgaactgtactgacaatccctgattctttacatgagttcctcaccacttgcctcatcccagccgtgagacttctggataggcacaaccacgtgattatattatcaaaggcttgccttccaactgaaataaccttataggaaattgttttgacatttcaataaaataaaccctcttgaagagaagccaacacaaataacctttgtaataaattctgctgtgctatagtaagatagtcacaggagttcacttccattcattgaaagtttaggggaaaaaagggggaaatcttacaagaatataagctcattcagttcatgcgttcctagaaggagaggttgagtttgcatagcttggctctttctcaagtccaagtctagtcaagaggcagtctttataaacaatgatagacaacttttctggggaaagatttgtttggaaagaaatggaggataattcaaaagaggtgattgaagccttagtacagtgggctttaaatgatgggttgtgtagtgtttatttcttcctgttggtggaggagagtgattaagggcttttcctaccttaaggtgatcaaagtggtattttcataagattaatctggcggcagaatgcagatagttctcagcctccccacccatccttggcgtatatagagcacctgggggcacatatgtccaagacagagacgtatacaggcaaagtaatgctttaatcttatgtctcagactaaacataactcagaggaagacaatgttgggaagagcaccaagaacttaagacatttgtgcacattccacattagccatcttttacatcacccctcggagcacgagagctctttcacttacttttggccaaattggatacagtttgccttcgtaatatgagggctatatagaggcatttcccaaaataaaagagtttatacgtttgacccatcccagattttgttcaatgctctagttcatgctttggtggtttcctcagacacagctgaatttataaacattctgagatgtcccatagatagaggattcaacctcagttcttccacctagcacacttgcttataaaatgacatgtaacctatgagttggctgaagccatgctgaaagccaatttttaggttccaaagcagagaatcttacaaggatgtgctcattttcactttgagacactgaaagagttggtgtctaggtggtctgggataataacctaagcacataatagctctaagcacgttgtcattaatccttttattggccatagacctccatgtggctagccaactgtaaagaacaccacccacctcagtggaaagcaggtgaaggggagaaatgcctcaacccactcaacattagtaatagtcagaatggaactgatagaataaaccctgggctcaccccttagaggaaaacttaagagcttatcttccttttatatttttcattctgtaatgagattgctttttgctagtctaccaatatatatgctattcatttttaatgcaagaaaaaaatatgcatacctaatacaaacacacacacatgtatgtgtatatgtgtgtgtatgtgtgcatgtattaggtaagtatgtgtgtatgcatgtgtattttttcttgcattaaaaaaaagataacagaatctttgaccacaagattttgggtaaaataccactttagtttatggaatagcaacctagtaaaagagcatgaatgttgaaagttataaagtcagaattctttgaggatcaaagactttttcagcccatcaaacatccaagagtaattcaatgtgaaaataggatttcttccccttgtgggggattcctcaatcgctgtttcttcatttaagcgacatttggacaggaataaaatgagaaagtacatgattcttccaaagtccctgaattttcaatgcgaccatattggagatgttcttttttgaacaatgttcccacaactagtaaagctttgtctaattcaagtccataagatagagactatgatacagacatttgataaatatacacctgagttggtaggttgcagaaggagctgctttgtgctttgaataactcaatttggtgatccacagtggattgggtggcttattcccagatcctcaccatcctttgtggtcagtagatatgtccaaccagttgatatggaaatggtcgtgtagatttaactgtaggaccaaggcacatgcagtggacttcttttgtcctggaagaaattagatcaatttcagcattgacaataacatctgagcttgggttgcttggctttcctggaagcatgttctttggtgtgcaaaaagagggtagatatatataattagtttgaaatttttaagggactttgatcaacccgtataagggactttgatcaacccgtatagctgcataacgtgtgtgggctttgtgaaatgtgctgagcgctaatttttaattctttcagcaacacacattcaaatgcaaacctgaatgtgtttgttgtcatgcaaaattaaaataagaaatgtagaaaattctttaaaatgaaaatgatagggactcaccttattttgttttttgtttgtgtgtttattttttgagaaagaatctcgctctgttcccctgggctggagcacagtggtgcaatctcagctcactgcagcctctgtcttccaggttcaagcgattctcctgcctcagcctcccgagtagctgagattacaggcataggccaccacactcagctaatttttgtatttttttgtagaaacagggtttcactatgttggccaacctggtctcgaactcctgaccttaagtgactctcccgcctcggcctcccaaagctctgggattacaagcgtgagtcagcgtgcccggcctttattttgtttctaagatgggaaatgaacctaagactcttgaagacatttacaacgtcaattttatcaaaacaattgagagaattcaggtcataattttgagaaacaataaaaatggtcagacaaatgctgtctatgacgagtgaaagagctctatgagttttagaacaatggtctccaaggtagggagattttgttctatgccaggggacacttggcaatgtctgtagatattcttcagtgtcacaactgagtggtctcactggcacctggtgcgtggagcccaaggatgttgctcgacaccctacagtgcacaggacacccccaccacagagaatcatccactccgaaatgtcagcagtgccagctcaactgcaaaaccctgccttagcatgagagactctgtgtgcctgtctgtcatctatttatctatctctctttttgtccacctatctgttatctgtctatcatctatatatctatccacctatcatctatttggtcatctatctgttatcattattatctatctatatatctgttgattatctatctatttatctatcaatccatctgtattagtccgttttcacactgctgataaaaacatacccaagactgggtaaattataaagaaaaagaagtttaatgaactcacagttccacgtggttggggagacctcacaatcatggaggaaggcgaaaggcatgtcttacatggcagcaggcaagagaaaggatgagaaccaagagaaaggggtttctttttattattaaaacatcagatgtcctgagacttattcactatcaggagaacaatatggggtaaactgccccccaagattcagttatctcccaccaggtccctcccacaacaggtgggaattatgggtgctaaaattcaagatgagatttgggtggggacacagccaaaccttatcaccatctatctatcgatctatctgtctatctatctattatctatctatctatctatctatcatcacaatggtttccaactgcagtccactttgccctcaggggacactggcaatgcctggagacattttctccaggtggagggttggtcctggcatctggtgggtggagcccagggacactgctcaacaccgtagagcacacaaggatgccccaccagagaatcatgcagccccaaatgtcaacagtgccaaagttgacactgctgctctgatggcactgttactctgttatagaagccatgtaggtctaaaaagatacaatgtagagagtagtggggattccagatgtgcaaatagagtaacaagtctctctggttttattttgtgtttgttttgttttgctcctgcttgggaggagggagtggaagaggggagagaagccaaataattggatgctggggatatccctaaatggtgggaccaatgacaaatcatcagtagtggcgacactaaaaagaacttaccggaaaagaatcttttatatccaatttttagccatctgtgtagattggctcttcgtgtctccctcatcctctaaaccttctcagcaaagcctgatgcatacaaagaagtcttgtgtgaattattttgtttgattattcctttacttagtcctttattcatctctggaggaaataaaagagtcgggattctgtgactgattcagcaaggggcaaaagagagacagtgtgtggatgttggacatatgatcgacagaatgaactaatgaactcaagacacgtccccttacccccatccatactttttatttactggaatcctgagaaaagcatccactgtttgtcagtcacagaattgggctttgaatggaatttatccaggacttaatatgaacacacctggaatgttcattagagcatctcttctccaaatatgacatcatgggagtgaatgaagcaaatcattttcttggctacttggcttgtaggtcatcttgtctcatacctggagaaaaatgtcagcttcactctatggtgaagtcttaggataacatctcttatgtagaagatgtgagtttgccttccagctaaaataaccttataggaaattgttttgatatttcaataaataagctctttgaataagagccaatacaaataacttttatattaaattctgctggtctatggtagaagtttaatcataggaggttacttccatacactgaatagtcagaaaaaacatcaaaaattctataagaacataataaagctcattcagctcattcatatctagaaggagagcttgaattcatgtaagttggccttttcccaggtcctaggctagtcctcaaatccagcctgcattttctttacgcccactgctactagaaaaaacatctggcagatttggaatatgaataacatcagagataaccagagaaaatctgctggccataacgagttgaggacaagctataaattgtaagtttgtgtcaattttcatttcctaaaggcagcttttataaaaggcattatttcatcccattaagagcttgggctgacatatgaatgcatcccataaattctttaccataatttgaccccattttgattatttatagccacaaacatttcttgagcagaatttcagaactttatttggaaagacaaattctgatataaattgaaattcactgaaacattcatatatatacacatacatacatacatacatacacatatatatactgtttaatatggatactctttttatatatgctgttttacctatatatataatcctacagttccatgttgtgtgtgtgtgtgtggagagagagagcatggcgcatgtatatgtgtgtgtatatatgtgtgtataaatagtacatataagtgtgtttatattgtacatatatgtttgtgtacatgtgtgtacatatagtgcatatacatatatgtatatatgatacatatgtgtatatgtgtgtcatatatagtatgtacatctatatatgtgtgttatatggtacaaatatacttgtatgtgtatgtgtgtgtgcatatatagtgcatatgtatgtgtatatgtatatataaagtaatatatgtgtgcatatatagtgcatatgtatgtgtgtatgtatatataaagtaatatatatgggtgtatgtgtgtgtgcatatgtacacagcatatgtgcatatatacacacacatagacatatgcaaacacacacatacgcccatgtatattactttatatatatacacatacatatgcatatatacacagtataactatatatatgtcatatataacagtatatacatgtctgtatatgtgtatatagcatatgtatgtatatattagtacatgtgtgtatataaagtacatatatggtacataagtgtgtgtgcttatatagactacattatatgtgtatatatgggtatgtataaagtacttgtgtatatatgtgtttatatataaagtacatatgtgtgtatagcacatatatgtatatatgcacatatagtacacatgtgtatatatcagtacatatgtgtgtatacatacaatacatatatgtgtgcatatgtatatgtgtatgtataaagtacttatatatgtgtatatgtgtgtgtatatattgtacctatgtgtgtgtatatgcctgtgtgtatacatggtacatatatgtgtatatattgatatatgtatatgtgtggggtgcatataaacaaaatatcaacagtatggaatattacggggtaatagacctgggttttggtcccatctttgattttgaggcaaattttcgtatagtccatgactaataataaaatacgcatgaaatgaaataattattttaatccagggagcaacacagtgttcagctcatcacaaacccacacattttcagagtttaggttttatcgaaggctaaagttgggatctgttcactagtgttttatctgcttccacaatgtctgatccaaacttcacatgctttcagtgactcaagacaagtaaagggacataggcctgtcggatttctgagagccgagcagcccctcagaggcacccactggaagactggatggcctgtgtctcctcagggcctgactcagcagggctgaagacacttcccctctctgatgtgtgataaatttagctaagaggttgcttcatttttgctgttcatggaagtgaaatcatgcttatttttggttccagtttcaatgaaatgtcattttcaatcaagtttctaattgaattttgtcttgtttttttgctcccccgagaaaaagaccatgaaagccagaatatatgtatgtgaaaatacatatattcaaacctaacctcaaaaaatatagtaagagctgaggtcacaaagaagagaaaaaaagtgtttctatttttcagtatttcagaatctagttggaaaaagtggtgtttatacaaccaataaggaatcaaagtctataaggtcagtaagaggggtcatgaacagacaccatgggagtggagaggagcgagagatgaattctgatttagggaaattaagagacattttaggaggagcttgtcctaattaaggctctaaagtcagataaaaaatttacataataaaaaataaaccagagactcctcaaactggaggtggcggaaacaaagagcagcacagaaaagcgagtccccgcactaagacagaagagtgaagactgggtggccagcatggtggagctgaggtgggtagggggacgatcaaattgatgagatgaatgtcgggtcagagcagctttgtgggacatcaagggaaggctcagagttagggtgtgtttctatgtgggaaggtgttgactgggtgtgctgagatgggagtttcaggtcatctccatgttgtggatgatgtaacagatgtagaggatagagacagagaaagacagagagagagaaagaaagagagaaagagaaagagagacagagagaaagatagagacgatagagacagagacagagagaaagatagagagacacagaaagacagaaagagagagagaaagactgaggacaaaagaaagactgagaaagagagaaagaaaaagagggagagcaagagaaagaaagaaagagagaagtcagaaggcatatgtgtgtgagaaagagagagacagagtcagtgccagagaaggaatgaggaaaacaaatagaaagggagaaagaaagaaaaacagaaagaaacagtgagagagagagggaaagaaaaaagagagaaaaagacagaaacagtgagtgtgtatgtgagacagagagagagagagagagagagagagagagagagaaacagagacagatggagttatagggcactggggcactagctgtctggaagctattacaagctatttattatttctttatttttccagaatgaccagcatgttattgatgagattgacattatgtaagggaattctctgtctgttcattctttttattttttttgagacagagtctcggtctgttgcccaggctggagtgcagtggtgtgatctctgttcactgcaacctctgcctcctgggttcatgccattctcctgcctcagcctcccgagtagctgggattacaggcacctgccatcacacctggctaatttttgtatttttagtagagatggggtttcaccatgttggccaggctggtctcaaactcctggccttaggcaatctgcccacctcggcctcccagagtgctgggattacaggtgtgagccaccgcactgtctgttcactcctatgtcttttactatctccttctaaaatgcaagtgtctgcaatttcctcacctttttttacacacgtaaacatcaaatttactattggaaccattttaaaatggcattaagtccatccagaaatttgtccaagcatcagcactctctagttcccgactttttcatcatctcaaatacacagctgctgtatttacaatagccagaaagtgaaaaccatccagatgtctatcagcagaggagtgaattaagaaaagatggtccatctatagaatgaaatcttattcagcctatattaggccgttctcccactgctataaagaaatatctgagactgggtaatttataaagaaaagaggttgaattggctcacggttctgcaggctgcacaggaagcatgatggcttctgcttggcttctggggaggccccaggaaaatttcaatcgtcgtaaaaggtgaaggggaagcaggaactcttgaacgtcttacacggctggggcaggagcaagagagagagcagggtagtgccacacacttttaaacaaccagatcttgtgagaactcattcactacacagtaccgagggggatagtgttagaccattcatgaaagattcactcccatgatccagccatctcccattgaggattgcaattcaacatgagatttgggtgggaacacagatccaaagcatatcacagccataaaaagaaatgcagttctcacatggctacaataaagatgagtcttgcaaatatcctgctcagtaaaagaaccgcatctcctatgacttcacttatattaaatgtcctccattattttctatgactaggctatacattgattggagcttttatacatattgatctatacgttgatagttgcggagataattgaacaaagatgcaaaaaactgtccaggtgcggtggctcacacctgtaatcccagcactttgggaggctgatgggggaagatcacttgaggtcaggagttcgagaccaacctggacaatatggtgaagccccatctctactaaaaatacaaaaattagccaggcatggtggtgcacgcctgtattcccagctacccaggagggtgaggcaggagaatcgtttgaacccgggaggtgaaatcgcaccactgcactccagcctgggtgacagagcaagactgtctcaaaataaaaggtgcaaagaaccaaggagatctccggggagtacatttcctacagggggaaatgtatgaccttccctttaatggccgaattgtcttccactttaggttgaagtcttcagagtgttcctgtttcctttcgcctttgaaatggcagtgtctgggatagatggtgtccgacttgctatgccaaatggggtaagcattatttttcaggagggtagattaggcaactctattaaagaggctgcactgcattctgtaaatggtatgaggctaagaggacatgtcctttgggcaccatccaagccggaatagaagccaattccaccatcgccttcactctggtctttctttctcctgcctattcaataatctccccaagctcttctttttcatagaactcaattattttcctttgatgaacttatacaaatttgaagtacaaattttctatggttttcttaaacaaatctctcttttgctgctctgtaaaatccataaggtctctgttgttatgaccagtgaccaggaaaattctgggcatgtgaagacctttgggtaggcatctgttgaatgggtgaattgatgaatgaatgaatgaatgaatgatgtaattaattgctaataagacccaagcacacagtatcaatcatctataaagctggcatatcaaagctttgttatatcccaaaagagttaacccagcacacaaggagggaaacacaacattttatttcattttatttcacctgtgccagttattcagataacctctaaaaactgtttaacattcacagtgtagccaaataaacagatgctggtaaacttaactccataaacggtttcactcaggagacagaggcacattgttttatcagagtttcaggatacgcgttgggaatcactgaatcctagagcggccaagggctgtgtgtctcagccctttcagatgtggggtgctctgtctctggagacccctggcttccacagtcctgggacttgtagctgactgagcctgggctgatttctctggtagttcttcctggatgtggcccaatgacccctgtatagatggattagtcagggtttgctgcagagacagaactaataggatagatatacatatgaaagggagtttattaaggagtattgacttacacaatcacaaaatgaagtcccacaacaggtcttctgcaagctgaggagcaaggaaaccagtctgagtcccaaaacctcagaagtagggaagccaacagtgcagctgtctgtctgtggccgaaggcccgagaggctctggcaaaccactggtgtaagtccaagaacttggagtctgatgttcgagggcaggaagcatccagcacaggagaaagataaaggccagaagactaagcaagtctgcttttccatcttctcctacctgctttatcctacctgtgctggcagctgatgagacagtgcccacttagactgagggtgggtctgcctctcccagttcactgactcaaatgttcacctcctttggcaacaccctcacaggcacacccaggaacagtactttgcatccttcaatcagtccagttgacactcagtgttaaccatcacagtagattttgtttgtgcccaagttcctgaaggctgtgtgtatccagacccgcacatagatcagcaggatacttgacgatctcaactggataatggaatcttttcacgcctcctccactttctttggaaacccatttttaagacacctcaaattcttctatttgaaacacttttctcaaaatcccatcaccaacagtgaaaaggattctggcaccaacaacactggaatttgaattgtttgtgctaagtggctgtctttttggaatgtcccctctctttaaccacttcccctctctgtggctttctgtctgctttcttaaaccctgggttttggaatttgatcattttgctcaggacatctgagcagttttcttctacgaagaatctgaggatgaaaggagaccacagactcctccagaagaaagaaataaggcattgcattaattcgtaaaactggtttcaaagacaaactggtatttataatcatctccggtagggttcatctcccatcccgcgtcccatataaaaattagtgagactgccaaaatccttatctttcatgttccttcttttcctgtgaaaaagacaagtgccaaatcttgttaactcagcacgatatatatgcctcttttctccctgggacttcgtgtgcctacgtcccttctgattcagggataagagattctgctttcagggtgaagtgcaactgaacgtgtttttggtgtctcgtgagcaaagccctagtgagcatgctttgtaaggtgaaatatgcctttgatatatgacagtgtttatatgtatagttaagctttttcagctttaacaagtctgagagtagtctttgagaagttttaggggttatataatgaagacaaagaagttactttatgaaagccacgtactaaaataattcatgttggtttgcatgaattatttatgtctggtgtgcattggaaatgctttctttttcagcgagaatcagttttcttagccttggctcctcagaaaagaagatcactccttatgttacagttctgtgcccattgtaaggtattgctgtggcgttttaccaactgaggagggtctcccacgtgtctgcgaagcctctgagtacttttctgtgctttttgcttcctctgtgtctacaaggcatgtgtgcaagtctccatcttgttggaagaataatccccttcctctcccatgagaggtatatggaagttactgtaggagcacacacacagagtgttgtgtttgagttttctggggctgctgtagcaaaagtgtcacagaccgggaggcttaaacaacagaaatttattctctaccatttctgggcaccagaaatctgaaatcaaggtgtctccgggtggtgctccctttggaggctctaggggagaatccttcctgcctctcccatttctgggggacttcaggcttccctgggcttgtggccgcatcactccagtcctgcctccatctccatgaggacttctcttctttatctgtgtctcgtcttctgtctcttacaggaacacctgtcattggatttaagagacccctctaaatctagccataatctcatcaatagattgtcaatttaattgcagctgcaaaagtcctatttccaaataaggtcccatccctctatacctggtgttaggatgtggacatatattttgggggccactgtgccacccactaccatatggacacttcctaactgatgtcagaatacatgcacttcccaatagttatatgctgcccggtgctttgatgaactgttgacttttggtttggagaaaacccacatgtctagagctctagctattccacagaacttaactcttactgggctctttccttttatgttcttgtaagacatgcttaaactgcttgagtgttatggttcatgtttcttttctttttcttgcagtgtaaagcctgttaattcatggccagttcaccaagaagtatcaaattcaattatatgaacactgttttttccccaaacaaatgcccttgtgttaaaaccacacacagcaatagcaatggcaactgcaacaattgcccccagctctacttaaatcacttgcatccccctattaccaatgtcaatcacctatggccactggaaggctaaggcagcgcatgcatagctattaataaaagtttttgctaaggattgacacattggtagtaccagctatgagctcacagtacaacacagttcaaacaaagaccatggatctaaatttcagagcttgaaagaagcaaatctttgcccagttaacattaggagtcttaactttttccaaggtaagaaagagagaaaaattttggctcatatggacactgttcactggatgtactatgttcagtgagcagatgtgtttgtgtatgcatgagctttggtggggttgtaatgttacttcttaataataattctgccctcatccgtttcctaggagacagaagaaaaatgaaccttacacttttgctggagcacaacatctagatttagttgccttggatgtgaaggttctatgtcctatttatccacacctctcagcggtgcccagaatgccactggcatatcatgaatacattgtcaacatctgttaagtgaatgaattggtcaatgaatgaatgcatttggcgtcatgtaaataagattcttcagggcatcagaaagctaccttatagagtaccaaattgggcatttgcttttaattcatgtcaaccaaacatttaaacatgtgctttgcccagaaatagagcatttgaaacagctaaatatatgccctttccaagtgtacttacctcagctgaggacatgttcagatgttacctttttctccttctagagttattctggcttgtcttcaggttgtgttagttgagttggtgcatttattgtctttgaataaaatgtcgtgatttatgttccctgtctgtcagccacaattctgcagcacaggagataagaagaattccccatgtgttttccatagcatttcaacttaatgcaaagttttacattagcacattcgttttcgctgtcacaaacagtcattatatgagcttttgtagcgttaatgtcattttatctcaattctgggaacatgcaaggataggaatttggtatgtcactgaaactgaatactcccaagttgccaaccagaagatttcagatctactttgttttactttgcatttacgtggctgttctccctacttttgtgtaaaattacaatgacacttgctgctttcttctaattttatggttctctatatagaagtgtagaaagttaaatggccttcagaatgaaagtctgtgttttatccctggcctaaattacggactgcatgttccaatccctggtctaagtcatggaatgcacgtgatatggtttggcagtgtccccacccaaatctcaccttgaattgtaataattatcacgtgtcaagggtggggccaggtggagataattgaatcatgggggcagtttccctcatattgttctcatagtagtgagtaagtcctaagagatctgatggctttataaatgggagctcccctgcacaagccctcttgcctgccgccatgtaagaaaaagacatggctttgctcctccttgccttctgtcatgattgtgagcctcaccagccatgtggaactgtgagtcaattaacctttttactttataaatgacctagtatcaggagtgtctttattagcagcttaagaatgaactaatacagcacatcctccccaaatccatatgtggaagccctaatccccaatgggatggtcttagtaggtggggcctgtgggaggtatgtaggtttagatgagataatgagggtggtgcctgcttgatgggattagtgtctttataagaagagaaagagactcagagctccctctctcctccatgtgaaggtacagagacatggcaccatctgcagaccaggaaggaggaaggaggccctcagtagacaccagatctgccagcatcttcatcttcccaggctccagaactttgggaagtaacatttgttgctcaagccacccagcttaaggcattttattataggatcctgaactaagacaccatgaatgtgaccttctatagcattagggtctttgtagatgtaattaagctaaaagtcttgagatgaggatgtcatcctggattatttgggcaaacctacctctaatgctataaccaaatgccataaactgggtggcttaaataaaatatgcacgaagggcaagagagacagaagaagaggaggtgatgtgagcatggaggtagatgttggagtgatgtggccacaagacagaacatcaaaaggcaccagaagccagaagcaaagaatggattcactctttgagtttccagagaaggtgtgttgctgctcacaccttcattttgggcttctggcttccagaagtttgagagaacaaattcttgctatcttaaaatttttttttttttttcatttccataggttttgggggaacaggtggtatctggttacataaattctttagtggtgatttgtgagattttggttcacccatcaccagagcaatccactgaatccaatttgtaatcttttatccctcacccccatcctgccctttccaacaagttcccaatgtccattgtatcattcttatgcctttgcatcttcatagcttagctcctacttatgaatgagaacatatgatgttcagttttccactcctgagtgacttcatttagaataatagtctccattcccacctaggttgctgcaaatgccattaatttattcatttttatggctgagtagtattccatggtgtgtgtgtgtgtgtgtgtgtgtgtgtgtgtgtgtgtacatatatatcatagttcctttaccaacctgttgattgatggcatttgggattattccacaatccacccagattatagtaatttgttacaacagccacagaaaaataacacaagaggtgtatgcatattttaggttttgtggttgtcattcattttaatgactggaacagacaattggtcaaaatcaattttagtaatgtgattgccttcctagagtgtcattgagctggatgttggagaactaattataatttctgttccacaatgactgtttttacattatgtttagccatgatttactacaggaattttattcattttatttctccatggcagcgtcacacttccctaataaatgtgacaccttttgcatggtgactatgtggtattaatgaagccagtctcctccttactcacctgatgtataaatctaatgttaatcaaatgcctgttattagcccagcattggaacagtcatcagcaatgaagcaatgagaaaacccaacgggctcctgggttgattgaggtaatctttcagtagaaataaagattgaaattacattcaattctctgtatttgtgatagttgtgttctataaagtcaccataaacactgaattagcaagttgtaaactattgctcccaggggaaatacaagattaggattctatgatgtctggtcacaacattttcatcaaccagtcaatacataatcttgttttatgcatgtttctgtttaagaaaaactttctgagtagatatttttgactcattcacactgaactcatgtccagcagcaccatgactcatgcctgagtaatgcttctctaacacagagattttctctgtgaggcacattgcagtccttttgtactagggaccccagacagcacttcagctctgttcttcaggccattttaaacagcaaaatcaccaacaaaaagcacaaacacgcaaaacacatggtactcaatggaccacaataattctacttgtttaaagtataagagctgaaacaagaaggtagggcatggccttgttccactgtagctgggaatgtgcactttgagcaatttatattttttccagctttgtgtgtgtgtctgcaaatgactgcaaaagtgctgtattgatttcgagattacaaagttttagtgagcaggcaagttcagaaagacaaaatttataaataaggaaaatcaactatacttagaaaacaaacagaatattcataaatctcaggtctgtaaacttttataattacacatggctaactctccagaccattagtcaactccatgccttcaaatttttgttgtatttggttattttctaatgagcattttggatgatag

SEQ ID NO: 126 - DNA, 1706225 bp, Homo sapiens
gatgatttgttagattgagacagcatcatttatggtggcaagggtgctttgtgaaatgggccctgcttctcttgtccttttgtactaggagaaatgttaaatagttagaaaccgacctggattactccgatctgaactgagatcacatgggactttaatagttgaaaaaacgaacccttaatagcggctacactattaggatgtcctgatccagcattgaagctgtaaaccctgttgttgatatggaccctagaataggattgtgccgttatccctaggataacttattccgttgatcaaattattgggtcagtgtgtgttaacttgcttagactagtgcggtcttagtttaggtagtttggaggttgaattatgctctgaaataaaagaaaatttttattttttttgttttttatttatttattttttaagacagagtctggctctgttgccaggctggagtgcagtggcacgatcttggctcactgctatctccacctcccgggttaaagccattctcctgcctcagtctcctgagtagctgggattacaggcacataccaccacacccagctaatttttgtatttttagtagagacgggatttcaccatattggccgggatggtctcgatctcctgacctcgtgatctgcctgtctcagcctcccaaagtgctgggattataggcgtgagccaccacgccgggcaccccaaccaaaatttttaatgcaaagatagtaggctagggcctgtaggctttttttgagtttctatttgcattaatgaattaaagctctatagagtcttctcatcttatttgtttatactgcctcttcatggataggtcaatttcactgactgaaagtaagagacagctgaacccttgtgtggccattcatacaagtccctatttagggaacaagtgattatgctacctttacaatgtcaggataccgcagctgttgaacatatgtcactgggcaggcggtgcctctaatactggtgaagccagaggtgatgtttttggtaaacaggtggggtaagatttcccgagttccttatactttttgtaatctttccttagagcatacctgtgttggattaatggtataaataatagggtatttattctttattaatattaggctgttaactatcagtggattctggtttgatataagcttatgcaatggagaatgtcttcgtgttactaatattaacattattgcttctattaagtaatagattagtctaatgtaatgttaggagttcaatagagtgattaggatttaaaataattggatgttgagcttgaaagctttctttttttcttttttcttttttttttgagacggagtttcgcttttgttgtccaggctggagtgcagtgacgcaatcttggctcactgcaacctccgagtcccgggttcaagcgattctcctgcctcagtctcccgagtagctgggatcacaggcatgcaccaccatgcctggctaattttgtatttttagtagagatggagtttctccatgttggtcaggctggtctcaatctgctgacctcagatgatctgcccacctcggtctcccaaagtgctgggattacaggtgtgagccaccgcacctggccttgaatgctttcttaatcggtagctgcttttgggccaactacggtggtaatattttttactctctggaggaaggttatttcctagggtctaaacagctgtcccaaagagggacaatattaaggatgggagatttgtctcctgtaaaatgcatcctttctcctctgcaggttatgttcacctggtcctactctgaatgagaatctgctggtttttgaaaggcctgctctgtgatggagggattgcaatgcccagcaaggtgtgggcactttagttaagtcctcagtgtctgagtcacacctctcccccagacagatcaatacagctggctttctgctcgagagacggccagaggccaggcgcagtggctcacgcctgtaatcccagcactttgggaggcccaggcaggtggatcacgaggtcaggagtttgagaccagcctgaccaacatggtgaaaccccgtctctactgaaaatacaaaaattagccgggtgtgggtggcgcgtgcctgtaatcctagctactcaggagactgaggcaggagaatcgcttgaatccgggaggcggaggttgcagtgagccgagatcgcaccgctatactccagcctgggtgacagagtgagactccatctcaaaaaaaaaaaaaaaaaaaagagagagagggagggggccaaagtgggaccagcttggggctgggtactgtgctgcacggtgtgacagctgtggatctggggtgggagcagccacagaccttcctgcactgccctaagccaacaggaccctgatgtgctctgtgtccctggcagctgtggtgctgagaccttgactgtcgagggggtttggtttacagattattttgtcaccgaggtaatgagcatagtatccaataggtagttttccagtcctcaccctcctcccactctctaccctctagtaggccccagtgtctgctgttcccctctttgtatccatgtgtacttctaagctcccggttacaagtgagaacacgtgttatttgggtttctcttccattgttaattcgcttaaaataatggcctccagctccatccatgttggtgcaaaggacatgatttaattcttttttatggtggtgtagtatcccatggtgtatatgtatgacattttgtttatctacttcaccattgatgggcatctagattgattccatgtctttgctattgtgaatagcgctacaatgaacatatgtgtgcgtgtgtctttttggtagaacgattattcctttggctgtatgcccagtaatgggattgctgggttgaatggtagctctaagttctttgagaaatctccaaactgatttccacagtggctgaactaatgtacattcccaccagcagtgtataagcattcccttttctctgcatcctcaccagcatctgtcattttttgacattttagtaatagccattctgactgctttgagatggtatctcatggggattttgatttgcatttctcttatgattagtgatgagtattttttcacgtgcttcttggccacatgaatatctgactgctcttctaattctgttctgctcagctgcacttgccccgctccacgttcaagtgtttagctctggctttcaggaatctctgttaccatacctctgctctctgagcccatacagggatttctgaagggatgaggtagggtgtcagtgatagggtttttttttctctgggattatggggggagttgccaagctcctattagagccaatgaagcccccttcctcagggactttcccaagagaagagccagagctcatactcaggaccattcagaccataaggccttatagaggaacccagtgactccaagaaatggtgagacacaaaagagtctcaggctggaaggggaagaatccagggatgagagctcatcagtgcctgtgacatcatagacatgaccgtacagttctgtcatgaccagaattgggggaaagaagcaggtgaaatggtggtgcagctgccagactgagacagctcagttccttatctaagctttgtcatgtcctccagtcctcccttcagaaaggcccatattccatgatagcccctagaagggtcatgtcttggtgttttacacagaactctttgggtttctccattaacttagctactgtgcccagcagccaccagaggccccagaagaagaaaccagcaggggatctggctgcctgggttcctcgggggtggtctcaccatcaggggtgggtgagaccaccacagccacactgtgaaagtttcagagttttcactacttacagatcctcaagataggcagggtgaccagagagaggcagacagcagtcctcagttccaggtcttatgtagtgacagcagctgcacacttgtgggagaggacttctgttaaaggcttatttgggggtaggatgtcctaatttcatggaattactttccactgagtccttcaaccacttctagcaccaaaggtagttgagcagtttggcatgaggctggagttaaaacagggctctgcagagcaacttcttgtctatcttggtcagcccttgccaggcaacaatcaactgtggtttcttcattactcctcagacacttgggacattcatggtgacctattggcacccaaggaagagaacctgattttaatttggactgataagcaagttttctgaacaggtttatagggattagtttagtctggacagagtgagccggaatcaaaagatactgttaataccagaggactagaagatcccatgtggagatgtcaggtggcttagccattgagaaagaatgacagtagatctgaaatggtccagagcccagatattcaacaaaggctaagagccaaggtgagagggtaaagggaaggtgtgaacgaacgggtgaagccccactgtgtgcttggccagccccacagagctctctgctggtgcttgggggtatgaattctacttctgacatgtcaatttatgtcaccatctcctgtgcctgggtctaaagtcttgacttgtaaaagaaaaaaaaaccaactggggattccaacagacactaccttgatggtaggtaagcggggctgggtaacaagtgagatctctgattccttccttccttccttctctctccccttttcttttcttttcttttttccttccttccctctctccctttcctttccttccttcctccccctccctccttccctttcctccttccttccttctttctttccttccttcccctccctcctttccttcctcccttcctcccttcctttctccctcccttccttcctcccttcctttcctttctttcctttctttctgacagactcttactctgtccccaggctggagtgcagtggcgtgatctcagctcactgcaacctccgcctcccagattcaagcgattctccggcctcagcctcctgagtagctggaattacaggcgcacgccaacaggcccagctaatttttgtatttttagtagagatgggttttcaccatgttgaccaggctggtctcaaactcctgaccccaggtgatctgcctgccttggcctcccaaagtggtgggattacaggcttgagccatcacgcctagctctttctttctttttaaatgggtctctttttgccttttctacctttagactgtaaaaactgagtgaaagtgaaatggaagtaatgaaaggttttggaattgatttgacctatgttcaaaatctagctcctctcccttggggcagtgaccaggtcttccatatctctctttgcctggcacattataaacatacctgggcaaaataaatatcagttttatcatactgtatttaatgaacaaatgaactcactgaccgactgaagaatatggtgttgggagagttgtagatgtagccatcagtaatgcctgttggaggttgtttggcgcttgtttatcctgcctggtaaaactcaagacatatccagtaatagctggcatatgtgaagcttttacagtgtggttggttacatgtaaatggcttccacacatgaaagcacttaaccctttaaacccctctgagaggtagacattgtcatcactgactgtaagatgaagaggctgggctcagaaaggttaagtacttgtgtacttacttacctacttacgtaagtgtccaaagacacacagcaataggttataacaaaattagaagttaaacccggtttgtctcactccaaagccctcactacagcaccatactaacactttttgttggaatctgcagagctggaggttcattcgttgtctgatactgaccttaggccccagtgtcctctctctctaagaaaggggttcatgtctctcaaacaggcataagcacacaaaagcacttggaaaactgccccagactgacaaatcagaatctctggtggtggcatctaggaatcctcatttaagagaaattacagatgaggggaaaatgtccagctctttcatttagtcactgtgcaagtcacctaacctaggagggcaggtatgaattggggctaccaggaaaccaagactttacttacaaatctccataaatcttaaatctatgaaaaactccagacttgctcctggaatggccaactgtaagggtagtggctgagctgctgcaggagtacagcttcctccagatgccacacaggtcaacaccaagttcacagctttcaggctgactacgatggggaatggtggggccgcttgctagagtcccatattctctgtaagtgaagaacactcagtccttctcttggtctctacccagaaaccaagttacggttgagtctatttccaggactgtgaggagccaaggattctgcctgtgatgaagtcagctatgaaatgggtgcgtttttgtgccaggatcccagaagttctgggctgtttccagactgaactcacaagagaagcagcagagaggtagccagaggaaaggtgaatgaggcgcccagctcttgtttggctctgaccgtctgacagccactgtcagctgagaggagccatggtagaactatggaccagtgacggccagtaggctctgcccaacttctctgggttgtagcgagacgattgatccagtctacagggactggttaggaatctttggaaaaaaggaatagtgtcaattgaaaaaaaattatatcaactagttaaaatgtttcagtgagggaaggaggtatggaaacagtgtagagagcccactgtgtaacttaccagggaatgacctggttttttaatgggcctctgaagggctgcaccaatcctggagggtagtattagacataagaggaaatctgtagacttggggtcttgccttttgtacaacatacttccaatacattctcaagtggttagtgttgtattgggcttgttaagcaatggaaagtcaaatagtgagggcctgtggtcaattgactgagagaaacagccctgaactgtcattctgagtgtaccctcctggtggaaggtatgcactagggtgctgaagaaacaaagaccttcctcaccatccttgataaacagcagtttagtgaaaatacctaacctggtactgataatgcaaggtgcccaaaacaatagctgtgcagcctgaggagctgggttatttgcacatccagagctgtgtcacagcaagttgaagtgtctccagatgaacgtcacaaggagagcagcagccatgtgccaaagccctgtcccctccatgaagaaatggaccagaggacattgaggagccaacctggctggactcctagcccccaagacccagcccaaaagctaagtggtagtaaacattccctcctagaagagttacataaaagacttagtaagaagagagccctctgcaccctgggaaacctggattataattctgtctttactgtggattgagccaaagactgttgtgtgcccatccttcctccctctaagaagtatttccatttctagaagagagatgataatctactctccctctcaaagataccacttagagggcctgctttccatgtggggttgtatctctcctttctttctgtgagttacttttccctctctgacctccacttatttgagtttcacccattgacccagataataataggaaatccctagtaatagacatagatgagaactctctccttcacctccataactaatctatcaccgctacattatgttgactatgcgcccaaaatgtacaaaacccatccacttttttctgtatccactgccatcactagactagacaactgagtttctagacctcacagctaagaaagtcttacctggtctctttgctagcactttttttttttttttttttgagatggagtctcactcttttgcccaggctggagtatagtgacctgatctcggctcaccgcaagctctgcctcccgggttcacgccattctcctgcctcagcctcccgagtagctgggactacaggcacccaccaccatgcccagctaactttttgtatttttagtagagacaggtttcaccctgttagccagggtggtatcgatctcctgacctcatgatccgcccgcctcagcctccccaagtgctgggattacaggcgtgagccaccgcgccctgccccttgctaccacttttagctcttctgacctattctccacacagcagccagaataagagaattgtgtctttccctgcctaattattcagtggcttcccattatacttatcataaaatccaaactcttagcatcacatgtgataataaagtccagtcaggaaaacagaaaccattcttgatgtttcaaagaggggacttaatgtaaagaatttgtaaagtgggtgtggtagaattgaaaaaaaaagtgtaaagggaaaactgcagtgacagagatagtaactgtaggaaacagctaccacacatggggtctggatagagaaagggttgggtttaccagaccttggaagcttggaagagaggccccgcagagctgggacttggatttggcgagggtgctgggggttgggagctgggagctgggcagtgttgcctgactggtgctgatacctctgaagagtccaatgaggctgcttctggaagaagctttgttcactgctttttttttccgcttaacatggggaatcttgcacgctggagtgcagtggtgtgatcttggcttactgtaacctctgcctcctgggctcaagccatcctcccacctcagcctttcgaatagctgcaagcacgtaccaccactccaggctaattttttatatttttttgtagagatggggctttgccatgttgcccaggctggtctcaaacttctgagctcaagcgatcggcccacctcagcctcccaaagtgctgggatgacaggtgtgagccaccacccctggccctgttcactgctttatatttggctccagtacctcatatattataggcaatcacatgtttccggaataaatgaatggattctcccaacccttacctgtctacttcaggtcatctagagtggctgacaggcatggattggagactctaacggtacttgttttcatttttctgcccagcagactagaggacaaagcagcctggagggcagaggcaacctaaacatgcaaggagttcaacagttgtacccccatttacctggccacggtaggcccaggaatgggaggagcctactagtgaggccccgaagtgtctcactttccttatctcttccgttgacttgcactggctctcctcatttatccagccaccttctctgagctgataatccaaagcccatcagtaactagtccactcctgtctcctcttctccaccatgaatcaccaatgaagtcatggtgtcccaaataggtcacattccagcccacctctttgtcgaggccctttgaagatgtttttttctgagttgagcagaggctgtgaaatatgtgactttcggagctgtcctgcagagcttctccttaggggcatggtcgaggacagcaaatgcagagagaagcagtggcccaggcagagctcaataaagaaacaaaagtatattctcctcttctgcctttgcttctccttcgtccccttaaattctttttcttctggatttgaggtagaaagcacattctcctttgctcatatttaacttttctcacttagaaaaaaagtgaagctcgctgccagcactcatttaatttcatataaacatgctctctgagggtgaagcaaatgtgactgattttcaatgtgaaaataaaatataaaaactgttcttggagttatttctaaacagaaataacattagaattgcctgaatcatcagaattgtctttcagaaaaatcagattcatcaaatagatctttggcttacaactgttagagaatgatgttatcatatgtaagaatgctatgttttctaggatttgacattttcagcgattgagaattactgtattttgtaaaaggaaataccactactaaatgctgtaaatagaatgatgtcttttgtttccaaagttgatatactagagcaatgcgaaaataataaaagagagatggccaggagcagtggctcacacctgtaatcccaacactttgggatgctgaggcaggaggatcacttgaggccagttcaagaccagcctggtcaacatggcaaaaccctgttagttgggcatggtggtgcaggcctgtagtcacagctacttgggaggctgaggcacgagaattgctttaacctggaatgcagaggttgcagtgacctgagatcgcaccactgcactccagtctgggcgacagagagagaccctgtctcaaaaaataataaaagcaagctattttgtagcaaagttatctcagggtaaacactgcagctgccagtgctgctggcaagtattcttggggcaaatgcttaacttttcaaaaagctcaagagaccatgatgcttgttttgcaccataccttagaaaacgtcctactaccttgtgtgcaccagccaacaaccatagacaaatgtacctatcttctaccactttttatccatggcaatttcataaaagtttaactatctgtgactcatcacagatgaattttaagtttagttcctagtgtttctcatatccatccttcctttcacctaccattctcatctactaaactcttcaggagtcagaatctcttgatgaaccttgtttttcccttgtttctgtgatcttccctctcatgatggcacaaacccttcccaatccaattaattccctcttccccatttcctacccctattccttctctgcatgtcctactgccctgaagcaggctctacacttacatacatcattttcaggaccctgcaggcttctgcacgagtatagtttctgatggagaaaattacaaccaaaggccaaggaagtggagggagaaacaactttattttcatcagaaattagtaatgtttataaatttgtttatagtagtttgtaaattattatcagaaatagtaatgtctataaaccacttactttaagagacaatcaggaactatgatgagggcaataataaaaggagaaatcttacaaaaaattaacctggatgttgtgcttgctctaaggttaagtcacttagggaaacagattcagtattatccaatggcttaaccatccttccttctttctgtttgctttttggtggtggctgggttacaaagagcagtgtcttctgccctgaaggtagcagtattacggtgggtgcctagaggtcaattattggtttagaagagattcaggcccttaacttttacatgtgctttccaggaaaggagacactttctttctcagccctgtgtgaggactatgttagcccagaaagtgttcttggaccactgggtgcccattctcagtgctaggaacaggaagaccctggtttcctggtagaatttatggatcctacagctttctctccatcaaactttaagtcacagtaagataggactctggagtcacaggcacagccaggagaggtcagcgtccttatgctgactcctggtcctagacatgggtcttaagatccagtagtcagtaggtctgttgcaaagtcagggactggctagatctctccacagcagaagaaagctcatacatgctgacctgaggaacttaatctgacagtttaccgacacactcataacgcatctcttccttcctgtgatgagagtactgctttcatgtgtactgtctgatgacgggtgagggcagagttcttagtgaagcctctctcacagtgagaacacctgtaaggcttttcaccagtgtgggtttttcggtgggcactgaagtgggagctattgttgaagattttcccacacactgcacacttgtatgggctctccccagtgtggatgcgccggtgagcactgaactgggaactgttgttgaatctctttccacagacaatgcactggtaaggcttttccccggtatgggtcctctggtggacaatgaggctggaactctggttgaagcttttcccacattgcccacactgatagggcctctcccctgtgtgagttcgtaggtgggcagtgaggttggagcgctcactaaagcccttcccgcactcactgcacttgtgaggcttctcgcctgtgtggattctttgatgccgaacaagataagaacttcggctaaaggttttcccacattcaggacattgagatactttttccagtttgagcgctggcttgtggggagagtgcacactctgagagcagtttttcccacagaggatatgtgtacaggctttgtccctggcacaaaaactctggtgactcatcttctcctgggatggggttttctcctcactctcccctggagaatttctacattgccttcttgatgttggctcactctccaagcctttttgtagctcagagtgccaataaactcctctggactttctctgtaaagccttgtttatttctacttcctctgaatcatcccattttagattttcttttttaatctcgttcttgaactcaaaacctgaaaaaaaaaaaccccacagaaatacaatggactatagagaaggaaaacaatggaatgcaaagttataactatactacgtagaagaaatatctaattgaaattcttcatgtgattaagtctcctgctaattaatagctttttattttctcattgtaatatttttgagctccaaattattacaggaaaattatgccctaaactccaacttttctcctatcttttttcggatgttctgacacaatgacaaactgaggcaagacattaagcactatatcatctgccagtctgtttataggtgtaccctcaattcttgaatgttctaacttctagcagcagaataacaaaaggcaaccctgggcttggccagctcaaacaggaagaaagcaaggtgctaagtacccagccagcataggctcaggctgtgaaaggcaaggccatgctagagaaaaagggagaagatggacctggtctggaggcctaaccagcagtctgacaatgcatagtgaaactccatgggaaaagatgacatgaacttagttgaaagaggttggcaaatgcaaaatcagggctgtaaaatgcaaggggaataacctttaactccatgaaaaccaaaacttggatagggtcacacatcaagatgatgatgatgccaggatcagtgacagctcctactcaactgctaggctaatggcctctaaagtggactttgccatcctttgaccatcagagccaagggagtcttaccaagtctgtttgggaacagcactggcaggtctagtttcctgacttcctggccaggattcctgaagtccttttcatccctgtctgcaccatccacagtgccatcttctacctccgtgggttccccattctggtgattcagctctccagcctcaatatcacttccttcttggccaggaacagcatcgcttgccataggaggtgcagaggcccaggagcctgaaagagcattcatttcctcataaaagatacaaggctcaggcacacggcctctcctcactttgcggtaactcaactgtaggcttttgaacttggtgcgacactgttctggggtccgcagaaaaccctgctcccagagtccttccgccatggccctgtagatctggctgttctgctgacaggtctggagttttccataaaattgagaactactaagaatagccaggagcgtcttggtctcttcatagccccagggcacacctgttgctgggggacaaagaataggtcaattagatctgtcagttagatcatggaggactgtacatactgcagtgtgcagttttggcagcttaaaaagttacatcctaggctggatgcggtggctcacacctgtaatcccagcactttgggaggccaaggcgggcagatcatgaggtcaagagatcgagaccatcctggccaacatggtgaaaccccgtctctactaaaaatacaacaaaaaatagctgggtgtggtgccgtgtgcctgtagtcccagctactcaggaggctgaggaagaagaatcacttgaacccaggaggcagaggttgcagtgagctgagattgtgccactgcactccagcctgatgacagagagagaatgccatgctcatgggtaggaaaaatcaatatcgtgaaaatggccatactgctcaaggtaatttatagattcaatgccatccccatcaagctaccaatgactttcttcacagaattggaaaaaactactttaaagtttatatggaaccaaaaaagagcccgcattgccaagtcaatcctaagccaaaagaacaaagctggaggcatcacgctacctgacttcaaactatactacaaggctacagtaaccaaaacagcatggtactggtacaaaaacagagaaatagaccaatggaacagcacagagccctcagaaataatgccgcatatctacaaccatctgatctttgacaaacctgacaaaaacaagcaatggggaaaggattccctatttaataaatggtgctgggaaacctggctagccatatgtagaaagctgaaactggatcccttccttacaccttatacaaaaattaattcaagaaggattaaagacttaaacgttagacctaaaaccataaaaaccctagaagaaaacctaggcattaccattcaggacataggcatgggcaaggacttcatgtctaaaacaccaaaagcaatggcaaccaaagccaaaattgacaaatgggatctaattaaaccaaagagcttctgcacagcaaaagaaactaccatcagagtgaacaggcaacctacagaatgggagaaaatttttgcaatctactcatctgacaaagggctaatatccagaatctacaatgaactctaacaaatttacaagaaaaaaacaaccccatcaaaaagtgggcaaaggatatgaacagacacttctcaaaagaagacatttatgcagccaaaagacacatgaaaaaatgctcatcatcactggccatcagagaaatgcaaatcaaaactacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtcgcgattcctcagggatctagaaccagaaataccatttgacccagcaatcccattactaggtgtatacccaaaggattataaatcatgctgctataaagacacatgcacacgtatgtttattgcggcactattcacaacagcaaagacttggaaccaagccaaatgtccaacaatgatagactggattaagaaaatgtggcatgtatacaccatggaatactatgcaaccataaaaaatgatgagttcatgtcctttgtagggacatggatgaagctggaaaccatcattctcagcaaactattgcgaggacaaaaaaccaaataccacatgttgtcactcataggttgtaactgaacagtgagaacacatggacacaggtaggggaacatcacacacggaggcctgttgtggggtggggagagaggggagggatagcatttggagatatacctaatgttaaatgacgagttcatgggtgcagcacaccaacatggcacatgtatacatatgtaactaacctgcactttgtgcacatgtaccttaaagcttaaagtataaaaaaaaaaaaaaaaaaagttacatcctggtttctcaaaccgtgccacaactggctattgttatttctaggaagaaatctcactgtggctttttgtctaaaacatgaaaacttttagtataatacaaaagacattccctccactgataatgacttatagggttatttactaaagctgcctatttaatttctcgttaattatcctcaatcctactcattcctcctggagaggtggctggcaataagggtagtggcttgcctgccttgacagttgtgggacttcctgagggtggccacataagaggacacagtgaacaggtgatactcaaggaaagcaaagattcaggggacagaggagctggttgtaacgatatatctgcctgttccctccctgatacaggaatacctcctcagccagcccatctctatctgtttatatctcctgtcatccttgtagatacaggaaactaaatgacagcagttaacacaccaaggtaagaataagtagtaaacatctgagaagagcagttcaggatggctggctactaaataaccctcaccacacacacctgctgcccatctgggccagttcatgaggaccgatttgactagagctgtcccagcaagtgcattccaacatctggtcatgatgctctgaagcgcaccagcctcttcttgtcaccccctcttctccacactgagccaccatcacctcatgcctggatcactgccatagcctatctggtcttcttgcttccactctggaccttctacggtctactttcaacccaacagccagagggagtcccctcctttgttattcaatttaactaacactgagtgcctacaatgccagtttctgagaaatataaatattacatgaaccctgccttcaaggaggtcacagtcctatagaagtctctccagcaaaaagagacacaaataaatgtttacgtagagttaagtgccaaataaagtgacatactcaaagtggtccttttaaaactattactcctctgcccagaaccgcacaaggctcccccatttcactcagaagaaaaaagtccttcatgtagggcctcatgatcccatattagtacttctcaaattatctatgaaggacaggagtcttgtgcttatttcttttgtaaaatacaataaaaatgcaaccgaatagtgcagcagtgtcaaattgttataaaagtttctaattgctccctctcagtctcagctagcagcactcatttgatctggctttctgagctcgttttctcattactcatgggtgtactctgtgccagtgaactggcatgcccacctcgctccagcccaagtcattgcgtctgtcttacactcttcctccatgtaggatatggctgcatagctcatccctcctccttcagcaagtcttttcaaatgtcattttctcagtgagggcgaccctgaggacccaaactgaaaactgcaaaccaacctctgccctagcactcccatcacgctgctctgctgctgcttctctcccattgcgcttatcgccctctaacatcttctgccgcttactgattatgctatggtctgtctcttcccacagggcaggaatctttatctgtttgttcactgttgtatccctaacgacctagaactaggtctgagatactgtaggcactaaattaatatttgtggaaagaatgacttgtcctctcacattctgtctcaactcttacctctaattttaaaggatcctcaatggttgacaagaaaccaaaagtgtgtggggaatacaagccctcattcaataagcctaatgttgtagcagttaaaattacaggtaccattacatgaaatattcagaatagctcaatccacagagacagaatgaagactggtgtctgcaaagggcttgcaggggaaggacggggagaaactgctggatggttgtgggaccttactttggagagatggaaaggttctggaactggacgtggtggtaattatacaacactctgaaagtgctagaggccaaagaattgttcactttacagtggttaattttatgtcatgtgaatttcacctaataagttaaaaatcacaagtacaaaaatatttatatctcaccttattgtattatccatatatacttagtaatacaaatctcaatacagagctcaaaaagacactatactctcctgcaactggacagagatgaggtgcagaagcctgaagcagcagcaagaaatggcacatgatgaagccaggaaactgggagttcctggcaaaggaggggagggatggcaggggcagagcagggaaaaaccacacaccactggggagggcaacattgtagagtgaggcggggcactgtcacagggcctgtgttcacagccttgtgtagtccctcccaccctgggcttagccaggagtaccctgcatgtgaagcagcagaggagaaatctaggcccagtgagctgcagtgtctgtctctgaatctgcatggtcagggaggctgctctgaggaggaggcatttggcccagatgggacagaactgatttgagaaaggcaagagagcggtctgcttggcagaaccttccccaagtgtcctgagatgctgggaaagggcctggttcctcccggaaggcctgggcatagtagactgtcctggttgggtggttttatttgttaatctcctctgccactggggaaactcgggagcgactactgctacctgtgtgcatgagcgcacattcagcatgaacacatctgtgctcctggtggccacctgtctggctccggctctggactacttgttctgactctgtctcactaacattttgcttctccaccgcctcacccttcacctcccatgttcttgactgccggtcacacatgctgcccctttcttttgatctctgcctgtgtctctctggcctgctctggttccccatttacttcctcctttccctccacccaacagtctccccactccctctgtctccctccctctcaagtcctttcagcctctctgaacaactgaacacatccaccttgacctggagggaagatggatccttacccagcgagacgtgactgtccttcctctgggtggcacccctgtagagggccctttgtgcagggcctgggcacatccattcttgctgacagagggatacagctctgttgtcacgcatggctggtccctgtaacaacactggagctgctgctaccgataaaatagcaccactctagcctggggtgggggcagagacaggatcacagttgtcagatcaggggcaaggcaaaggcaggggaggtcagctcccagtgggacaggttctgagccatgtgatgatgtcagagtggacagaatcaaaataacccgagaagccccatggaccacacagaatctttctcatgtctctggaaaggaggagggttttggggtgagagtgggtactcaagagacagaaggcatcaaccacagctcacctgggacccagctgtccagaccacagcacctgtctcctggtcgtggagacctgtgttttgaggcaggttcctgggagcctgaggagcaagccaggctgggggaaaaaacagccgctattagagggcggcttccacacaacagcacagagcagaagctctcaaagtgggctcctgggccagccgcatcagcagcccctggcaacccatcagaaatacaaattctggggccccacctcagatcttctgaatcggaaattctggaggtggggcctaggactctgttttatcactctcccacctccgaatgagtctgaggcaaactcaagtttgagaaccactgccagcgctcacggcctctgtgagttgagaagttcctttcatgagattcctcttggcataagagctttaatttttttttcattttaaagaaaaatatacatgtcagggaaaaaaagagaatcgtagtgggcaaacaaaaatctctccatagccctgccacccaaagataaccagagtactctttaaaataccacagtaacagaaacccttcatatttttcacaccaagataatacattttttctcaagtctccaacttcaagaattgtacaaatatgactgtgacatcgcttaaaaatacaggaaaattaaaaaaattgtacaaataaaatgaatcatgtctatgacttattaatggaacttcagtggcaactcagaggtatgtgacccttcgggaggtgacaacactccagatctgtgagtggcccatgggcctgggaagagcgggagcctagcctggaaggcagcaagtcctgcttctctttacttacagccccctgctgtcccaaagccttggaaatcacacacagagaacacaggtgttcccaaggattaaaaggaaataaatgctaagtggcaaagtttataaagatgttgacaagagtattaactttgcttaaaaaaaaactaaaatcagccgggcgcggtggctcacgcctgtaatcccagcactttgggaggccgaggcaggcagatcacctgaggtcaggagttcgagaccagcctgcccaacatggcgaaaccctgtctctactaaaaatacaaaaaattagccgggcgtggtggcaggcgcctgtaatcccagctactcaggacgctgaggcaagagaatcacttgaacccaggaggcagaggttgcagtgagccaacatcatgccgctacactccagcctgggcgacaagagtgaaactccatctcaaaaaaaaaaaaaaaaaacaaaatactaaaatctcttagacaattttccagtttatcaacacaggtttgccaacttaaacatcatcaagacacactgtttttcaggctggatgtggtggcacatgcctgtattcccagcactttgggaggctgaggcaggaggactgcttgaacctagcagtttgaggcagcagtgaactatgatgccaccactgcactccagcctgggcaacagagcaagaccctgtctcttaaaaaaacttacctagcaacctgtaatggcagcttccaattaaacagaaaaggcagcaagtatctagccaaattactttatggaaaaagacttataaaaatatagacccttggaatatccatgcaatggaatattcagccatcaaaaggaacaaagtactgatacatgctcaaaacatgaaaagtgaaagaaggcagacacaaaacgtcacataatacatgtgattcaacttatatgaaatgtccacaacaggtaaatccatggaaacagaatggggagcaactgtttaatgggtacagggtttccttttcgggaggataaaaatgttttgaaactagacagaggtgatggctgcataacactgtgaatgtactaagcataactgaattgttcattgaaatggttaattttatgttatgtgaccttcacctcaattaaaacaattttttttttttttttttggtagagacaggatcttgttatgttgcccaggttggtctcgactcctaggctcaagctatcctcccgcttcagcctcccaaagtgctgaggttacaggcataagccattgtacccagccaagataatttttttagtttaaaaagttttctaaggccaggcgtggtggctcatgcctgtaatcccagcactttgggaggccgaggcaggtggatcacgaggtcaggagatcgagaccatcctggctaacacgatgaaacgccgtctctactaaaaattcaaaaaattagccgggcatggtggcgggtgctttagtcccagctacttgggaggctgaggcaggagaatggcgtgaacctgggaggcagagcttgcagtaagccaagatcgcattactgcactccagcctgggcgacagagcaagactccgtctcaaaaaacaaagaaacaaaaaaagttttctaaaaaaattaagacaagtaaaaacaaaaaatagagctctggaagaaaagcaaaaataataaaaatgtattctggaaaagattaagttggatggggaaggggatttaatgtcttcaagtatatgaaaaactgctgtgcagaaggtgaaggtaaccatgttcacctttaatgacacctgattctttagtaacagaattgtaataaaaaagaattatgctaacacataaagaatctctgttcctactttaagtgctattaccctcaactgaaatttgtaatcttgcttttggatatggagagagatatatatatatttctatatatatatttctatatttatatatatatttatatttatatatatatatatatataaatttatatattttatatatatatatattttttgttttctttgagacagcccaggctggaatacagtggtgcgatcttggctgactgcaaccttcacctcctgggttcaagcagttctcctgactcagcctcctgagtagctgggattaccatgcccagctaattttttgtatttttagtagaaacggggtttcacgatgttagcaagactggtctcgaactcctgacctcaggtgatccgcctgtctggtcttccaaggtgctgggattacaggcgtgagccaacacgccctgccggtttttggatgtatttcaaaggcatttagtctggaacccttgggtggactcagttcagacctttgtttccagtaaatgattgttcctcacctgcctcaggtgaggacagaggcttctgcttaccttctgactgttcccctggtctttggtgtgagctctgtgatcccttaaaagtcggttcctctggctgaacctcctgtttccattgggatctcagtgattctctggttgctcccaaaggggccatctccttcatgagtactttcaagtccttctcagaatctagaacctgagaacagaccccattatctatcactacaaattcctgcctaagctggactttacaactcctaagagtggcattaaaaaatgtgtaacataaggaagcagaagagaaaaatctaggagccactgtattgctgctgtaataaaataaaaattaatagaattaggtatttgaggggcagtagcttacgcctgtaatcccagcactttgggaggccgaggcaggtggatcacgtgaggtcaggagttcaaggccagcctggcaacaaggtgaaagaaaccccgtctctactaaaaatacaaacattagctgggtgtagtggtgtgaatctgtaaccccagctatttgggaggctgaggcaggagaatcacttgaacccaggaggcggaggttgcagtgatccaagatcacgccactgcactccagcgtggacaacacagcaagactctgtctcaaaaacaaaaaaaaactctttgaagtggttaagattatttatatgacagcacctagcatagagcctgacacaccagaactgttaaaaactgaaatatatttgtcagaagagagaatgtcagctttcactttagcaaacccccatgacttcagcactaggccatttcctctgccccccaaatccagtatcagttctgtcttcaaaagagacctcgcattggtcctctctcttcacctcatggctccatcagggtccaggacactatctgctgtctgcatcctctctactgctggaccctccaatccattctctctacatggaacccagtgtgatctttttaaaatctagagtcctgtccctccgtagtaacagcactcttcagtggcttcccactgcacacagaataaaatccagactcctctttgcagcctaaaaggcccagcatcattctgcccggcctcctccctttctctcacagcactcttccccagtctctgagctccagccacaagccctcccttcttcctctcaaacccgcccagtcttttcccaccttaggctcttggtatgtgctgtgccctctgtctggagtactctcctcccagctcttgggacaactggttccttctcctccttcagtgtcacctcagagaagtcctgcctcacagcctatctcccaacactccagttatcacatcactctgctcatttccttccaagcactcatctgaaacgatctttatggtttacttttgatttatgattgtctgtttcccccatggaccgcgggctccagcaggccaggggccgtgcctgtcctgttcactgtaaaatcctcaatatcaacggtcactgaaaatcaacttttgtctttcagagccatcttcattctttaagtcccatgcttataacaaacacccttaaagggaatgaagagaggtactgagaggcaagtggggtcctgagaaattatatcaacctctattactactacccacctccacttcttgctctctccttcactttcatgataggtaataaggtttggctgtgtccccacccaaatctcatcttcagttgtagttcccataatccccacgtgtcatgggaaggacccggtggacgtaattgaatcatgggggcagtttcctccatgctactctagtgatagtaagttctcatggcttcccccttcactcagttctcattcttctctttcctgctgccatgtgaaggaggacatgtttgcttccccttccgccatgactgtaagtttcctgaggcctccacagccatgcagaactgtgagtcaattaaacctcttctctttataaattatccagtctcgggtatgtccttatagcagtgtgagaacggactaataaattaggtttcaaataggtgtttaacctatacactcctgcactgttttcttttatattaagagtgtgggccgggcacaatggttcacacctgtattcccaacactttgggaggctgaggtgggtggactgcctgagctcagaaggtcaagaccagcctaagcaacatggcaaaacctcacctgtaataaaaaacaaaaattagttgggcatggtggtgtgcacctgtagtcccagctacttggggggctgaggcaagaggatcgcttgaacccaggaggctgagactgcagtgagccgcattcatgccactgcactccaacctaagtgacagaccaagaccctttcaaaaaataaataaataaaataaacataagtgtgattccgacatggttaaggataagaagaggagagaccatcaaacagagtgatggaaggggaactgggctaggatgactcttggcatactgggattcccactctatttataatagttcagttctccaagttctaccttcatacaagtgctactgcacctctccattcaatcttacttatgaataagagtcccaatcccacagatttcagactaatttcctgaacttcttccctgatgcatcaccatcaagctgctcttcccctctctaaattaagtcaaaagtactaactcttcaatcctaccaaatttcatctatatcccccttcacccattcctcttcccacagcccgtgcacatccctacctcctcactgggaaacacaagtatatctgctgcctagggccttcccattccagccatgcagactctggcacccagcaagctgcttcctgctctgatcacagacccactcaggctgaccaacgttcctctgacctgtgccctccattactctaggcctctcccagacttacccaatttcagttgccttcctcctaccaactcttccacaaccgaagctggtatgttacttttcctcttcctgtgcctttcccacctccctgctccaagaaaatataagctggttacaccaatcagatctcagacctagtcctgaccgtaagaggatattttatgaatccatcagtgtcccaaactgaacacttaatcccggcatcaagaactagagcaaggcctggctctaatataattttgttgagtgtacaacacatgtcactctgccctcaaagaagctcctagcatgaaactagattttcattcactagcatctctagttttcctccatcccctgagtgaaggagagttgtcctttccctggccttgttttcgagaatttttctgagtgtttttaccaccttaattagggacttcaaatattattaaatatatgaatgtctagcagctgtatccacagatgagaaattcttcccgtattataagggcataggaccaatccaagacagccaagaccttctgtgggcagcagagggctactgtgtgtttctcaaccaagcacctctccagtaactggattccccgacaacttcataaccaaaaccacaaagttccgacttccttttctcacctgttgtccaggagctctctgtacatcctcaaccagagccacagcttcctcgccgttttctggatgctgctccctcacccaggtctggatctcctctggcaagatagtcagaaactgctccaaaaccagcagctccaggatttcctcttttgagtgggtcttcggcctcagccactgacaacagagttcccagagtttgctaaaagcttcatgtgggccagttacctcctggtagcaaaactgcctgaagcgctgacgggaggcctcggagtcagggctgttaccctggagggctgatttctggccctgtgtgggatccttgtttgaggatgggtgtgcctcggtactcttcactgcagccatcatttgcttcaacgaactggcttactctggttgccacttctaccctggagatcagagtccatctttcccacatcactgggaagccatgttctcctgcaaggaatgtctttctgtaatccgtgggacatgagagtgtcagacatgtgtagagactcacagcggaaaaaaagggctcaactttgaaggatgtctgaagaggatggaaaaagacaatataaacctatcaaacattccttcactctggttcttgtgatttacttcctatccctttcctttactccctccacaaatctacaccaaggatccaaaacactagaaatagatctagaccatcctggctaactgcctttgcaaaaaccattaacagtgagaagattatgacactaaaagagataggatctaaccaactccatcttgcttttaacctccaaactgccgttggtcattcctgggtgtgggccaagctagctttgggagaaatttagtttatagtttgaatgataataacccttcccaaaactaaactgcctttgtaaaactaattaaagacaactaggttaggaggatgagaggggcctgaattctgctaagatgcaggcataatgaaatgattatccagaggtcacaagatttgcaacttccccaattaaataacatcacgattgtagaacctaagattggccttttgagatgccttttcaggcctctgctttctgacaaccagatggctccacctagaccagggactcctctgtggctcccacccaaaatcgcactcagcacacaaaaaccgttttccacagccctatgaatgcatccccaaccagtcagcattccctgttccctacccaactgcgtgccaaagccctagcctctgaatttccggggaggctgacttgagtaataaaactttagtctcccatttagccggttctgtgcgtattaaactctttctctattgcagttcccctgtcttgacaaactggctttatctaggcagtgggcaagatgaacccactgggcagttacagtaccaaaaaatatagtcttctcccagccaagattctgtgtctgctgacgaattactcaaactgttcctgacgatatagttcacctgttccttcccttcttccctcacacacctaggtctttttcctgtccttccctatcctcaagaagcctgaattcatgttcccaattgctaccctctcctcgggggagaactggtgtgtgtgtgcttcttgattaacttcttcattactattactccacacacacacaacgtggataagtgactgttcgggtttgctgtatgtttttattttccagcattcctttcccacttctagtagcagcatcttcttcctttgtgaaaaagtccccctcgaccaggcgtggtggctcacgcttgcaatcccagcactttgagaggccaaggcgggcggatcacgtggtcaggagatctagaccatcctggctaacaagatgaaactccgtctctactaaaaatacaaaaaaattagctgggcatggtggcacgcacctgtagtcgcagctactcgggaggctgaggcaggagaatcgcttgaacccgggaggcggaggttgcagtgagctgtgatcacgccattgcactccagcctgggcaacaagagcgagactgtctcaaaaaaagaaaaagtccctctcattggttctggtggggatattaattacaatacccacttccccagaagtgggcatatgacacacagctaggcctatcaaaattcttttctcagattttacatgagaggtagggaaagctcttcattttctaggaattggtaaattgggcaaatgtaagatcagagttgtctccaactatgtcccactctctactccactcttccatcacaggagtgagcctgtttacaagaggacaatatactcaagtcttgacaacatgtttggatctccaaggccagtttatgtaaggcaatatttttttaagagttaattttaaaaatagttttatataatttaaaattaataaataacttttaaaaataattttatttgtttttttatctttagagatggagtctcactctgttgcccaggctggtctcaaactcctgaactcaagcaatcctcccacctcaacctcccaaagtgttaggattacaagtataagccaccatgcccgaccttaaaaataattttaaatagaagctaacttttgtattttttgtagaggtggagtttcactatgttgcccaggctggtctcaaactcctgtgctcaagtgatcctcccaccttggcctcccaaagtgctgggattacaggtgtgagccactgcacccgcgaaggcagtcttttttaatgagtttgtgttggtttttatctacttaaaacacagattaaagcagatcgtaatttacattttctccaggggctgatacaccctcaccatgtggtattaaaatggatccagcatgcacaacaagatgaatatactcaggactactgagctgtacacttaaaaatggttatgatggtaaatgttttttaaaaattaaagaaatttttttatattttaaaaatggatttgggttcccttttctcaaggaacttgaactgccttcacttaaattctctttacatttcagtgcttctagagatagagaaatcaagggcattattattgttagcactgctttctagccaaaaagaaactgagagcgatgaagtatcttgcctaaagcatcacacagcacagctcctaggcagcaaggccaggactagaaccagcaccccttgccttcattatgttcatcctgtgccttacctggctgaagaagaatttaataaaagctcttctaacttcatgcagaaggcggaacctgcacccttcttgaccccttttgaccccttacctcccactcatcgttaaattttaaaatgctgttctctgaaaattttacttcactctagcgatggcccaaacactcggaaaaaaatgtagcatgaggatggggagccaggttgataggtttttcacttagttaactatttattgagtactcagaacgcactcggtgccagggctaggcactgtggatgagtagggagtgggcgagacagggacgagatgagcagggtcaaggccagggggtcccggggcgccggcgctcaggctcggggtgatccgcacggtgggagcggggcacggtgatcgcggcgcgtctggggacgcccggcctgagggaggctgcctgtcccaaggagacgcccatcggggccggacccgaacgcctcggagaagactcccagcggggaggggctcctcggccgtcgcagggcccagcggctaatcccgccggccgcaaggaagcggagaactcaccggacaccagcactcgcgactccacaaactccctcagcctccgggccggaagtcagcggcgcgattcgctccgcccattacgcacgcccctgcgcaggcccgcaagccgaattgccggactgcagctcccgggatgcactgcgacggtattgacaggcgcagcaaccaatagacggtagagaatgcccttggcaggaggcgggccctgtcagtagttgtcctcagcagctagtgggcgtctccgcagcgagtggcatcggccccgcccccagcccgtgctcgccggtgtcgggtcctaagtccctcggtcttgggttcccggagaggtgagtcggctgcaggtgggtgcggggcgccgggctgttcggggtaccggtgtcgcagtcgccagtccgagctcacaccgggcgtggagttcagctgcgcatcgggttgcggcagcttcgccaggcctggggctggctgggccgcggggccgccctggaggccggagccactgggcctgcggcgcctcggcagcgagcagccgctttgctcgcgtgcaggaggctgttcgctacctcacacccccggctggcgctgtggcctcgcttagctctaccgtttagcacccggcgacatgcacccggtcggtttccgccaggatgcgggagagttggggcaagctacctgcgacagcttgaacttttcctagggattccgctccacccgccggttagagcgtattgctcattaaatccgagacctgtgtgcttgctactgaaataaaagaagtattttttccccagagtccttttaggacgttatgacttttctcctttgcaagactgcaaaaaactgacaagaagacaaaactcttcccactcccagggaccgcgttgtcttgagtttggctagtaaaggctagcaagtgaggctttgtctctgcatcccgttccccctaacatcctcagagaaccttcgtttctagaatctttctagtattcagagacttctccagggtcatgatcccaaaggcttaacccgtttacaaggagagagttgtctcctgacgcccaaaatggcagctaaaatggagataactttaagctccaacactgaagcttcctccaagcaagagagacacataatagccaaactagaagagaaacggggccctcctctgcaaaaaaactgcccagatcctgagctctgccgccagagcttcagacgcttttgttatcaagaggtgtctggaccccaagaggctctctcccagctccgacagctctgccgtcagtggttgcaacccgagctgcacaccaaggagcagattttggagcttctggtgatggagcagttcctgaccatcctgcccccggagatccaggctcgggtcaggcatcgatgtccaatgagcagcaaggagattgtgaccctcgtggaagattttcacagagcatccaagaaaccaaagcagtgggtaaggagggtcctctcccatcatcctggggatttctttttcttttctttttttttttttttctttttttgagacggaatcttgctctttcgcccaggcccgagtgcagtggcgctatctcggctcactgcaagctccgcctcccgggttcacgccattctcctgcctcagcctcccgagtagctgggactacaggcgcccgccaccgcgcccggctaattttttgtatttttagtagagacagggtttcaccgtgttagccaggatggtctcgatctcctgacctcgtgatccgcccgcctcggcctcccaaagtgctgggactacaggtgtgagccaccgtgcccggccgatttctttttcatctgggtaatgtttggtatctggatctctccctatttaagtctcagaagtggactggatggcttcagaagttgcttccagcctctatctgggaacctatcctgagttattaacaggtttttagaaaatccaactactgatacccagtgaggcaacagaggaccaaggttcttaccattcctttatgcaccttgtgtcaccagaagtaattgtaaggttcttaaatcccttctgtcagctcttcccccacccaacttagttttcctactagcagaattcttagcagatagggtcaccctgttgggtagcagttggactttggggaacttcatttcattggaagttctagcttattgtctttccagtgtttagcttatagtctttttttttttttttttttttttttttttttttttttgagatggagtcttgctgtgtttcccaagctggagtgcagtggtgccatttcagcccactgcaacctctgcaccccaggttcaagcgattctcaggtctcagcctcctgagtagctgggtttacaggtgcctgccaccacgcccagctaatttttgtactttttagtagagagggggtttcactatgttggccaggctagtctcgaactcctgacctcaagtgatcctcccgccttggcctctcaaagtgctgggattacaggcgtgagccaccacacctggcctagctttttgtctttgatttttttttttttttttgagactgggtctcactgtgttgctgaggctggagggcagtggcacgatctcagctcgctgcaacctccatgtccagctcaagtgttcctcacacctcagcctctcaagtagctgggactgcaggtacatgccaccatgcgtggctaatttttgtacttttgtagagacagggtttctccacattgcccaggctggtcttgaactcttcttgggcccaggcgatccgcccgtcttgacctcccaaagtgctgggattacaggagtgagccacacaatgcctgactagcttattgtctttggatcaggaagttacagttcaactggccagcgttgccattgcttgccactccccgccccgaagtcagaccccagtcaggacctaggcaagaagcaaacggcaggtacttcggaaaatagaacttgttagggaatgaaggtggggtggtcctcttagacccctactactactgggatctccttaccaggaaagcctttggcagaacaatgtattaggtaagaaggacttttaacagcccctcaccatactgcttcctgttcctacagggcctatttccagcagaagtaggtggggggtggtgtgtagagtaggcatctgatggcccagtgttgtgactgaccctgatatttgtgccagcaactaccctgatgactttgactctggcccttgagaaaggcccaagctttaggggaagccactcggctgatttgtagcatcctcattcctgtcattcttcacgttctcccctttacttcctttgagggtttcagtggtttctatgaaagttgacctctagatggttatcagcaattcccaaggtaaacgggtcattatacaacagtgagagatcaagcttccctcagtcctgatggatggaattaatggatggggcttgttcctaggtggccgtttgtatgcaggggcaaaaggtgctcttggagaaaactggatctcagcttggagaacaggaactgccagactttcaaccgcagactcctaggagagatctcagggagagctctccagcagagccttcccaggcaggagcttatgaccggctgagcccccatcattgggagaaatccccactcctccaagaaccaacccccaaattggctgggacaggtaaacactctgccttttctctccctctcatcagccctttatctccatcaatgtatctcatggttctgcaaaggcatagaccacatgtgtgtgtttttttaaatgttatatataatagtagatgattattcactaaacaaatttcactaattaggatggtggtgatactacaagtaagtatgtttttatcgttttctgttaatgaaaatttaagaatccagtgcatgacagggttgtacctacttttctgtccgtttcagaacttcttatagaaaagacagatccaaatatggccacagatgaacttccatgcaagctatggctgagtttcattgcttaaaatgctcctctgtttagaggggcctggtagaaataaaaacccaccctatatcttatatctttgtcctcctctgtgatgttgcttgtactttagatcctcaaatctatttccctttctctggtgtgatacttgtgtaactgctggccttgttctacacagtcctgtgatctctaagcctgaatgacagtgacattttggccaagcctggtgatgtgaatacaagatacagtgagcacgttagggaggagggttacaagacgacaaaaatcctcagtttcttaatatttgctacatccaatgaggtacttcgtgttttagtctgttcaggctgctaatataaaatgctagagactaggtagtttataaacaacaggagtttatttctcacagttctagaggctaggaagtctgagttcaaggtgccagcatggttgggttccagtgaggcccctcttccaggtcacagactgcctacttctcagtcctcatgtggcagaaggggaagacaggctcccgtggggctctttcatgaaggcactaatcccattccagtgagggcagcaccctcatgacctaatcacctcccaaaggccccatgtcctaacactattaccttgggagttagaatttcatatgaatttggaggaacataaacatttagcccctggcaaccacagtctactttttgtctctagaattgcttattctgaacattttatacaaatggaatcacacaggccgggcacagtggctcacgcctgtaatcccagcactttgggaggccaaggcaggcggatcacttaggctcaggagttcgagaccagcctgggcaacatggcgaaatcctgtctctacaaaaaatgcaaaaattagcggggcatggtgctgcacacctgtaatcccagctgcttgggggagctgaggcaggaggatcacttcaacctgggaggtcgaggctgcagtgaactgagatcgtgccactgcactctagcctatgtgacaaagtaagaccctgtctcaaaaataaataaataaataaattgaatcacacaatatgtggtcttttgtgtgtggcttctttcactgagcatgttttcaagttttatccatgctgtagcatcaatcagtgcttcattccttttctgtggctgaataataggcattgtacggatatattacatgttggttttctgttcatgttggttcatctgttcatagatttttgggttgtttctactttttggttattatgaagaatgctgctataaatgtgtgtttttgtgtagacatgttttcatttctcttgagtatatacctaggagtggaattaccatatgctaggtcatgtggtaattccatgtttaacttatgaggaactaccagactgttttccaaagcagctacaccattttacatccccaccaatactgtgtgaggattccgatttctccacattcttgctagcacttgttattgtcttatacccatcctattcggtgagaaattttgatttgaggttttgatttacatttccctagtgactaatggtgttgaacatcttttcatgtgcttattatccagttacatatcttgtgtggaaaaatatctgttcagatcctttggtcatttttaaattaggttatttgtctttattttttataagagtcctttatgtattctagatactagacccttatgtgtaatttgcaaatcttttctctcattttgtgggttgtctcactttcttgacagtgtcctttgacgcacacgtttttcattttgctgcagtctaatttatctatttttttctttctttatgctttggtgtcatatgtaaaatagcactgcctaatccaagggcacaaatatgtacagctatggtttcttcaaggagacatagatttagctcttactttcagctatttggtccattttaagtttattttttccccatacataaacaagtcaatttttatataggttttgaggtaggggtctgtcaatctgatcaggggtctgtcttaatctgatcaggctcttacaacaaattgccttagactaggtaatttataaacaacagaaatttgttgctcatagttcctggatactgggaagttcaagatcaaggtgccagcagatttggtgtctggcgagggcccattcctcataaatggtgcctgctatgagtccccacatggtagtctcttgggtttcttttataaggacactaatcccatttatgaggaccccaccctcataacctaatcacctcccagatgccccacctcccaagaccactgcactggggactgtcaatatatgtgtgtcaggggacaggggggataaacattcagaccatagcagggtccaacttcattctcttgtatgtggaaatccagtagtcctagaatcctttatgaaaaagactattcttttcccattgaattgtcttgtcaaaaagcaattgaccctgattgtataggctgattatttacatttgaatttaaatgaattaaaattaaaaaaaaatttaaaattaagttccttagtcacagtagtcacatttcaagtacccagtagccacatagtcacatgtggctagtggctgccatattgaacaacgtgcatgtgcctgtgcatgcacgtgtgcacacacacattttccacatcacaagggatccttctccagatcctgtgatttcccataggccgttccagctcatctccatccagactgtcaatccttctgtaattaggatacatggctaagccctgattccagtttctgaactcatatactgtcaaatttgtaatgaaagaaaacatcacagtctctgaacttaccatcttttgaagagaaggtggttgtcaattagtgtttactaagtgaggggtatttgttgaaatagctcaggcattggactacagcagtaaaatttgcaatgttgagatttcacctctcttccttcttcattagatacccaattctgatgggtttgcttttccctgttcttcatttcctaaacctttccctaaagggagaaaggaagaaggaggatggagaacttggttcctaaatttaatataaatcacagtcaccccaggagcctgctaactgtgcagattatcaggcccaaccccccgagattctgacccagcagctctgggggaagggtgaagagcctgcttgtttaacaagtgctccagatgagtctaatgcaagttgccagcggagggccaccctttgagaaacctctcagagtatttcataactcttgctgaagttatttcttccaagtgcagaaaatgaagcattttctttctaattatagaggcccccagaatgagaagtgacaacaaggaaaatccacaacaggaaggggctaaaggagcaaagccatgtgcagtgtcagctggcagatccaaagggaatggtctgcagaatcctgaaccaagaggggcaaatatgagtgaacctcggttgtcacggaggcaggtcagctccccaaatgctcaaaagccatttgctcactaccagagacattgcagggtggaatacatcagcagccccctaaaaagccacccactgagagagctaaagaaaagcaaaggaggtaaacggagtctgagcaaccgtttgcaacatcttggtcaccagcccacccgctcagcaaagaaaccctacaaatgtgatgactgtgggaaaagcttcacgtggaattcagagctgaagagacacaagagagtccacacaggagagagaccctacacgtgcggagagtgtggaaactgctttgggcggcagtcaaccctgaagctgcaccagaggatccacactggagagaagccataccagtgtggccagtgtgggaaaagctttcgccagagctcaaaccttcaccagcatcaccgacttcaccatggggactaaaaggagcactccatgctttagattcacacggaaggtgtttgtgtttctcctcccccttacttgcatgtaaatcacaaaaactgtgtgacttacaaggaaagcacgaggcccttgaggaatgatgatgcacattctgctgtgaggaggcccagaaaaggccaaccagggcccaaccgtgcatgatgacagggtgaagagaaggcaggtctgggcactggggcaaagagaacttaagtctctgcagagagcaaggagtaactactgagagagaatcaggacaatcctgcaggtggcccgcttactgttaaatcgtccctctgttgctttatcctctaaaatatgttaagggataaattctatatatatagttatgcatttgctgtcataccagacaattttttatcatgagcacacttctttaataaagatgagtgatctaccagaatttcaaggcaaagttaattggaaaatagatccctcatattctttctgtaattactagctgtttatagcaaaggatgaattaaatgagaatatgcacgtttgtgcgagaagagtttccaagtagttagatggtgcttttacaaaaagaaaagaaaattacatttgagggatcttttttgtatcaaagcaccttttttttttcctttttattttttgagacagggtctcgctatgttgcccaggctggtctcgaactcctgggctcaagcaatgctcctgccttggcatcccaaagtgctgggattgcaagtgtgaaccaccgtgcctgttctcaaagcacctttgattgagaaaaaaaaaatctacacagttgctgcaaccccagcctaacacataaggaaaagctacagtgagaagcaagtagtggacaaagagtactaaggagatataaaagggaattcttcccactctcctttctcacttagcccattagctttaagaataacaaaatgcaatgggggtacagtggctcacacatgtaatcctagcactttgagaggctgaggcagggtgatcgagcccaggagtttgagaccagcctgggcaatgtagctaaatcctgtctctacaaaaaatacaaaaattagccaggcatgatggtgcatgcctataatcccagctagctactcttggaggctgaggcaaaagtattgtttgagcccaggagttagaggctgcagtgagctatgattgcaccactccactctagcctggatgacagagtgagactctgtctcaggaaaaaaaaaaaatagcaaaaggattggggtaatgaaaatattctaagactggattacagtgatggttgcacaactcagtaaatttactaaaaataattgaaatgggctaattttatgatatgtaaattgtacctcaacagcgtatttttaagtgacaaaatatatttatataaaatgagccctggaaataagcctgagcgatcatctaatgccacctcctcgttttctcaaagcggaaattaaaatgcaaatcagtatacaattcctagctcattgctcagtttagagaaaacttttggcagattagtgcattcctgatgcagaaaataagaagcaagtagcattttttttttttgagacagggtctcactctgttgcccaggctagagtgcactggcgtgatcatgcctcactatagcttcgatcttctgggctcaagcaatcctccctcctcagcctcccgagcagttgggactacaggaatgcaccaccatgcctggctaatttttctatttttttgtagagacagagtctcactgtgttgcccagtctatcctcgaactcctgggctcaagccatcctctcactttagactcccaaagtgctgggattacagatgtacgctcagcaaggtagcattcttcacaaaacatcagtatcatcaagtaactaccagtcacctcagggctgtgggctgagctcttctgtaccccccaaggaatctcttgtcccttctaactgccgagggacatatgcacacctatgagtcctctttggggcctttgcacacaattgtttcctttgcctttatttcctgatgctccccactccctcctgcctcctccctctcacaagagtttccttctctcaaagccttccctgaggagccctaggcagacttctgtgaaaattggggtccagcctctctgctagaccccatacaccaggggtgctcaaactgggagccccccaggggttgtcggacaaagtccaaagacacttttggttgttaggactggggaagggaggcttgttgctggcctctagtgggttctactgaaccgcctgcagtgccgggacagccagcccccacagcaatgacctggctcaaaaaatcagtatcaccaaggctgggaaactaccatgcactataacagctctttcaaaacaagaacattgtttttccataactttagcttctggactttgtcaataaccagccaagagaaacagatgttcagtatgtgaacagttgagaatccccactgtacccacagggcccatgtctgcctgagttcagagatcctggtgacaatctgttgaatgcacaggtgagcttctgtcttttgggcagaggcttattgaaggcccagtggccttccttacagcttttgtggtcctttaggtactttaggccctgatcccattcccatctgttatgttagatcatgaagaatttagcttctgtatccgagctgccccatacctggctccatcctgatacctctccctggtcaaggcctctttcttcctcattgtgtttccacctcaccctactgaaaccaggctgatttcactgttgtcccttaataacctccaagtcatagtcacatctgtattaggtactttgtggtgtggtaacagatgacccaccagcttaatggtttaaaacaacacaaactggggccgggcgtggtggctcacacctgtaatcccagcactttgggaggccaaggttgtgaaaagttcacctgaggtcagaagttcaagatcagcctggccaatatggtgaaagcctgtctctactaaaaatacaaaaattaaccggatgtggtggtgcacgcctataatcccagctactcgggaggctgaggcagaagaatcacttgaacatgggaggcagaggctgcagtgggccgagattgtgccactgcactccagcctgggcagcaagagtgaaacttggactcaaaaaacaaaaacaaacaaaaaaacacaaaaagcaaaaaaaccgccgggcacggtggctcacgcctgtaatcccagcactttgggaggccgaggtgggtggatcacgaggtcagaagatcgagaccatcctggctaacacagtgaaaccccgtctctactaaaaatacaaaaaaaattagctgggcgtggtggcaggcacctgtagtcccagctactcaggaggctgaggcaggagagtggcgtgaacccaggaggtggagcttgcagtgagccgagtttgcaccactgcactccagagcctgggctacagagcaagactccgtctcaaaaaaaaaaaaaaaaaaaaaaaaaaaaaacccacaaccttatcgttctagaggtcagaaatctgaaattgatttcactcagccaaaatcaagctgtcggcaaggctggttcctctgaaggctctgaggggtgaatctcttgccttgactttttcagcttctaacagccacccacatcctttggcctccaccctcaaagtgcatcactccaatctcattccaccgcattctcctctgactatgaccttcctgcttgccttgtataaggaccgttatgatgttgggcccaccggcataatccagaataatctccctatctcaagatccttaacttaataacatctgcaaagccccttttgccatataaggtaaacttaatgggttccaagtattaggatgtggacacatttggggtgccatgactcaacccaccgcacatatccatcttgaatcaagttagtcaaagagcatctctcctaaaagagaaggaccatagatttctacttaattataagggttggggtcaggcgcagtggctcacacctgcaatcccaggactttgggaggccgaggcaggcggatcatttgaggccaggagttcaaaaccagcctggccaacatggtgaaatcctgtctgtaccaaaaaaaaaaaaaaaaaaaagaattagccgcgtgtggtggtgtgcgcctgtagtcccagctactcacgaggctgaggcatgagaatctcttgaacccgggaggcgaggctgaaggaaggtagaggttgcagtgagctgagatcgcaccattgcactccagcctgggcaacagaccatccccaagcatagccttcctttggtataaggctcaactccaggccaagaggaccaggaagggtccaatggctacaagaacccaaggtcctgtactcagatgtaagtttcctctcagcccccgtacccatgcatggtctgccagaggacctcagctgctccaatagattgtgattctccgtatccaccagtctgtctctacaaattttggggtggctgtttgccctgtgacctcacttctcttacagaagaattgttgggtttttcgggttgttcagctttttatttgtcattagaatggagtgacaactttcaagctccttatatttgcaaccagagactggaagtcacaagagtgaaacaccgtctcaaaaaaaagaaaacagcagtgagacagtgactccctgacctcactggctagatgaattcctcttaaaccttctcaaagcaaaacatggctctacttggctgcagttgccctctcaatgcagatcgcaacgaaaccctctcaatgcagatctctgccttcccgcctcaacactgcacccgggagccctcctccaagggtcagtgcccgataggtttgagggcaagcccccgccagggtgaagccgcctcctcctctgggcctgggacgtgctgggagggagggaacgcggtcccccggggagtcacatgcccccattcccggggtcacccagggacaacgggcaggaatagacaggtaaggaccctgcagctgagcgagccctgtggccggatgttccaggtaggcttttccggaaatcgccaccggaggatagaacgctcctagggtgaggggcggggcctcgacaggaaatacctgaaagagtcccctctgagtgggctgcttggcgcccagcccgaggaattctcaccttccattgcctggcacagctgtcagggtgaagaggaggccgggcagccacggagccctctgggaattgtggttttcgtgggctccacgtactgctgagctgttgcttgcctgagactgttgaacctcaaagggtgtcctggggttcattcattaagcttgttcacgcaaatgacaaatatttattgactgtccacaacacgccaggcaccaataggggctggaggcaatatggtgaacccggacgatgctcatggtctcttagaaagcccagtctccaggccgggcgcggtggttcacgcctgtaatcccagtactttgggaggctgaggtgggcggatcacctgaggtcaagagttcgagaccagcctggcctacatggtgaaacctcgtctctaacaaaaatataaaaaaaaaaaaaaaaaaaaaaaaaaaaaaattagctgggcgtggtggcgtgcgcttatagtcccagctactcagggaggctgaggcaggagaattgcttgaacccaggaggcggaagttgcagtgagctaagatcacaccacggcactccagcctgggtgacagagggagactgtatctcgggggaaaaaaaaaagaaaaaagaaaaaagcctagtctccagcaaggaacacatctgaatcaaataattacacaaaggcaaaactgcaaccacacagctcctaaaagaaatgttaaaacagaaatggcacaataacaagtgactgaggaaggatctaatttataaagatagaaaggtttttgttttgtttcgttttgtttttttgttatgttttgtgttttgtttttgagatggagtttcgttattgttgcccaggctggagcgcaatggcgcgatctcagctcaccgcaactgccgcctcctgggttcaagcaattctcctgcctcagcctcccgagtagctgggattacacacaaccggccaattttgtatttttagtagagacagggtttctccatgttggttaggctggtctcaaatgggtgatctacccgccttggcctcccaaggtgcagggattacaggcgtgagccactacgcccagccaaaggtaggaaggtctttatgccacccccaaacattctcttgccagggcgatcacttgatgacgacagcgattcctcacagagatacaactgacagcacatctgctttgactagcatattcgagatagaccctatgattatcttcctggcatttgaggagactgagattcaataatgtttctggagtttgtacagctcataggaagttgagagatgtaacaacacacctccagtgcaccttccatcctgtctcctactgcctgcccaacataccctacaacctggtcctatattttctgatgtgtgaaatgtgatgataatggtgaaataatccaggaaaagtgcttagcataggagggctggcataggacccgcacttgaatggtgttagccacttttataactattctaattacctctctgattctctactctgatttaactattatttttaacccaagcacccatcctctcttctccttcttctcttttttgaggtagggtctcactctgttgcccaggctggagtacagtggtacaatcatggttcactgtagccctgaactcctggactcaagtgatccttccttcacacttaatccctgtgattttggtagaactgataccaactccaggacagcacatgagaatccaacctgaacagtctactccatcttcctggccacagcgtgtacaacacttaagatgtacaacatgatattctgatatacatatacatagtgaaatgattaatatagtcaagcaaattaacatatccatctcctcacacagttaccttaaatttttttcctctagtaagaatacctgaaatgtactcttatcaaatttccagtactatatcattaagtataatcatcatattgtacatcagctttctagacttagtcatcctatataactgcaactttataccctctcacctacatttccccatttcctcccccgcccccgcccccaccaccattctactctgttttttgttggtttttttggtgaggatgcagtctcgctctgttgcccaggctggagtgcagtggtgcgatctcagttcactgcaacctccacctcccaggttcaagcaaatctcctgcctcagcctcccaagtagctgggattacaggcatgctgccaccatgcccggctaatttttgtatttttagtagagatggagtttcaccatgttgcccaggctggtctcgaactcctgacctgaggtgatctgcctgcttcgacctcccaaagtgctggggttacaggcatgagctaccgcacccaccctactctgcttttatgtatttgacttttttagattttgtatataagtgggatcatgtagtattttttctttctatgtctagcttacttcagttagcacaaagtccaacaggttcattcatgttgttgaaaatggtagaatcttttttttttttttttttttttgagacagagtcttgctctgtcacccaggctggagtgtagtggtgcaatcatagctcactgcagtcacttgacctcccggaatcaagtcgtcctcccgcctcagcctcccaagtagctaggactacaggcgtgtgccatcacacgtggcttattttgtaaaacatttttttctgtagacacggggtctcactatgttacccaggctggtctcaaactcctgggctcaagcagtccacccaccttggcctcccaaagtgctgggattacaggggtaagccactgcacctggcagatagatctcctttttaaggctgaataatgttccgctctgtgtgtgtgtgtgtgtgtgtgtgtgtgtgtgtatccatttatctaccagtggacacttaggttgttttcaagtcttggctactgtgaataacgtaccttagttgtatacagtatcctcacagatattgcagttttgattccagacccctacaataaagtgaatgtcccaataaaatgagccacacaaatgttttgatttcctggtgaatataaaacctatgtttacactatactgtagtctattaagtgtggaaaagcattacatcagataaacaaaatgctgataagtgtggtggctgcagagggttggggtggcagggacaatttcttaaaataacaatgaagtttttcaaatcagttgactcttcctttcacaaaagatttctccatagcatgtgatacagggtgatagcattttgtccacagtagaactttcaaaatcttctcaaatcctgctgctccttcattaactaagtttatgtaatattctaaatcctattgtcatttcaacaacattcacagcatctttaccaagagtagattccatctcaaaaaaacacttttgggctgtgcaagtggctcatgtctgtaatcccagcaatctgggagaccaaggtgggaggactgctctctgagcccaggagttaacacagggaagaccccaactctacaaaacaattaaaaaattagctgggcatggtggtgcatgcctgtagtcccagctacttgggagcctgaggtgggaggatcacttgagcctaggaggttgaggctgcagtgagttgtgattgtgccatttgtacttcagccagagtgacagagcaagaccctgtctcaaaaaacaaaatggttgggtgtcatggctcatacctgtaatcctagcaatttgggaggctgaggcacccagatcacttgaggtcaggagttccagacaagcctggccaacatggcaaaacccatctccacaaaaatagaaaaattagctgggtgtggtggcgtgctcctgtactcccagctactcaggaggctgaggcaggagaatcgcttgaatccaggagttggaggttgcagtgagctgagatcacgccactgcactccagcctgggaaacacagtgagactgtctcaaaaaaaacaaaaacaaaagcaaaaacaaaacaaaaccaaacacttatggttgggagcagtgtctcatgcctgtaatcccagcactttgggaggctgaggtgggaggatcacttgagcccaggagttcaagaccagcctgggcaacatatcaagtccccatcgctacagagaaaaacatttttttttgagacagagtcttgctgtgtcaccaggctggagttcagtggtgcaaccttggctcacggcaacctccacctcccaggctcaagcaattctcctgcctcggcctcctgagtagctgggactacaggcacatgccaccacgcccggcaaattttttgtatttttagtaaagacagggttttaccgtgttagccaggatggtcttgatctccttaccttgtgatctgcctgccttggcctcccaaagtgttggtattacaggcgtgagccaccacacccagcctacagaaaaatttaaaaaattggacaagtgtggtggcacatgctgtagtctcagctgcttgggaggccaaggcaggaggattacttgagcccaggagctaggctgcaatgaattatgattgtaccactgcagtctagtctgggggagtgagagcccatctcaaaaaaataaaatgaaataaagagaagaatgaaattactctttgatccatgggctgcagaataaatgttgtgttagcaggcatgaaaacattaacttccttgtatatctccatcagagctcttggttgtccaggtgcattgtaataaactgtaatatttggaaaggaatatttttttttctgagcagtaggtctcaacaatgggcttaaaatattcagcaaaccatgctgtaaacacataggttgtcatccagtctttgttgttcaactgatagagcacaggcagaataaacataattcttaagggcttcaggatttttcagaatggtaaatgagaactggcttcaccaacggcattcaccccaacaaaagagtcagcctgccctttaaggctttgaagccaggcattgacttctcctctctagctacaaaagtcttagatggcatctttccccaatagcaggctgttttgtctacattgaaaatctgttcttattgtagccactttcatcaatgatcttagctagatcttctggataacatgctgcagtttctccatcagcacttgaagcttcaccttgcacttttatattatggagatggcttttctccttaaacctcatgaaccaacttttgttacttcccaacatttcttctgcaccttcttcacctctctcagccttcacagaactgaagagagtttgggccttgctctggattaggctttagtttaagggaatgttgtggctggtttgatcttctatccacaccactcaaacttgccccatatcagcaaaaagactgtttcacttttttatcattcatgtgttcactggagtagcactttaaatttccttcaagaacttttcctttgaattcacaatttggttaaacatttggcacaagaaacctagcttttggcctgtctcaggttttgacatgcctttctcactaagcttaatcatttctaccttttgatttaaagtgagagatgggccaaggggtggttcatgcctgtaatctcagcactttgggaggctggggtgggtggatcacaaggtcaagagttggagaccaacctggccaacatggtgaaaccccatctctactaataatacaaaaattagccaggagtggtggtgcacacctgtagtcctagctactcaggaggctgaggcaggagaatcgcttgaacctggaaggcagaggatgtagtgagccaagatcacgacactgcactccagcctgggcgacagagcgagactccatctccaaaaataaataaataaagtgagagatgtgtgactcttcctttcacttgaacacttagaggtcatcgtagagttattaagtggtctaatgtcaatatttttgtgtctcagggaaaagggaggtccaaggagaggaagagcgatgggagtatggctggtcagtggaacagtattgaaagttccatgcaggctgggtgcggtggctcatgcctgtaatcccagcactttgggaggccaaggtgggcagatcatgaggtcaggagttcgagaccagcctggacaatatgacaaaaccccgtctctactaaaaatacaaaaattagccgggcatgctggcatgcacctgtagtcccagctactcgggaggctgaggcaggagaatcgcttgaaccggggaggcagaggttgcagtgaactgaggtcctaccactgcactgcagcaggggttgacagagtgagactccatcaaaaaaaagaaagaaagaaacacagaaagagagagagacgaaagaaagagagagagagagagagagagaaagaaagaaagaaagaaagaaagaaagaaagaaagaaagaaagaaagaaagaaagaaagaaagttccgtgcagtattttctgttcctgccagtagtttctggcctccaactccatcgatattcctgcaaaagacatgatctcattcttttttatggctgcacggtatttcatggtgtatatgtacgttttctttatccagtcgtcactgatgggcctttgattccacgtctttgttattgtgaatggtgctgctgtgaacattcatgtgcatgtgtctttacaagagaatgatttatatttctctgggtacatacccagtaatgggattgtggggtcaaactgtagttctctttttagcactttgaggaatcgccatactgctctccacaatggttgggcgaaatttatactcccactaacagtgtataagtgttcccttttctctgcaatcttgccagcatattttttgactttttaataacagccattatcactggtgtgagatggtatctcattatggttttgatttgcatttctttaatgattagtgatattgagctttttttcttatgattgttggttgcatgtatgtcttcttttgaaaattgtctgttcatgtcctttgcctactttttaatggggttgtttttctcttgcaaatttgtttacattccttatagatgctggatattagacctttgtcagacgcatatttgcaaatattttcttccattctggaggttgtctgtttactctgttgatagtttcttttgctgtgcagaggaagctctttagttcaattaggtcccatgtctcaatttttgcttttgttgcaattgcttttggagtctttgtcatgaaatattttcgatcctatgtccaagacggtattgcctcggttgtcttctagggtttttatagctttggattttacatttaagtctttaatccatcttgagttgatttttgtatatggtgtaaagaaggggtccagtttcaatcttctgcatatggctagccaattatcccagcaccatttattgaacagggattccctccacccacacaccattgcttgtttttgtcagctttattgaagatcagatgatcttaggagtgtggccttatttctggtctctctattctgttccattggcctatgtgcctgtttttgtaccagtaccatgctgttttggttactgtagccctgtaggacagtttgaagtcaggtaatgtgatgcctccaactttgttctttttgcttaggattgccttggctattcaggctctttttggttccatgtgaattttttttttttttttttgagacagagtcttgctctgttgcccaggctggagtgcagtggcgcaatcttggctcactgcaagctccgcctctcgggttcatgccattcttctgcctcagcctcatgtgtagctgggactacaggcacctgccaccatgcccagctaatttttttttttttggtatttttagtaaagatggggtttcgccgtgttagccaggatggtctcaatctcctgatctcgtaatctgcccatctcggcctcccaaagtgctgggattacaggtgtgagtcaccgcagccagctggttccatgtgaattttaaaatagttttttataattctatgaagaatgtcattggtagtttgataggaatagcattgaatctacaaattgctttgggcaatatgtccattttaatgatatttattcttccaatccatgagcatgggatgtttttccatttgtgtcatctctgatttatttcagctgtgtgctgtaattctcattgtagggatctttcacctccctagttagctgtattcctaggtattttatatacttatttatttttttgagatggaatcttgctgggattacaggtgtgagcctccatgcacggcttggtattttattctttttgtggcaattgtgaatgggattgccttcctgatttgactctcggcttggctgttgtatgtgcataggaatgccggtaatttttgtacattgactttgtatcctgaaactttgctgaagttgtttatcagctgaaggaacttttgggctgagacaatggggtttcctagatagaaacatgtcatctgcaaacagggagagtctgacttcttttcttcctatttggatgccttttctttctttctcttgcctcattattctggccaggacttccaatactacgttgaataaaagtggtgagagagggcattattgacttgtgccagttttcaaagggaatccatcctgcttttcctcattcaatgtgttggttattttatgttttctttagaaaaatgtccattcaaattcattgcccattttttaattgggctatttggttaatttgtttttgagttgtgtgagttcctcatatatttgatgactttatcagatatattatttgcaggtattttcttttaatccatagtctaccttttcattttgttgactgcctcctttgctttgcagcagttttatagcttgatgtaatcctacttgtttcttgtgtcttgctttgtttttttttttgcctcagcttttggtgtgatattcaaaaaatcattgctggctgagtgcagtgggttacatttgcaatcccagcactttgggaggctgaggcaggcggatcacctgaggtcaggagttcgagaccagcctggccaacatggcaaaaccccgtctctactaaaagtacaaaaattagctgggtatggtggtacacactgtaatcccagctacttgggaggctgaggcaggagaattgcttgagcccgagaggtggaggttgcagtgagtcaagatagcaccactgcactccagctgggtgagacagagcaagactctgtctcaaaaacaaaaaacaaaaacaacaacaaacaaaacataaaataaaaaataaggaaagatttactattgatattttgttacttatttctgttagtcttatagtccttctgtccctttctcttgctgttttcttttgtatttcactgttttttttttttttttttttttgagatggagtcttgctctgtcacccaggctggagggcaatggcacaatctcggctcactgcaaccttcgccttctggttcaagcaattctcctgcctcagccttccaagtagctgggattacaagtgtgcagcaccacacctggctaatttttctatttttagtagagatggggttttgccatgttggacaggctagtctcgaactcctggcctatgttttcattattttctccttttctttaattctataggcattttctttgtagttaccaagtgtttacataaaatctcttataatagtctactttaagctgataacaacttaacttcccttgcatgtcagaactttgcttttatctctcttcccctggcttatatgctattgatatcaccactaacacctatttatattgtaccaattaacataatatagttgttttactacttttgtcttttaacttttataagagaactaaaattgatttacccactactgttatagtaatacactattggttttgactatatatttacctttgccaatgagtttcatacttcgtgtgctcctgttactgttttccatacttttgttttaaccttaagaactctctttagcatttcttataaggcaggtctagtggtgataatctccctcagcttttgtttgagaaagtctttatttccctctcatttttgaagtatgggtttgttggatatagcattcttgactggaagtttttttctttcagcactttgtatctattgtcccactcctttctggcccacaaggtttatgctggaaactctgttaatagttttattaggggacccttgtacacagaagttgcttttcccttggctgctttcaaaattctgtctctaacttttgacaatttgattgtaatgtatgtcagtgtggatctctttggattcatcttattttttttttttttgagacagtctcgctctgtcgctcaggctggagtgctatggcatgatctaggctcactgcaacctccacctcccaggttcaagccattctcctgcctcagcctcctgagtagctggcattacaggcacatgccaccgcgcgcggctaatttttatatttttagcagagacggggtttcaccatgttggccaggctggtctcgaactcctgacctcaagtgatccacctgcctcggcctcccaaagggctgggattacaggcatgagccaccgcacctggcaggattcatcttatttcatgtcccttggacttcttgggtcttgatttctatttcattccccagttttggaagggtttcagccactgtttgtttgaatatgctttctgtccgttttgctctctctgccttctgaaaatccactaatgcatacattagtctactcgatggtgtcccttaagtaccttaatctatcctcactctttctttttttctcatttttgcccctctggttggataatttccaatggctggtcttcaaattcactgactcttttttctgcttgacctagtctgtgagtgaaaccctctagagaatttttcagatgagttattatgtacttcagatctataacttctgtttggtatgtttttaaattttctcctttttctgagacagggtctcactcagtcacccaggctggagtgcagtggtgtgataacagctcactgcagccttggcatcccaggctgaagtgatcctcccacctcagcccccagaggagctgggaccacaggcgtatgccaccatgccaggctaatttttaattttttgtagacatggggtcttactatgtaaaccaggctggtcttgaactcctaacctcaagcaatcctcccaccttggcctcccaaagtgctgggatgacagtgtgagccaccatgccaacccttgtttttgtattttctctttgttgaaagtctcggtttgttcatacattatactcctgacatcagtgagcatatttatgattatttttaattctctttttttttttttgagaggacgttttgctctgttgcctaggctggagtgcaatgacacgatcttggttcactgcaacctccacctcccaggttcaagcgattctcctgtctcagccttccgagtagctgggattacaggtgcccgccaccacgcctggctgatttctgtatttttagtagagatgaggtttcaccatgttggccaggctagtctcgaacatctgacctcaggtgatccacccgcctcggtctcccacagtgctaggattacaggcatgagccactgcacccagcctatttttaattctctaataggtaaaatcactgatctgtatttcattggaattggtttctggagatttcttcatcttttgtttggaacgtattttctatttcttgatttttttgttgactgtgttgattttcatgcattagataagacaactctctttccaagtcttaatatctgatttttcgtaggagatgaacctcaccaatcaacccaaccagattctaggcacctctcaaacttttgtgcttgtacaaactgctgtctttgttcttagtagccccaagagattggggtgcaccaaatgccatcagtgccccaagactggtgatattgaagccagttactgaaatttagctagaaaagttggggtgttatatgtgttccagttccttctatcctcaaggagaagctgggaactggtgttgatctcccacttgccctgtactaagctggggagataatcccaagcaaatgcctgcattctcattcagaccacatactctttcaacccattgcctaatgtgttgttacccccaggggcctagtcaattgcagctcccatctactgtccaggacagatggattgttcagaggcttggctccatctctagagtgagcctgcaaaaggaattgcgggaagcaactgcatgcccattcaggctcccagaggactacttattgcctgccctgtcagtgcccagatataggctagaggcctgactcatggacagcggctgggaaagttgggacgttaggtgtgcagtcaaaccccttcctgggggtaaactgggaactgggtgtttttgtctgctcgctttgtactgagttaggggaaacggatgctagaactgctcaaacactcttttaaaatcacttttcttctctgtagtctagggggacttgtgaatgcagtcttatcaattcccagagacagatgatttaggagcttagaagctggtcccttgggtggaagctgtaaaagttggggtacactgtccaggaagaagctagaagcctagtttttttttgttttgttgttttatttttgagacagagtctcactctgtcacccaggcagaagtagagtggcacaatctcagctcactgccacctctgcctcctgagttcaagccattctcctgcctcagcctccggagtagctgggattacaggtgcacctccctgacaacccccaaccatgcccaggtaactttttgtattttttaacagagagagggtttcaccatgttgaccaggctggtcttgaactcctgacctccactgatccacctgccttggccacccaaagtgctgggattacaggggtgagccaccgtgcctggcccctagttttatctctgaatggagtagtggcagaggggagaacgacagtgaagttcccacatgcctgttcatgctcctggaggtctattgtttaccagccctatcagctactcgatgtaggctacttagaagcccagcgttcaggcagcagttgggaaaaatgtgtagataaatcccttttagggagactgtggaactgcttttttaaattcttttgtttcttttctttttttttagagacagggtctcactctgccacctaggctgtaacgcagtggctccatcatagctcagtgcaaccctgaatcttgggctcaagcgatcatcctgcctcagcatcctgagtagctaggactataggcatatgtcaccacacctggctaattaaaaaaaatttttttttgttttggtagaggcagggtgtttgtatgttccccaggctgttttcaaactcctggcctcaagtgatcctctgcctcagcatctcaaagcactgggattacaggcatgagccatggtgcccagcagatggtgcatttctgcctgcttgctctgcactgaccctgggggacagccgctgaaagtgctcacatacctgtttaaaatgtcctcttatggctgggcatggtggctcacacctgtaatcccagcactttgggaggctgaggcgggtggatcacaagatcaggagatcgagaccatcctaacactgtgaaaccccatctctactaaaaatacaaaaaattagccaggcatggtggcaagtgcctgtagtcccagctactcgagaggctgaggcaggagaatcgcttgaacccaggaggcagaggttgcagtgagttgagattgcgccactgcactccaacctgggcaacagagagagactctgtctcaaaaaaaacaaacaaacaaaaaaaaaaaaccccacaaaattagctgggcatggtggtgtgcgcctgtaatcccgcctactctatagcctaaggcaggagaatcgcttgagcccaggaggcggaagttgcagtaagccaatattgtgccattgcactacaacctgggtgaaaaaagcaaaactctgtctctaaataaataaataaataaataaataaataaaatgtccttttttctcaggggactcacaaatactaaaccctgccattcccgggataagaagatttaggagccaaactctcacgtggaaactgtttaagtttgggagcgatatgtctggcctcaacccttcattcttcaaaaatctggtatttcgggattccttcccaattgtaagatactgtgcccaggtttttggtttacattgtgtctcaatttgttggtatccattttgatgtggatatattatcagttgccagtgtgtgggagtctcaactagtttctatatttctctcagagagaactgatccatgtgtagatacttattcagtgcatccatggaaggaaagaaagtcaggagtctcccattctgtatcttgttgatgcccaatcagtgaaatgaaactttttttttgggcagggagggagttctcattctgtcacccagggtgagtacggtggaacaatcacagctcactacagcctccacccaggctcaagtgatcctatcaccttagcctcctgagtagctgggactacaggcatgtgccactacgcccggctttttttttttttttttcagacagagtctccctttgtcccccaggctggagtgcagtggcgcgatcttggctcactgcaacctccacctcctgggttcaagcaattctcctgtgtcagcctcccaagtagctgggactacaggtgcgtgccaccatgaccagctatttttgttttgtatttttagtagagatggggtttcaccatgttggccaggatggtctcaatctcttgaccccgtgatctgcctgccttggtctcccaaagggctgggattacaggcgtgagccactgtgcccggcctaatttttaaatttttggtagagatgggtcttattatgttgcccaggctggtctggaacttctggcctcaagtaatcctcctgccttgacctcccaaagtgctgggattacaggtgtgagccactgcaccggccatctttgctaaattattaccttcaagcctataaggtatcattatatatttatcctggaagctttcttagtttttttctaaactccttacagcttctttgggtacactgttacacctcttgcctactagtaagtgacagcaccagtatctattctcctttctttttttttttttttttgacaaagtctcactctgttgcccaggctggagtgcagtggcacaatctcggctcactgcaacttccgcctcctgggttcaagcgattctcctgcctcagcctcccaactagctgcgactacagatgcgcaccaccatgcccggctaatttttgtattttttttagtagagatggggtttcaccatattggccaggctggtctcgaactcctgacctcgtaatctgcccacctcggcctcccaaagtgctgggatcacaggcatgagccactgcacccggccctctgtcagtctttaagctgaaaccaatggtataaaagtgacagagccgtagtagtttcaatcagtgcataattttaagcatctaccatgttcctggtctctcctcccatggagacaatgaaattttattagttacataattaatattcaattacaagcatattgctataaggagggtaaaacaaagaatgtaggaattgaaagggatgttccaagtaaaaggaaaagtatgtgcacaattctcaaagagcttggtatgtttgatgaattgagagaaagtgtagctggagaggggtaagagaaaaagaacagctggagttgacactggcagggaagtaatgactaggaaggtcatgttgaaaatttaaatgtccctaaggacaatgggaagccaatggaaggtgtcaaattggatgatgaaatcatcataatcatctggtacctggccctctagttctgtgcagcaaagactggaaagatgaacatctagtgttgtcttcccgcaataatgctggaattttctgctgagtttcagggagcaaacattttttaatacttcttttattaaatggcagtgtgttagctgtgttgacagagaacaagtgtgatatgaaagtcatcagcgggctctttcaggtaacccaggtgagtactgttggataggatggggacaggggagacagaaacattcaggttttggtgatacttttgaggtagaatccatgagacttgatgattgagtggatgtgatgtcttagtctgttctggcttctataaaaagttaccataagccaggtagtttataaacaacagaaatttttttctcatagttctagaggctaggaaacccagatcaaggtgctggcagattcattgtctggtgagggccatttccacaatggcaccttcttgctgggtcctcacaggctcgagtacagtgggccaatcatagttcactgtaacctcaacttcctgggctcaagcaatcctcctgcctcagcctcccaagtagctaggactacaagcaccagccaccacaccgggctaaataaattttttgaaaagatggcgtgtcgctatgtttcccaggccggtcttgaactcctggctttaagcaattctcacaccttggcctcccaaagcactgggattacagacgtaagccaccacacccggcctgcagtctcttttataaggacactaatcccaatcatgaggggtctgccaaagtccccacctcctaataacatcagtttaagtgttagaattccaacacatgaatttttagggtacacaaatattcaagccatagcaagaggaaagagggagtgtttgttgatagcatgagcaattgtatggatgtggccccacatactggaggcaaacagatcaggggctaaaagcatgagttaagggcatgtgttttgatgcctgagagacatctaaaagacgactcctgtaggcacctgaatgtaggaatctggagtacatagaaaagaaattggagctagacctaaaatgaggtctttgtagccatggaagtggctaagctcacctggggagataccatttaccaaaggtaagccgagggtacattccagctaagtagaagcatgttagaatttggctgcagagaatgccaaaagcctaagagattggtactggttctaaagaaaagacactctacccagcacaagtgagatgtacaaagtgcccatttcaacaagccagagacacacgtggtagtcaggcccacagctctgcattgcctaagtgagattagagctgggacggtggcccggagctgcttctccagtcctaacgcctagaatcatgggatggagattcgtgttagtgcccgacagtcacacccatgataccctcctgctgatgcggaggaagagacctgaggagttcctccgcaaacactcttacccgtactgctagatttacacggagatcacctagcgatatgcagtggatatggccaggcacatggccaaaccccaccactggatctccaccgttcaccacagtccacttgccccaggaatgcgcaggcgctaccggaagcgggcaccggaagtggctcggctcgtggcttccggttcctcaccagtgtgccgctgtagcgcaagtcatctcgttgacacttccgctgacccgtgcagttggtggccaagctggagacccaggatctccctgaggccgcgcgaggtcttctgggagtcctactcaccacatccgctactcggaatccaagctttaagtggcaacccgtgccaggcagtagctgctccgtgaagacagaggtccttgcccctgtacttctgtgtacagcaaagacgaaaggaaattgaggtctagcgctagcttcccagaatgacccagaattttctgctgagttccagggagcaagcgattttacttcccttattaagtagcacgaagtccttcactctctgtctctaaaccagaatcctaacagtcttcaaaattaacctgattgccacctaaaaccacgtattttttttaaaaagttcacttcattgccatcatcataaaatagcatttaatagaagccaaattgcacattagacgtaatcaataacttcagagcttgcaaactagagtgaagactgatgagaatacgtcaaaaagagtaagacccaaaacattgaataaacagtataagtgtatacaataaatagaattctgaggtatccaaaggaactggagattacagcacattcttacgtttacacagaagaatatttatattgtattccccccctacagacttaatgcaaagaggactgtcaattttaaaagacaaaacacctgtactacttagatgggccttggaaagatgggtaatggttatctttgaatcagatcaatagctcttctaaattacaaaactaaaccagatgaatacatacacttctaatgtaatgaacatcattttgttaaacagatggtcaaagcaaatacactttcctactaaaatcccacagggataacaagtttaatgaacattcaaaatagactattcatataaactataacctgctatgtctccctttgtacacataggcagtaaattgcagattactttgatcaaactctgcagtttcagattgtatgacatcttatgctgcagtcactagaacattgccacttaattatatggaaactcaggaggcaaagactcaaaatggcatttgctgtgaaatgtcatttgagttttaactccctgaattattgggttagtcattttctatgttaaatgaggaggtgtcaatagactaccacctgtagcaacaaagctctaaataaaactattctgagtcgacctcattcaaaacaactacattccacaatttcttaaattataaaatgtaaactgctgacatctgaattccattggaaaaatgctgttttcatcaatgacgactgtttaaaagactgtttaactattccagcaatcatgttaaggaactgttggatatacattttcatcactgcatcaacgacaaaaacggagaaatttgtctgagtcaatttattcagcacaaagttttcactctcatagtgtgttgatttccatgctgcaaaatgcagttaaccaatcattcatagcaataaactcttgcatttagtttttcattcccatattaacttttatccagtatttgtgaatagcacctaacatggaaggctagtatctgagttaatgacaattttatggaatttatctccatcagttgacactgtaaacagaagggtgaaatgccatcatcataaaaagcctgaagctcaccagcagatatatcttttccttcaattccctgggggtaaagcagcttgaattacatctagcaaatgtatttaagtacaactgcacaataagcacaactgaaaatatgcctctttcacagtaactgacacttccggggttttcatttttttctgcatactaatcattaacagtattataccaaaaagccattttagttctacccacacgtatgttaatgtttctgaaaagggctattttttctaatcttttaggaagtttgtcgtaatcttccaaaatctggagaaaactgcaaaaaaaaaaattagaggttaattgtgaaggaagactcgtgtggaaaggcaaacttccatattaaggtgcagaacaggatgtatggcacaaattctcactttctgctatattttctaggagccaaaacaaaaatgacagcatacatcttttatatcacccccattctgtccaagtgccttctaagatattcccctctacttctttctgcagcaactctgctaatccagacctttcccaatttcatcccccatcctgtgactcattagatctttgactgaactcttagggcccctgatatgtgctgatgaggctcctgccagtttctcccactgagggcagaagcaggagagcaaggaggtggtgttcttgttatttaacaaaggtcatggtatctcagagttgcctaataagtaatctaactggagactatctttctacacatttcaaagcacctcagagaaacctggaagctggtgtcctgtctcctaagagtggagacatcagaaacaaacagccaaagtctgaccttgacatacagagcagcacattgtctcaactgtggatctgcaaacaagaaacaagacaagaatgacaaagagagagaaactctctctgggttagggatgtttttgttagtttcagtttttctctcacctgaacagtatcttcctgcctctactcagtaataagagcttagctgagtagccagcattttttgtatatttagtcctcaatctgctgttctgtaggaccaccttctgctaccttccatataattagtcctcaagagtcctttatcttttctcccagcaaaaattcccagcaacaattcaattttagcaaatattgtacttttatactgtctatttaaatagaatgagagcattcttccatcctaatcaaaacccatgtaaatattgttttgctgataggcatacaatcgactttaatgagaaattgtatatgaatctatatttacaacattctgtggttctttaacattaataaccataccatttaataatattttgctccagtatttatctataatagcaatatctaaagatctatatattatcaagtattttggttaaaatctaacaattttctatatgcattttctttggagatggagaggaaatgttatgggtgttttttaaaaaaccaaaacccagttaagaccttcagtattgtactctgccaagtgtgaaatctctcatctgattagagggacaagaattcaaacctgaagtcctggagagtcttctgctgctttgtaactgtatatgttagtcaggctttgggtacagcacaaagggaatgaaggggttccaggatgcaagcacacagaatcgcctccatgaggaccaccctcacctatctcagctcccctttccctggctgcctgcagtgctactacgtggtgcaaatgccaacaaatgccgcagtcttgcagactgcatggcctttggagtcagagaaacccaagcttaatgtcagtttcaccacaatgtgatttgtgtgctgggcaaagaactgactttaccctctgaggacttcagtttcctcgtttatgaaacaaagattttttttctctgtcacagattctgaagattaaattacataatatatctaaagtagctagcatgctcactgagaaacaattacaattattcatagtaagacaggtaatgtgcttcagtagcaatttggaggcaaatcttagaaaagagcaagtacttctccccctccccaagtcaagtccagcctccagaaaagggctgcagttagacttccaaaactccttgcaaacaattgggtcctaaatgccagtatgtgcccctggcatcagaaccatgacagagaactccggatactaatggccatcaaaatataaactagtctacccatttgggaacttttacagggcagaaaaaaacttctgaacgcctgtgggaattcacatgtagaacagcaatcttatacaagtattacattcaaatagttatagcaaaaaaaagtataaaacatataaaagcatttactttcctagatatgtctgcagaactggcaaaatataaataaattctcctccttctaaaagtcagaaactacgtaaacaaaattaaaataactttagcaagagccttcattttaatgaaaattgaatttaaacaaaagttgtgtatcttcttctggctcacagttgtacagtaactgagttcaaatcctgggttcattcactagtttagtgacacggattttgcatccctacttataaaatggaaatgatactgcctaaatcacggttgtgctgagaattaagtattacatgggaatgtgtgtaaagtgcttagcacattgcctgggacatatacagtaactgcttcccaccatacagatactgaaaagcccaatcactaataacaatttgttatatttactttacgtggtgttttttatgtgagttcgcttatgagtaatgagatgcaaattcgacttgaaagttttcccacacacggtacatttaaaaggttccgctagcatgtggctcttctggtggcatgcaagttctgagtccaaagcaaaactttcctcgcatgttttgcacttatggggcctttcctctgtatgaatgttctgatgggaaataagctcagagaaacaaggaaaggtcatgtcacagtcaggacactgtaagggcttgaattttgagaatgagaagaaattgtccccatcatcgctgcagcgttcagagtcctcgtcgtggctcttctcggaaagggcaggatataaggactgcctgaagctcttcatgcacttagtgtgctggtactgggggcctgatacgaatgtttcctcaggcaaagcaagatttggtttctcattaaaatgtttatcacagttagtagattcgtaggtgttttcagcactgtggcttttctgatgctgtgccaatcctgggagccacataaaacctctaccacatatgctacatgtatagggcttctcctttacgtggctattcatgtgtcgggatagatgagagtgctggcgaaagctggcactgcacttggcacacttataaggtttctcaccagtatggattctcctgtgtgtcctcaggttggctctatgattgaagatctttccacagtcaccacatttatgttttttctctcctgaatgaattttctgatgcaaaactaggtatgaatgatcgctgaagttttggtcacactcaggacatttgtacacatttttggctccttcccagggagaatcaagaatttcagaaagtgtgttggttcctaaatattcagagagttctactaatggggtgtggttttcaatggtaactaaaaggctgatgacccttctcttgtaagtgggagttccacttaatattttcgcttcagggtttccaactccatcctcagaggatttttctgggtaagggacaaggggtgcagcaatggggtacttttctaaggcaagctcgtcaagttccatagactctaggcttaactgctgattaatctcaggcttgccttcctctcctgttgataaaaacaaaagaaagcaaaacatagacaatatcttcaagggatactggggaaaaagtaagctaaggtagttacaaacaggaccaggaaaccttagaagggttattctataacccagacactaaccacacaaaatcaggaccaagcagactctcctggcctcccagaagatccagttttgggtgaatatccaaaggtaaggagagaatagctataactaagtcagagtccagtgggataggtactaaggacaatctcagtagcagctatctagaggtgaacttttccatctaatctatttaggcctcaagagcctttcatttttgaagctatctcaagtgacagcagaacaattaacaattggaaaaaagattaggattcatatttatcaacaaagagaggggttgggcagtgtctcacgtctgtaatctcagcactttgggaagctgaggtgggagcatcacttgaggctaggagtttgagaccagtctgggcaacacagtgagaccccatctgtacaaaaaataatttttaaaaattagccaggcatggtggcacatgcctatagtcctagatactcaggaggctgagacaggaggatcacttgagctcaggagtttgagatgtgccattgcactccagcctaggtgacagagccagaacttgtttcttaaaaaaaaaaaaaaaagatgacagcaagaatgagtgggaaagaaaataatttttaaaaagaggctgggcacggtggctcacacctgtgatcccagcactttgggaggccgaggcgggtggatcacgagatcaggagatcaagaccatcctggctaacacggtgaaaccccatctctactaaaaaaaaatacagaaaattagctgggcgtggtggcctgcgcctgtcgtcccagctactcgggaggctgaggcaggagaatggcgtgaacccaggaggcggagcttgcagtgagccgagatcgcgccactgcactccagcctgggcgacagagcaagactctgtctcaaaaaaaaataataataataattaaaaaagaaaaaagaaaaaaaagcaatcaagtgagcatttttcttccataacaaagaaacacacgggttatcagaaatagttttattatcaccaggagaactctccaaaatctctttactcctcactgaggaaagatcaaggtagaaggctgtgtgtactgcatgaaaataacagccaatctacttacaagaatggctgacaaaactaacattcctgtgtaatattttccaagtattcttcagttataaagcaaatatatcaatacaaaaggaacttttctttccagagaaacaaagttctacagttttcccaactcactgactagaaagggctgcagtatagttcatgggaatccaaacagtaccaagtggttttgctgatttgaggggactgagttcagagatcagggatgccaaggcagctagaatttgaaagcaaaacagcaaagaggcagctgttcagaaagagagctcaggtcatctacatggggtccccttaagactttcctgaggctaggtacagtggctcaaacctgtaatcccagcacattgggaggctgaggtgggagaattgcttgagccacggagctcgagaccagcctgggcaacatggcaaagccccatccctacaaaaaaaaaacaacaaaaaaagacaagcatggtagtgcatgcctgtagtcccagctacttgggaggctgaggtgggaggactgcttgagcctgggaggtcagggctgcagtgagccgtgattgtgccactgcactccagcctgggtgacagatcaagatactgtatcaaaaaaaaaataaccccacaactttggctgagtagtaatctacaagtgcatgaagaaactacccaatgccgtggaaagaaccacctaaaaggaataacagagcaataaccagttcatgttgcctccagccaaagtggaaagacataagacattgagcagcaacgtccacagaaaaaaactgccttagcagtaactcaaataagtcctagcagaaaggttgatctgaacctatcctaacaaagcaaaaaaaaaaagcacaccttgaaacagtcaaactgactccaagtaacttaactgcctcccacaacaaagtccaaaatatttttaaaaatacaacgaaatcccgggtccaacaacataaaattcttaatctaacatccgaccaaaatttacccaggaagtaaagaaaatatagaaaatataacccataactagaagacaaatcaatcaatagaaacagacccagaaatgacatcaatgttaaaactagcaagaaaaaaaagtttaaataaccattataaatatactccatacatttacgcagacagaagacaacatgaacatgatgaagagagaagtggaagaaacaaaatatgagttattcagaataactagttactctagttatttttttctgactaggattgagtatctcaactattccaaactatttagaataactacttagaatagatagtttagatactcaatcctagtcagaaataaaatctagtcaggcacaggagtccatctgtgtatggttccccttaggtgagtaaggcatagcaccccttaagagtaaatcaatctccagtctttagcaaatgatagtgatcgatactaatgggatttcccaagtaaaattgtaaactgcaacaaatgtttgtgaaagattaccaaatactgccatctcttgtactaaaccacaggcactgtactagactgaatttttgtctttaagagatcatctcggccgggctcagtggctcatgcctgtaatcccagcactttgggaggccgaggcgggtgatcacaaggtcaggagattgagaccatcctggctaacacggtgaaaccctgtctctactaaaaatacaaaaaattagctgggcatggtggcaggcggctgtagtcccagctactcgggaggctgaggcaggagaatggcgtgaacctgggaggcgcggtttgcagtgagcagagatcgtgccactgcactccagcctgggcaacagagcgagagtctgtctcaaaaaaaaaaaatcatctcatattttaaaactttttctctcacacaattatcacctccacataaattactgagggacaggtcccactccaccataccaacatctggataaagcatgaagttctcctcctagaattgacaaaagttccagatgcaggaaaaacaattgccttacccatcaaagccgcatcctccaaagactcttttgtaccatctttgctgagggacctctgggcagggtgcagagtcacgcactcctcttgagaaaaatacacagccagatcctcaaagagtattggtccctgaaacacaagagcctgtgtcagcacaagagggtggagggtcagcccctcacttaacctaggaaggatgaaaagagctagaaacatcagatgcacgggataaaaggctcggtgtaaaaggttcttgagcgcagaagtagggcaaatgggttctaaggggtggggtgagggttgggaagaagagagtaaacatggacatacatttttaggcagtggtacaaggacggtggactgtgagaattattgtctatcttgaaagagaaaagatgagggaatggctcttagggaggcaaccattaagtgaggatgctctaagaaaaggagaggtttggggccgggtgtggtggctcatgcctgtaatcccaacactttgggagtctgagggggatgcagatgacttgaggtcaggtgttcgagaccagcctggccaatatggtgaaaccctgtctctactaaaattacaaaaattaaggctgggcacagtggctcacgcctgtaaccccagcactttggaaggtggaggcgagtggatcacctgaggtcaggagttcaagaccagcctgaccaacatggtgaaattctgtctgcactaaatacaaaaaattagccaggtgtggtggcgcatgcctataatcccagctacttgggaggctgaggcaggagaatcatttgaacctaggagaaagaggttgcagtaagccgagattgcaccattgcactccagcctgggcaacaagagtaaaactccgtctcaagcagagcttgcagtgagctgagatcgtgccactgcactccagcctgggcaacagagcgacactccatctcaaaaacaaaaacaaaaacaaaacaacaacaaaaaaaactctgtctcaaaaaataaattaaaataaaatgaaattagccagatgtggtggcatgcgcctgtagtcccagctacttgggaggctgggccaggagaatcgtttgaatccaggaggcagagattgcagtgagccgagatcgcgccattgcactccagcctaggcgtcgcagcgagactgtctcaaaaaaaaaaaaaaaaagaaaagaaaaggagaaagttgggcagcccaggaagaatcataaagagataaaggttacaggattctcccaacatccttccctttgctatttcctctcgtccccatgacactcattgctaagctcactccagcacttcatccaggcctaccccaccttctctaacggtgtgataaattaatcacttgggatttattattactcaacgagtgtggagtctagaaatgtgcttaatttaaaaattcattcaaattggagaagtaccaaatctgtaattttgggaaccattccagaaagtcacttttaatcctagcactttggggagccgaggtgggaggatagctgaaggccaggagttccttggcaaagcagcaagactccatctccataaagaagttttaggccgggcgcagtggctcacacctgtaattccagcactttgggagaccgaggcgggcggatcacaaggtcaggagattgagaccatcctggctaacacggtgaaaccccgtctctactaaaaatacaaaaaattagcagggcgtggcggcaggcgcctgtagtcccatctactcgggaggctgaggcaggagaatggcatgaacccgggaggcggagcttgcagtgagccgagatcgcgccactgcactccagcctgggcgacagagcgagactctgtatcaaaaaaaaaaaaaaaagaacttttaaaagtagccagacactgtggtatgcgcgcctctcagatactcgagaggctgaggcgtaaggattccctgagttccagacggagctatgatatcagcactgcactccagccagacaagcaacactccagcgacaaggccagaccctatctccaaacaaaacaaaacaaacagataagacattgagaaactctctcagagattcctccacaggtccctgctcccagttggtagttctgaaagaaggaagttggtaaaccattatgtgtgtggtcttggaacgaagaacacttggtcaaagggctatttggggctcaggagcactcctaccacaacaggcatgcccaactctcctccaaaggagggggtcaggcagagaccgaaagcagcaataaacttggacgaaaaaggtacctcgactcacctgggcctcgggcgtcgggggcatggacgccatttggcgggtggggaatgccttcttcaagacgccacagggacttcgtgacaaagctgcggggggagagaacagttcttaaagggaccaattccgctgccaagttcctccactacccctagcctccctcgattccctccgaacccccccttaaaaacctacgccgactgctcctcctcttggcccggcctcgaaaggggcccacttaccgctccgcggttaataacaggcctcgcgctccctgacaggagctgcagaaagcgacgcccgaccgagacgcgacgaagaacgccacggccactgcaaaactcccacgctctcatgctcctttacgcaggagctgcgggaaaagccgccggaagcgacccgccctcagccctctccgccatcctgccctttgattggtcgaagttctcccgaaggggaagtccttcttttgtgttgaccaattgaacaccttaaccgaggacctgtagccactgggcagctgcgagaggtagttttcctccttttctctaagcaaccatttccgcttccgctggcggggtctcctccgtgagctccgggcctgtttgcctgctgaagtagagtcttagggtgaccccagggggacgtaatgtttccgagaagaaggacagaaagaagactgggagacaccggaactcgaaagaaaatcggtaacaaaatgtgggttcggccaacagtgccctgtaggcctgaaatttcggtctggccagagcaaggtgattgagagggcgggggttcgggcctagcctgggcttgagctgtcctttgtgtcttgagcggatggtggggccgtggaacatgaaggagtatctttgtgtacgttcacaacgttcacatcggtgtaggccaggttgctggactctgactcaaagtgttatagaggcattacgtattgtacccgcagctgcagcctaagcgagctgcttcagcttcctagtcacaggatcccacgcgagaatagagccataggttagcgtcgcaggacgttgttcgcccccggatacctcacatgcagcctaccctagagccagtcatttcctattgtgtgctgggggaggagggagtgccctggtgtaggcatttggaattggaaaattgagctcctccccaagctctgccactgattggttggtaatcttggccagtttacaactttgctttcctcagctgcaaacagctcagagtgcctctctgggctaactcagagggtaatttcaaagattataagataatgtaagtgaaagaaattgccagtttataaaggtgtttggggaaaaaaaaagacgaaaatgataggtaccttgatagaaaagcctgaaaagtctcaacatatttccttattccagtgccaggcacattcctgtatctaaaagcttaatgaatggctgcatggttattaaaacaatattaggagatttgacaacttaggtaatgtgattttgtggaatatctgataggatagtttcagctacaagtaacagaaaacccaccgaaaggatgttcaaagagcagttacaggttggttaattcggtggcccagtgacaacatcaaggtcccagtgcttctctgccaccctaagcatgttggtaacgttgacaatagaatccaggtaaaatatacagacatgtattgtgtcatgtacccatcctaaactagttattaccaagaataaataattgtttggggcccatcatgcttcagcccctgtcactaggggaaggacctagcctcccttgataatctacctgcacaaaattagggctttgttacaaatgaaaaaaagagatgtggaaaataagttagataagaaactagcagtatctgccacaaatgatatctcttgacagctaactaagagctagaccttgtggggatggatcacaaaagaggtagctgtgaagtcccagtaaaggtgcttccaggacaggtggaagaatggtaagaacaaacttgcctacaggctagaccagtccaaagcatatatgttgaagaagagctaatagcctgtatatgaaggtgtaagtaaaggagatgttcatggttgagtcactgtggtgttcacgtagtcatctttcccttcttggtttgtgcttatctcttttttttttttttttttgagacagtctcactctgtagccagactggggtgcagtggcacaatcctgactcactgcaacctctgcctccggggttcaaatgattctcctgcctaagcctcctgagtagctgggactacaggtgcccgccaccacgtccggctaattttttttttttgtatttttagtagagatggggtttcatcatgttggccaggatggtctcgatctcgtgacctcatgatccacctcggcttcccaaagtgctgggattacaagcgtgagccaccgcgccccgcctatttaatgctattcttacatcagcactgtctcattgtggtctgagattctccttatctggatttgtggctctttcaccaagaacaagagactcccgtggctctcttctttaaatcctgttgccataattacaaagaaataaacacagtttccaatgctttgaaatgaagcatgtggtattaactcagtggattaccagagagagagggatatacctgaaatgggagaggaaaaaatcttccctagactatctttcctaagagccatcaaaactataaacaagtggacaaagaaggaggaagcttgaaagctttatcttcctgaaaataaagagatgacatacaaagtccaagatagaccaagattgaaaaattagaccacattatatccctaactcaattttgtaaaaaatcacaaatgcttgactgtatacccactatatgttcaagtaacatgttttaatcatcaaaatttaaaaatccttccacgacaatcttttgcaagtttttccatttctgtctttaacatggtaccagtaataacaactacaacctgtttgtattgaaattatttctatagcccagcatctgctttctctgaaaattatctttttaaaaatagtaaaactaacatcattacaaaagtagtatatgtgcatttcagaaagttaggaaaggctgggtgcggtggctcacgcctgtaatcccagcattttgtgaggctgaggtgggcagatcacaaggtcaggagatcgagaccatcctggctaacacgatgaaaccccatctatactaaaaatacaaaaaattagccaggcgtggtagcgggcacctgtagtcccagctactcgggaggctgaggcaggagaatggcgtgaacctgggaggcggagcttgcagtgagccgagatcacaccactgcactccagcctgggtgacagagtgagactctgtctgaaaaaaaaaaaaaaaagaaaatacaggggaaaaaatggcaacacattcctgtcacccagagatcaccactatttactctttattatttgtttttttttttttgagacagtctcactgttgcccaggctggagagcagtggtgcgatctctgctcactgcaacttccgcctcctgggttcaagtgattcttgtgcctcagctaccagagtagatgagatgatgggcagatgccaccacaaccatttaatttttgtatttttagtagagatgcagttttgccatgttggccaggctggtctcaaactcctggcctcaagtgatccgcccatgtcagcctcccaaagtgctgggattacaggtatgagccaccgcacctggcctgctcactgcaacctccatctcccaggttcaagcaattcttctggctcagcctcccgagtagctgggactataggtgcgtaccaccacacctggcgaatttttgtatttttagtagaggacgggttttccccatattggccaggctggtctcgaactcctgaccttgtgatctgcccgccttggcctcccaaagtgctgggattacaggcgtgagcccctgcccccggcccctattcttaagtatatatcttttccctagtgatttttatgatgatgcagctgtatattgaaacggaaagatactcatttttgggagtaaaattggttatgaaacaaaaacaataacaaagttgcttttgaagactatgcgttaaaatggtagtggtagttatatttttaatttttatgggtacatagtaggtgtatatatttatgtggtacatgaaatattttgatgcaggcatgcaatgtgtaatcacttcaaggtaaatggggtatcttccctggcgatgtttaacatgatttccagaatgaattgctcactacgtttggtgtgttttccattcccagatggtactgccttttaaggtctattacttaaacataagtatggctctggttcttaccgcctttaccgtatccttcatgggaagttgatactgatcggaaactgacacagagccttctcacctacactaagggggcctaggtaagcaagattatctttctcccaacttcagcaagaggttttcttactggtgttcagaatgcttgattgagcagttagaaaactgttgctacctagtctccagtcttataaggggacaatggctgcaagtcatgcctgcaagaacaagaggctcacacagttttgaaattagcacaacttctagctggataggagtctttttagtttcatttagccttgagttgaaactaataggagtcttttaattagaaaaaagctcagggctctaaacgtaccttcaacatgttaattctgttaccaaaaactggcttggtctgtgttaactcccaacagaattctttttcagtcactgaggcagaggtgcttccagagaaagattcttgacctactcatactgaataattatcgttactagaagctgcaaccaaagactcctggagggtagtaagaggtacagagaatgcaggttagatacagtgaggacagagaagaaaggatgggttggaggctgggcgtggtcactcacacctataattccagctactttagaggctgaagcaagagaatcacttgagtccaggagttcgaggctgcagtgagctagcattgtgccactgcactccagcttggatgacagagcaagaccttgtctcaaaaaaaaaaaaaaaaaaaacatgggttgctttgtagtttagagaactacatgtttagatagttaatttttccccaaaagggcccatcagattgatactctgagatccagggtttgtctgacactcattagcctatgagttgtagagatgggatggccaggagtgaagtgatggccttgtgtctttctcccctgcagcatacagaaaggctgtacctggaggaaggaagtgcggagccagcctgagttgggagaagagctccagagagtgagtcaaagcgctctgtgtcctgctattaatgatgccctcatagtcagaggaagcctacttaagtgaaatccatttttgacctgtcaagtattaaatattctcttaatttttagtactgaatgatagaaggcgcctagtgaaacaaatgctttcacttttttgctaggagggtaaatgagtatattcttacgttaggtacacagggatacagtacaagtatgccagcctctttaaactataaagaagtaaacaagatttggtttaagcatcagtctcttgtgagtctgatgggtaagcccagtctcagggcacactgacaatgttagtggagaacgagactctcccagtgtgctgccctgaccctctgagattggtctgtgtagccacgtggtggtcatcctgtgccacctctggtttggttctaatcaaaggaagcagtatcatctgtggtgatccgtcttacacacttgcatcattttataccaaaggagaatttcttttgttaaaaatttatttttcattatctactcataaagaaggagccaaagggctgggcgcagtggctcacgcctgtaatcccagcactttaggaggtgaggcgggtagatctctggaggtcaggagttcgagaccagcctgcccaacatgttgaaaccccatctctactaaaaaatacaaaaatgtagccgggtgtgctgggcgtggtggctcacgtctgtaatcccagcactttgggaggccaaggcaggtggatcatgaggtcaggagatcgagaccatcctggctaacacggtgaaaccccatctttactaaaaatacaaaaaattagctgggcgtggtggtgggcacctgtagtcccagctacttgggaggctgaggcaggagaatggtgtgaacctgggaggtgacagttgcagtgagccgagatcacaccactgtactccagactgggcgacagagcaagactctgtctcagaaaaaaaaagaaaaatttagccaggcatggtggcgcccaactgtagtcccagctactcgggaggctaaggaagaagaattgcttgaactcaggaaatggaggttgcagtgagctgagatcgcaccactgcactccagcctgggtgacagagcgagaccccatctgatatggtttggctgtgtccccacccaaatctcatctgcaattcccatatattatgggagggacccagtaggaggtaattgaatcgtggggcaggtctttcccatgctgttctcatgatagtgaataagtctcacgagatctaatggtttttaaaaaggggagtttccctgcacaagccctcttttgtctgccaccatgtgagacatgccttttaccttccaccgtaattgtgaggcctccccagccacgtggaactgtaagtccattaaacctcttttttttgtaaattgcgcagtctcaggtatgtctttatcagcagtgtgaaaacagactaatacatcgtctcaaaaaaagagaaaagaagaagaaggaactaaagaagaatttctttggaagcaaaatatttggaagcaaaatatttggctcctgactgaaagggttttgatccatgcatacattaataaacccttcagaaccatgagttgggataattcactgtcccttgtgctagtctcatggagcttttctgctcttctgggagtgctcctggggtggtctggaggcctctcaggcagagcagaggctggtcagcaagccacagggcttgccatgaagtggtttgttcatgatttgtttctgggaccctgggaaaaatgttctcagggtctgcctaggaaggctggttttggaagcttgtggatttctttctgggtgagtcaggaaagttgtgctcctgctgggcgcagtggctcatgcctgtaatcccagcactttgggaggctgaggcaggcggatcacaaggtcaggagatcgagaccatcctggctaacatggtgaaaccccatctctactaaaaatacaaaaaattagccgagcgtggtggtgggcacctgtggtcccagctactcgggaggctgaggcaggagaatggtgtgaacccgggaggcggagtttgcagtgagccgagatcgtgccactgcactccagcctgggcgacagagtgagactccgtctcaaaaaaaaaaaaaaaaaaaaaaaaagaaagttgtgatccaagggaaagcatacaggttttaatgatgaactagtttgttcctttgtctcctggctttcattcttcatggcatgtgctcagggcagccagtggagagaggcatcattctgcatggtatagaagccttgggtgggtgtttcatcatctgtaaaatgaggacaacaatactgaactttcaaggccattgtaaattagaatgtacagtacaagcattgtaagttagaagtcaattagaacatgcaggagggattataactcagtgtttagcgtatagcagacacttagtaaataatgcatttactctgttccattctagaagctccattgttgtttgtacaacaaacacctctgttgcagtgcttatcagattgtcttgtaatcacgtaactcctcaaaggcaggatgtgtgtaataacacatttccttggtcaccatttgtacccagaatggggaaggaagaaatgaaaagaatccagtatctaagcccagcctccatttcacttgcacgccttttatttatgaaaatatagtacttgtccatgtaaataatatctctgaatggataccaggaaaatggtaagatgagttagctggagaacttgggtactgagttggagggagggtaacttatttttcaccaatgtatccttttgttttgctttaaaataatttaccacaggcatgcattacttctaaaaataaaaatgtttactgtcagaaaactcccccaagttaaaccaaaaccaaaatatgttagatacatctgtaacactcattataaaagatgacatataaatgcctcaaaaatagaaaaggtgatcaaacttactgagaaatgtgcattaaaacaatgagacctttttcagttagattgcagaaaggtaaagaataatacctggccaggtgtggtggctcacacctgtaatcctaacactttgggaggccaaggtgggtggatcacctaagctcaggagttggagaccagcctgggcaacatgacaaaacctcgtctctacaaaaaatgcaaaaactagtgaggcttggtggtaggcgcctgtactcccagctactcgggaggctaaggcagcggaatcacttgagcccaggaggcagaaattgcagtgagctgagaccacacgactgcattccagcctgggggacagagcaagaccctgtctcaaaaaaaaaaatgagcatggtggctcacaccagtaatcccagaatcccagcactttgggaggtaaggtggtcagatcacttgcaccaggagttcgagaccagcctgggcaatatagtgagactctgcctctacaaaaaataaaaaattagccaggtatggtggcgcatgcctgtactcccagctactggggagggtgaggtgggaggatcacttgagaccaggaggttgacgctgcagtaagccgtgatcacgccactttactccaacttggatgacagagtgagaccttgtctcaaaaaaattaaaaaagactaattccctatgttggtgaggctgcgggccatttgccctgctgtagtgggtgtagagtcttcacactcttggtatgagaataaattggtaaaactttctggcaggcaatctagggtttgtttccaaagttaaatgtggttaattaaaactaattttacttatgcctgtaatcctagcactttgggaggctgaggtgggcagattgcctgagctcaggcattcaagaccagcctgggcaacatggcgaaactctatctctactaaaaatacaaaaaattaaccgggcatggtggcaggtgcctgtagtcccagctactcaggaagctgaggcacgagaatcacttgagcccaggaggcagaagttgcagtgagccaaagattgtgtcacactccagccggaggggcagagcaagaccccgtctcaaaaaaaaaaaaagaatgcttggttgagcatggtggctcacaccagtaatcccagcactttgggaggtaaggtggtcagctcacttgcaccaggagttcgagaccagcctgggcaacatagtgagactctgtctctacaaaaaaatgaaaaattagccgggtgtggtggtacgtgcctgtagtcccagctactggggaggctgaggtgggaggatcacttgagaccaggaggtcgacactgcagtaagccgtgatcatgccactgcactccaacttgggtgacagagtgagaccttgtctcaaaaaaattaaaaaagactaatcccctatgttggtgaggctgcgggccgtttgccctgctatagtgggtgtagagtcttcacactcttggtatgagaataaattggtaaaactttctggcaggcaatctagggtttgtttccaaagttaaatgtggttaattaaaaataattttactcacgcctgtaatcctagcactttgggaggctgaggcaggcagattgcctgagctcaggagttcaggaccagcctgggcaacatggtgaaaccctgtctctactaaaaatacaaaaaattagctgggcatggtggcatgcacctgtagtcccatctactcaggaggctggggcaagagaatcgcttgaacctgggaggtgtaggctgcattgagccaagatccactgcactccagcctgggcaacagagtgagactctgtctccaataatgaaatcatgaaaaaaaatttttttttttgagacagagtttcgctctcgtccaggctggagtgcaatggcatgatctcagctcaccacaacctctgccttccaggttcaagcgattcttctgccttagcctctcaagtagctgggattacaggcacgcaccaccacgcctggctaattttgtatttttagtagagatggggtttctccatgttggtcaggctggtctcgaactcccaacctcaggtgatctgcctgcctcagcctccgaaagtgctgggattacaggtgtgagccactgcacccagctaataataataatttgaaccaacattctaggcattttccctaaggaaataatcagaacgtatgcagatttgtgtacaagattgtaagttgcaatattgtttttgacctgaatgtgtaggtttcagtggggaaacctgatccccagtccctgctctcctcccaccccaaccccatccatctactacctttcccaaatagagcttgcgtagggccattggtgtccaggatccagagcagggcatgggtttgtgggaggtggtggttggaatcacctggggttggatactggacttagttcctctatgggtaaatgagagcctggggattgtcggaaagaggcctagggtgaaaattaaaatgacttaatttcaggagcagtcttggccttggagattcatgggacttaagagaggaagggcagaggctgaccgtgtagatggtagcttgttgctctacctgggccagagaagcctgcttgcctccctatctccaaggctgaaagagggttgtgcagctgaagatacaggaatttaggatacaggcaagtgccatgacctggcagcttggtatgtcgctacactgcaggagcctgctggcttcccaccactgggagtgccgttaggtgtctgtgctagacccatggccagagggtgaaaggaggcatgagtaaataggcaagagaaaagcgataatatgctggaagaggccttagagccagagggagaaggagcagacagactctcataaataaggagttctggtgaaacagaatttctgcgagagattcaattatagcaaaactttatggaaccaaaaagcttaaaaaaaaatcagaagtttaatagataaactgaaggagagaatggtcagcacaaactgagtagcctgttagatcaagtggaagaaacactcaaacacagcaaaaaaagagagagagaaaggaaccatgaaagcaaagaggtggaggaccaatcagccctgaagtcgatggtgatcaacccattcctgaaccatccctgtgaccggcagatgtccctctgcttgacttgcttaggcaggggtcctctgaactcatcacagagccaagggagaatgggatgaccttaatgggttaaaccagttagggaacacactggaacaaggggtagagtctgtgccacaaacacaaagagaaagggtggaagtttttttagtgtacaaataaccttgaatatctcctgtagtgacacatggtgcctaaccgaatgaaccgttgtgaagataaatgagatcttgcataacatgtttaacacaatgcctcacacataagccgtggagaaatagttattttctcatttgtgttttaaaggagtatttttttcttttttgagactgtcactttgttgcccaggctggagtgcaatggtgcgatctcggctcgctgcaacctcggcctcccgggttcaagccattctcatgtctcagactcccgaatagctgggattacaggcatgtaccaccatgctcagcaaatttttttttgttgttgtatttttagtagagatggggtttcaccatgttggccaggctggtctgctggtctcgaacctcttgacctcaagtgatccacccgcgtcagcctcccaaagtgctgggattacaggcatgagccaccgggcatagccaaaaaagagtttttagttttttttttttttttttttttgagacggagtctcgctctgtctgtcacccaggctggagtgcagtggcgcgatctcagctcactgcaagctccacctcctgggttcacgccattctcctgcctcagcctcccaagtagctgggactacaggcacctgccaccacgcccggctaatttttctgtatttttagtagagacggggtttcaccgtgttagccaggatgctcttgatctcctgacctcgtgatccgcctgccttggcctcccaaagtgctgggattacaggcgtgagccactgcacccggcccaagttttgggtttttttgttttgttttgttttgagaaggagtcttgctctgtcccagactggagtacagtggcgcgatctcggctcactgcaacctccacgtcctgagttcaagcgattctcccacctcagccttttagtagctgggattacaggcacgcaccactatgcccagctaatttttgtatttttagtagcgacggggtttcaccatgttggccaggatggtctcgatatcttgacctcatggttcacccgacttgacctcccaaagtgctgggattacaggcatgagccaccgcgccctgcccaaaaaaagagtaaagtttgaagggatgtacatgctgttctgtttgccagttcatcttaacggtgctgtatttagaaccctggaaacagccgggcacggtctcaaaacaaacacacaccccgtggaaacaatagaatgttgttactctgttgttacttagggagtgttttttcaaactgtactgtgcttgttactcacatgggggtcttgttgaatgcagattctgaattaagtgcccattctgactcagtccaactgagtcctgaggttctgcatttttagcaagctcccaggtgatgccgctgctcctggaccgcagactgcactgagtagcaggcacctgagttttgcctgtttttatgattgattgggctccccacggcatccatcttctagccagtgggaaaggggagaggaagtacagagcgagcaatttcctttttttttttaaccccatcttttattttgaaaatttcaaacctcctcaatttttgaaagaataatgcgcttcaccagttgttaacaatttagcaatattcttttaagcacatgacacagaagttgccaacattgtgctctctcttgttcactggtgaaacttttggcacatagcctgatcctgctgcaggagaggctgagaaataaaagcctagcttgacagtgatctgcctgctgaagggggtgggattctgttactactagatgatgataaagcagttattttttaaaaggagaagatggcagagtaggacaatggatactaggggacagtttgacacgcagactcaaatctttttttttttagatggagttttgcttttgtcgcgcaggctggagtgcagtggcgcaatctcggctcactgcagcctccacctccagggttcaaacgattctcctgcctcagcctcccaggtaggtgggattatgggcacatgccaccacgcctggctaatttttttgtatttttagtagagacagggtttcatcatgttggccaggctggtctggaactcctgacctcaggtgatccacccacctcggcctccggaagtgctagaattataggcgtgagccaccacacccagccaagactcgaatcttataaccagttctcttcaaattggattctggaaagctcggagttgaaatatacagcccaggttggtcgtggtggctcacgtcagtaatcccagtattttaagaggcccaggcgggcagatcacttgaggccaggggttcaagaccagcctgggcaacataatgacattcccatccctacaaaaaaacaaaaaacccaaaaaacctgttttttaattagccaggcatggtggttcacacctgtagtctcggctacttgggagactgaggcggaggccaggagttggaggctgcagtgagccgagattgcgccccaggctgggagacagagaccctgtctcaacaacaaaaacttcgcgttagatcttgcattatagaacccctacaaccggagggcagcttaagttgcctgttttactcagggacagccctaaactgcctttcgccagaatcggacggctgagaatccagtgtcgtcgcggggtggtgctgccagctggctccgggtggtcggccaggagccagccttgtgcacctgctttcagttgttggccagccccggcgctgcaggccctcgcgagcttaggatgcgcctgccagggcctgtgcgggggggccactcggtagagccgcgggacctcggcccggaaaccgcgccaccggcgtccgcacacgctaggccggggagcccagaggtctggccggccatgtctcggcgacctcccggagcgagggacagggaaggagccggccctcaccagtgccccgcatacgggatcctgggcctggcttcgcacggagcctgcccgctcccaacctgcccgctcccaacatggcggcagcgccggcctcagggggcggggccacgtgggggcggcggccaatgggcttccgggctgcgctgccggcagggagcgggaggcggaagtgccgcgggctgccgcctccgtcccggctgcggcccctgccggttacataactcgttgcgggctccgcgcggtcccacttcccggctcccttcgcctccaggatgcgctgagccctacaacacccccagcggccgccggctcccccacgaggtgaggtggcggggggcggccgccggggctcggacctgcggcggggcgccgagggggcggggtaggcggggaggccgcgccggggtcaggggggccagcgcccaccgggtacgagcgcgctggtgaggcaggcccggccgcgcccgcgcccccggcgcacggtcctcccgggagccggtttcggggacggcggcggggagtgggcgctggccagggacgagggttgaggaggtcgcggctctcatgctgggtgggagtcgggccttctgcctgggggttgcgtcagtgtccgaccccgcgatgagtggtcgggacaatttgcaactagagggtggtcctcatgggtaccctgtggggtgtcgcgcgaggtgaagggccaggccatttccgtcgggtcagcgatttccgccttcgccccgctctcgcctggcctggtcagggcctgttttggtacttgttgcgccgattggagtcatctgcgacttgtttgccctcctctgaactcctgaaagccaggggctccgtctaggtctcctcctagtcttattctcccagctttcgttgttaagacaaattccttacgttcctggccctttacagaccggccctacagaacccacacccccagctccgactttcttctccagattgggtacttcccagggagtaaagggaatctgtagcttttgtggtttgtcctgctgggaaaatttgggggtaagtggtgggccttctctggacgaccacccacaaatctgtgtgcccaaacggagacaggacccagggtctggacatcaggcaaggggtactctgcagtaaacgtggacattggccgtttcgtgggtttgttttcactctgccaagtccttgaggcgtacacttttgtgtcactcatttatcttgaaagaaaaggttaacagcccaacagagtagttcgctttggtatctggagtggtaatcagagtgccagaactggagagaacattgccgtgtacagatgtttgccttttaccagggcactgaaggcataaaacccttagttaatgcttaactgagtgaaccatgaaagtcatgtgactccaaaggtcgactctagaaatgcggcagtccatgtagcactgtgatgtagaaattctatgatatatgggtcagtgttcacaggcagggagagggggagtcttcaacatctttgaattaaaaagcatctggggcaaaaacaaataaatacacacatatcagtgaactgctttaagttcagttagagaaggtgagattaaagaccagaagaaactcgagggagactgctgtataagtcccagttatctttccaaacagacaggttcatcacagcagtgaaggctagtcttcatctcccttcttgtgggattttctacattaatgtgcagatctgcccttggagaatggggcgtgcatgattgggctgtggtttgctggagtttcatcttactgaagttgcagacactgtgggtttctgtgacaatggtttacactgaaagtagcaaagtcaaggcatggtctggtatcagcatgccagaataaaacacacagacagctttttaaaaggtctgtgtccgtcctatctttagcctctcctggttgtaacttgaagtgactttgttgccgtgtttgttttgaccaggccgggacagtatggagagtatctttagatgtgacttatctgggttgcttagcaacagcatgcttcagattagaatggaagaaagttcctggatgtgaggagatttgaatgataaaagatacttacacctaaaaggagaccaggagggattgtgccctgttcttgctaactgggtgctcgtaactggagacggggtgtacctgttagcggtggttagacgaggtggatacagaatccagaatggtcacattgcagccatagggaacagatagatgcagagaagaggcttcagccctctgagttagggcagtgcatggccttgctctgctgaaatagcccagaggtcccatttgcttggtgacatctctcacttgaatagaaagctggctgtttatcagacactgttttcttaaatggcagctcctccacatctgcgtcatctccattatctcccctatccatctctttttggaaggaatccacgaagccctcatgactgtttgtttgtttttgtttttttgttgtcgttgttgttttttggagataggttctcactctgtcgcccaggctagaatgcagtggcgtaatctcggctcaccgcaacctccacctcccaaactcaagtgattctcctgcttcagcctcctgagtagctgggattacagtcatgtgccaccatgcctagctaatttttttgtatttttggtggagacggggttttgccatgttggccaggctggtcttgaactcctgacctcaagtgatccgccgcctcagcctcccaaagttctgggattacaggcgtgagccattgcatccagcccgccctcatggcttttacacctcttttcctggtttgcagaaagcaaggctggggtgtggaccctgcatcgaagctggttctgcttatgtccatgtgaagtgctttcaagtaaaatgctgatctgcaaaaagatgctgaaagtcctttgtctctttctggctaagttcaaatgccgaatttgattcagcaaatagttgtgagtgccttgaagtgcaaagaatgatccaggatcaggactccttccctacatatcattattttgatatgtatgtatgtatatatgtttagtgacggagtcttgctgtatcacccgggctggtctcaaattcctggcctcaagccatcctccaacctcagcctcctcagtcgttggggttacaggagtgagtttgccaggctctatatcattctttttagcatgacctctgataggaggctggcaggacagttcaggacttatcagaagcccaaatatcttacactgctgattaaagagagacctgtgtttgaaaaccaaacgggcatataataggattaacattctgctatgaacactaaggcatttgcgtagtgcttgtgggagtgataggaagggggtctgaaccgggggagccagggctttctgcaggaagtggtttggggtccttgtcaacagtgaatgctgcttaatggagccagagtgcccccctgcggaggtgggcagagaggtgccagtcaccccaaggtgccacagctctaagctgagatggtcagatagagggaagcaaacaagggccactccctagtcccaccttgtcagcagctcagacgggattccccatctctatctcagccagggagaagccatcgcgagaactggctatgagtgcgacagcttagagatgttgcaatgtctcttcaagttaggagtgaaattattatccattttgccccaaaatggactcttaaacccccatacacttggaatagcatgtattttgtgctttgaagccagaaataaacattctaaacaaagatttaaagttgcaatgaagaggaggtggttgtggacagacatgcagaacaaatgtttgagaaatgttccctttgcttccacagaaaaacaaaagaaaggcattttctcgtgtttgacaaaccatgttaaaaaaatattcttggccaggcacaggggcccagcactttgggaggccaagtgggcagatcgcttgagctcacaagttcgagagcggcctgggcaacatagcaaaactccatctctaaaaaaatacagaaattagccaggcatggtggtgcgcatctgtcatcccagctacttgggaaactgaggtgggaggatggcttgagcccaggaggtggaggttgcagtaagttgagatggtgccactgcattccagccggagtgatagagccagaccttatatcaaaaaaaaaaaaaaaaaaacctttcagtgctattttttgtggtatagttactgttattaaaaagcaaatggcatttctctttttttgtttactgtattcctgaaatagggtcgatttggccagcaaagtattgacactggggcccatcttgaaaacaactaactattgaagaaaataatttcattttataaaatagtagttgggtaattctcccttaggtaccaaaaagggctcttttctggaaaatgttaatgcaacaatatttccctcattcctttggtgttcatgggtgttctattgaatgctgttccattcttatttctttctagaagatagctcattctgactcctgctgtaaactgttcagagattattctttccagagtctgttacattcagaatgtcttgctagtctgtcacttgctgcccttctctttctacttagtttcagattactttgcatctcctctggcctcccgtttttaaccttttcattgatgtatacacacagaaaagtgcactgcttgatgagttgacatggcatgaacataacctgtacatccccaacgccagaagacccatgggcccccttaccaggcaagccctcttctattaagaaaagcgtttttcttgttgtaagcacaagaaaccactaatagtaattatactagggatggggcgcatacaggattcggaatttttgctttgtgttgcacatgaattcttactttactatgaacatgggttgctttgacaaatttaaaacaaaggcctgaaaggactccccttactcaagaaaaggaaaatgccttttttaaatgtttttttgaaatggttgtcttaaaatttctaaatattttttaaaattagattttatatagccacgcaaattgttctttaatggttatgtaggaatacaggctgcttggcctcccttgtccacagcctcctctttgtttctttgcgactttgactctgtgtttagaacatttatttccgggatgagtgcacaaaacaccatgctactccaaggcacagagtttcagagtcagcgctgagtctattttagagcaaaatgggtaacactactcataatttgaaaacacactattaaatacccaagctgttgctaactaaaagcagcctgtgaggttattttaatataaaaatgcaagctgaggccgggcccggtggctcatgcctataatcctagcactttgggaggccgaggtaggtggatcacttgagctctggagttagagaccagcctggccaacatggtgaaaccccgtctctacaaaaaaaaaacaaaaattacctgagtgtagtaacttaatgtctgtactgtcagctacttgcggaggctgaggcaggaggattacttgagcccaggaggtggaggttgcagtgagccaagatcgtgccactgcactccagcctgagtgacagagtgagaccctgtgttaaaaaaaaaaaaaaaaaaaaaatgcaagctggcgcggatgcagtggctgagacctgtaatcccagctacttgggaggctgaggtatgaggatcctttgagtccaggagttggagaccagcctggacaacatagggagacccagtctctacttaaaaaaaaaaaaaaaattcaacctagacttggtggcttgtgcctgtaatcctagctatttgggaggctgaggttgagggatcccttgaaccctaaagttcgagaccagcttgggcaacatagtgagatcctgtctcttagagaaagaaatctatgtgtgtgttcgtcattttgacatacaacatcttcacttttttctgacaatgaaaacaacccaaggttattgcaaaaaaaagatccagtaatacagaaacaagtgatacagaatggaaccgtctgctgcaattgctggggcagattcaggcagaaatttggattacttttattttattttattttattttattttgagacagagtctcactctgttgcccaggctggagtgtagtgatgaagtctcggctcactgcaccctccgcctcctgggttcaaacgattctcctgcctcagcctcccaagtagctgggattacagccaccatgcctggctaatttttgcatttttagtagagatggggtttccccatgttggaactcctgacctcaagtgatctgcctgcctcggcctcccaaagtgctgggattacaggtgtgagccaccacgcccagctagatttatatttgatagttatttgattccagaggatcttaagtgcaaacccagagaagcagagagtaaaaagcaaaaaggcaacaaaacccagcagatggtgagggaaagggaagaagccagggaggggcaagtggggacaggaagtgctctgaaacccgaccctctcttgctgggctttctccttttaaactgaggagctgctgtgtccatctcgcccgctgcttcctaggcggtacagagggtttcctgtagccttaagttttctctccgagaacagacagattcttggttgagccttaaacagggtccagtcttgggtgttagtcaagaatgctgttcaagtaaatacgttttactatcatttgactcccatgtgcccccaaacctggtattatttacaggtagttttgttgttgttttgtttttaaaccaaacaggttgacccattcactcaatctgagttaggaaatatattccaggcacaacctatcaggcggttgcctgcaagatcccagctgaaagcatcgctgggacaaaggtgatgctttggcagccaccctgttggctccgtccagcccacacctcagttgtctcaagctgctctttcagtgggaatgtgagatctggtagcagaggctcatttcaccccaattttctatttcagaaaaaggggccgggtgcagtggctcaagcctgtaatctcagtactttgggagtctgaggcgggtggatcatgaggtcaggagattgagaccatcctggctaacagggtgaaaccccgtctctactaaaaatacaaaaagttagccgaatgtggtggcgggcgcctgtagccccagctactcgggaggctgagacaggagaatggcgtgaacccgggaggcggagcttgcagtgagccgaaattttgccactgcactccagcctgggcgacagagcgagactctgtctcaaaaaaaaaaaaaaaaagaaaagaaaaaaggaaactcatccgaagcaagagaggcagccacggggtcccatcttggcagcacatcttctggtccccggtttagcgttctgtccttctcttgggtcatgttcttgtctctgttcttcctcatcccttcttcgtccttgtcatcgccacttctgacactgactgagtggggccacaaaaggtgagtcgtccttccggctgcccccaccacaatccagccctggctcaagagcagggaaggtgctgtcccccaggctgcagacgggggttagtacagcaacctcagacagcttcctctctggggggaccctgcgtgtcttgggtgcagtttcgaggaggatgcagagggatggatccctgccttcttctgtgtgacccctgcggtgggggagcatccctgctcagcccaggggatggcacttttcatgtttgccgtgagattcctctagcaaaagcagtgggttttgtgagtacttaggtaatggtgccagaaagcaccatgacaccctggtatgtccgccccatataatcagagaatctgactctgctcactgctgagaccccgatacccagggtagggcctgaattttcaatgcaattgcgataaattaatgactaaatggattctcagtttgaaatgtaaggcgtgacagaacgttcaacccagggaagattgagtcaggacccgggaccttgccggaacacctgtggccgttgctgctgttaactgaggtgtaattaacatgcagccaagtgcacagcttcacccagcagatccgtacgttttgacaactgtgaaacaagacgtagcacatcgccatcgcgcttctcagctccgccttcaccactctgggtgccagcaccggcaatttgtttggccagttccagagtgtcataaaaacagaatcctccattgtcactcctctgtccttgaagagatatgcatcgagttgtatgcggccactctgcgggctcccctcggcacatgatggtcttcagagagaggctgtttggaaatagagtggtgggtgtttgcttcttgtcacccggcaaatgattcatttttctgctgctctgacactttggaagaagccagggatgctgaggagatggcttgctctcacgtgggcagctgctcctttgagaaacaagccatgcgcagtgttagctgctgacatcctccacttttagcccttgagcccatttcactgatgagcaagacagtggcctgtatctgtcactaacgtgcttttctttttctcccctgttccccaaagacaggagtgtggagttcatgagtgttggatttttcaagctagtaaaccttgcagctgcaagtggtgtttaattcttgtggtatggatgagcacatgctaatctcccttgagcttctcttgagcagaagcctggtgtgctaacgggcaggactggggtggtgctttgagaggaagagggggaaggtggcccgagagggagatctactgagatgtgagctgcctggagtttggggtggggattcctggaggggctctggattttgcagagggacagctgttggtgcaccttcaccagtgtgctgggacagaaagtggggtgagtgggtgagtgaggaataagtgtttgaagggcaggagtaaagcagaaaggtggcagcaggtgttgagctgcaagtggttccattgcctggaaaggaggtggcagggaggcctgcccaagatgggtgcctgcagggtgcggacagcctgtcagaggtgcggaaagcctgacattgaaaatgtcagacagtgggtgcttgggccagagagaaagagcctgaggagctggaccaggggttggggggcggcctttagaagcagcgtctcatgcagccttcccagcgatcctgaggtaggtgggagaatcttcaggccacggctgagaagctgaagcgtgtggcgggagatccgtctcagaacacctgagatccctgcagggtctgggagcatgttaggggctcagagtgcaggtagggactggcagggaggagctgtgggcgggaagagagagaagggagggcagggcagtgtggccatggccagctgaacactgggagtctgctcctgaggtcatggatggaggccaggacacctctcaagccattaagagggtggcctttccaagcgcagcatgacttgttggtcttgaagcagtgccttcgaaggaggaggagtcccccgtggacttggggcattaggacagggactgccaaggagagagggcactaggaaacagggttgtttttggcttttttacctggggtgcaagtggagcaccctgtgggcatcatgagggtgtcaggaaacccttctggtaactgaaacgcagtccattctgtgtcccccagattctgagttttcagcacctgacagtggcgggggatggcagacacacctgtgggtgctggagacatcttggcggcccttcctccagtttggcatcatagtcccctgtgggctgagcacatggggctcctggacagttgttaccgatggagggtatccaggttcttgacatcttgaacaaagaattggacaaaacggcacaaacaaagcaagaaaaagatgaagcaacaaaagcagatttattgaaaacgaaagtacactccatagggtgggagcaggccctggttacagaattttctggggtttaaataccctctagaggtttcccattggttatttggtgcatgccctatgtaaatgaaagtgacctgcgatcagtctgattggttgaggaaagcagccaaccagaggctgaagtgaagttacaaagttacatcctatgcaaatatctgattcattgtggaaagcaaccaatcagaggctgaagtgaaattacaaagttgcactcctatataaatgaagacttggccggagaccagcttgattggttgcaggaggggaccaatcagaggtactttcagttcttgatctgcttggtagaaaagcaggtcggtgtgaagggagtagcctctggttcttttgttacttggggatggaaagttggggttttcctttggatttagttctaagaagtcagcatgaattggccttaggttccctgcctccagaccctattctcctgcctcacagtgatgttgatcagggggctcagcttggctctgccagttcagacaccagccccttccagctactgccagtccttggaggaaagcagtcttggtaccgtgtccggagaggtcatttccatgtaaaagaaatatgaggtctacaggcagctcaggagcacggagttgggggaagcagagaaggtgtgagtgccgaggcgcaagcacggcttttgtttgggtcaagcaggatcagtgcctccctccttgcatcgctccacctccggaaggcggagaactgcgatgcagacccaggaggccagccaggagagatttctcaccccaggctcgagcctttgaagctccaggttctaacttaaaaattcaagggagtggccgggctcggtagctcatgcctgtaatcccagcactttgggaggccaaggcaggtggatcacgaggttagggatcgagaccatcctggccaacattggcctgacaaggccaacaaccttgtctctactacaaatacaaaaattacctggttgtggtggcacatgcctgtaatcccagctacttaggaggctgcggcgtgagaatcgcttgaactcgggaggcagaagttgcagtgagccaagatcttgccactgcactccagcctgggcaacagagccagacaacatctcaaaaaaaaaaaaaaaaattcaagagagtttcgcattctcccgtgcaatacttccctgcttgttgtagtagagatgcgtcctgtgcctttttaggaacatgttctgaaagatggcttgggcaactgtgactttagtgctctatccccccagcactgccctggtacccatcctgtttagagggctcagagcagagagcacctgcctggcagggcccgtctctgactttgccttgctgctcctcccagcactgccctggtacccgtcctgtttagagggctcagagcagagagcacctgcctggcagggcctgtctctgactttgccttgctgctccccccagcactgccctggtacccatcctgtttggagggctcagagcagagagcacctgcctggcggggcctgtctctgactttgccttgctgctccgcacagcactgccctggtacccatcctgtttggagggctcagagcagagagcacctgcctggtggggcctgtctctgactttgccttgctgctccgcactgcactgccctggtacccgtcctgtttggagggctcagagcagagagcacctgcctggcggggcctgtctctgactttgccttgctgctccctgttatcagcactcttgtccctgtgtcctccgggtggcctgcagggcaatggaagatgagtacttagtagaaggttctaggtgggcacatgagggttccttgccagcaccagggctttgttcacacaggtgttgcatgaagccatccagccaagagccagggctccatgcctctgagccctcaggcactgcatcatgctgggcctcagctccatacctgccgcgtgtctgtctcaccatcactgtgctcaaggaaggtcgccaccagatgctcctctgtgcgccgggcctgctggggctgccctggggcctggaaagtgctttaagcaggtcctttgtctcgtgtcaggggatgggctccaaagttagtggttggaactaactttgccatctgctggagggctttgcccctgccatgccttgagcccacacatactccaggggtgactgacacagttggttttgcatcagaattggccattgccacctctgaggggctgggaaatgggtgaccctgccccacagtgcctgcactgcccccagcagacaatgctgggggagcagcttcccaccaggcctggcttggggcttctccagggaagcccaggtacacctcccagcctgtaggtgaaggtgcctggaatggaactcgctattcccagaggcacagagctcccgtcacagcggctgggtgacagcagtaattctcgcagatgttcaggccctgggaccccagaagtgaaatgacccagggcgtcagcaggaaaggaggccccactttttcaggacctctccctccaaccagctccacgtccttcccaaagctgggcccagcgtggccctcatagccagctccgtctctctctccttgggcctgctgtgactgcaggcacggatacactggggagacgggatgtagaaagctgtgggaagagggagcaacggcagggcaggggccagtggggttggggggggccgctggccctgcctttggatcatctccgacttgatcagcatgaacccctgactctagagggaggctgatgggccagggcacatgtgggtccccctcactgcctccgcagcagtggacctacagccatgctctttgaccccatctcttcctttcatgggcacacaggtgacccgagtctctgtttcgtgcaccttcctgcctcttctctgcccctcagttgggctgagacacatgaggtgctgtgatgcatgctgcatttggccctgacttaggtgtgacgcgtttccatttttaaatcgagtgtaaagaactggcctccagaaacacggaagcacttttagtagggatttgaaaatccgcagatcgttgtgtatctcagagcccagtgtttttcttgaaattcacactggaaacaaatgaggatactgggggaaatgtgcagtcccaggacatgagagatgcgagcttattacgaatctgtctttggtaccaagccacaatatagagatttgtgaaaatctttaaaaatcaacttgactgggccgggcgcggtgctcacacctgtaatcccagcgctttgggagggcaaggcaggcggatcatgaggtcaggagatcgagaccatcctggctaacaaggtgaaaccccatctctactaaaaataccaaaaaaattagccaggtgtggtagcaggcccctgtggtctcagctactcgggaggctgaggcaggagaatggcgtgaacccgggaggcggagcttgcagtgaaccgagatcgcgccagtgcactccagccttggggggcagagcaagactccatctcaaaaaataataataataaaaagatctggaacgttttcgtcccctcaggaagtcatccctgccccaggcatccacggaggtcaaggccttgccaaccccacttcctgggtccagctctcaggtggttctccctgtggcctccagacccgggctgtaccggctggtttcgcaggttgcctgtgctcatcctgccctctccggtgagagctgagccggtggtgtttttttcagagccagctggccctgcaggagctcagaaacctgggcggctgggcctatgggctctggagttctgcccagggtggccaggtgggcagcctttcccccgtgctggttcctgtagcaaggaggaggccgtgtgctggggcccttgtgtcaggagctgtctctggaaaggctgaatcgaggaaccagcctctgccttgtccgtcgatgttgtggggttagtggctttgtcccagagtttcaaagtgtgggtaagtggtttctgggtttgccagttttcttagcccttaggggaaagggggtgggagcctgccctcagctggcttcgtaaaaacacagtatctgtgcttgagttacacgcccggcgtccttttgcgttttgagacctcagtggagtgtgcgggccctgagtagtatgcacccactgacagtgaaccagatgctgcccccctgcggttccagtgtatgtcagtgccagccacgtgcccaggacccaccgttcccagggatacaagatcccgtggcccatggtggcagctgcggcacacagcgctgctttccagagctctcagtgcggacaacagaggccttgcattcagtcacctggaaaacccaccatccacattggaaacccagtctctccggaatgagaaatttggttggttttctttagctttttgtttttttgtttgttttgtttattttttgagacagaatctcactctatcgcccacgctggagtgcagtggcacaatcttggctcactgcaaccttggctcactgcaacctctgccgcccaagttcaagcaattctgttgcctcagcctcctaagtaactgggattacaggtgcctgccactgcgcccagctaatttttttgtatttttagtagagacagggtttcaccatcttggccaggctggtcttgaactcctgacctcatgatcggcctgccttggcctcccaaagtgctgggattacaggcatgagccaccgctcctggccctggttggttttaattaagaacattttcaaacatccacgtggcatacccgttatccagatctaacgcccattaatattttgccacttttttgctccaactaaattaaactaaattctggaacattctgtcattttgcccctgcatattccactgtgcatctgttaatataaaatatggactttttgtacataaccacaagactcttctcacacctgacaagattaacaccttcatctgttcttttagaggttttgttcctttgtgtgttctttgtcatctgttttgttttgttttgttttgtttcgtttcatttcgtttttgagtcagaatctcaccacgtcacccaggctggaatgcaatgacaccatctcagctcactgcaacctctgccacccgggttcaagcgattcttgaacctcagcctcctgagtggctgggatgacaggcacaccaccacgcctggctaatgtttgtatttttagtagagatggggtgtgttagtccattttcatgctgctgataaagacacaccagagactgggtaatttataaaggaaccaggtttaatggactcacggttgtacatggctggggaggcctcacaatcatggcagaaggcaaaagtcacgtcttacatggtggcaggcaagagagaatgagagccaagcaaaaagggaaaccccttataaaaccatcaggtctcgtgggacttattcactaccacaagaacagtatgggcgaaactgctcccatgactcagttatctcccaccaggtccctcccagaacatgtgggaattttgggagctacaattcaagatgagatttggggagggacagagccaaaccatatcatagtgtttcaccatgttggtcaggctggtctcaaactcctgacctcaagcagtccacctgcctggacctcccaaagtgctaggattacaggtgcgagccaccatgcttggccccagctttttgttgttgttgttgttgttgttgttgttgttgttgttgttttttgagatggagtcttgcactgttgcccagcctggagtgcagtggtgcgatcttggctcactgcaacctctgcttcttgggttcaagtgattcttccacctcagcctcctgagtagccgggattataggcacctgccatcatgcctggctaatttttatatttttgtagagacagggttttatcatgttggccaggctggtcttgaactactgacctcaggtgatccaccagccttggccttccaaagtgctcatattacaggcatgagccaccattcccggcctatttttaaagggtctggagtcaacagtgcatggatccagaaccgtgggaacaaaggggtgggcacaagggcggggtggggggtgtgagtttagagaggcttctccctataaagctgagcatgaactacttggcacacctgacgttgaaccaggagctgagaaccacacaagttaggagtcagagcagagctgctcaggacgtcagtgctggccctgtcccaggtcaaggggataccccgggaagtggctggactgagccaagtatcagctagtagtgggtgctcaaggctggtgtagaggggcaccgcctccctgccagcactgtcctgacacttggaccccatcagctcgttccagcagagaaccaccctggggaggggcctagctatctccactccgcagagaaggctccaggaatctgattaactaaggctgagccagcagagagaccagattcagcgtctaaattcctccccttgtcaggaaagggaaggttgtgcagaaacctggacagtggacgccgcgggcacttcccacccatggcagcaggagggcgggagctcagagaggctgggctcgccctgccagtggagtggggactgccagataaaagacgaggtctttcctgggcagtgagtgagtcctgggggcccaggggcttgcctccacaccttgcacctgcccccagcagctttcagctgcggatttcacggcctttcctgattgttgtttgactccgtcatttctgttggtgattccaaaatggtgactttctaattcagtcattatttctacttttattagctggcattcttctgtaaagaactttcctcaacgctgagatgaactacgcagttcctcctaaaaaaggaggatgaatgcagcatcttttcccatttatttatgggtttgtttatttatttatttttagagacagggtcttgctatgttgcccaggctgatctcaaactcctgggttcaggcgatcctcccacctcagccttccaaagtgctgggattacaggcatgagccaccacacccagccttccatcctttccttttttttttttttgagatggagtctcactctgttgcccaggctggagtgcagtggcgcagtcttggctcactgcagcctccacctcccgggttcaagcgattctcctgcctcagcctccacagtaactgggattacagttgcccgccaccaagcctggttaatttttgtattttttgtagagacagggttttgccatgttggccaggctggtcctgaactcctgacctcaggcagtccacccaccttggcctcgcaaagtgctgggattacaggcgtgagccatcacaccaggccccatcctttccttttaacgactaatttccaacttaaagaaccaaggcttctgttttccccttctcggtgcccagcacttggccggccagccttcctccctccattcctctcttcctttctatacaaacttccttgttaaataaaacaggggggctgctcctcccgcccctggattggatgcactttcctgatttaaaggagtccttggccactcgtgaccccgacttgaactgtggtgtcccccaaagtctctttctttccgcccaggagtgttcacttgctgggcggggaggagaaattggggtgtgacccactcagcacaaacccacgccctggtcataaagccgcaccatttcccctgcaaatccagccgttcactgccccggccaccgggctgctttgaagggggatgaggcatgggggctgctgaacccacaactgtcactggcagccactggctggagttgagagaagtcaggctggctggggccgttgaccctcggaaggaccactgtcataagatgtgagaccagtcaggggcagctcagatggggagagaggctggccagggcttccttcagctggggctgagcagtggagggcctggttccccatcctgcctgccctcctgggcctgggtcttcccagcgatgggggcgactgcagcgcctcttgggagggcgatcgtgagaggcagaggcctctgagtgctggctgaggggtgtccacccgtgggacatgctccgtgctcttctgtctcgcctgcctcacaagctgagcatgaggaagaccaggctgtgaggtgacgcgtcccccccacccttccccacaggtgtgaatgacagaggtggtgccatccagcgcgctcagcgaggtcagcctgcgcctcctctgccacgatgacatagacactgtgaagcacctgtgtggcgactggttccccatcgagtaagtggagcggattgcagggttggggagagcccgtgagcctcaggtgcagaagctgggcggcgggggtgggggcctcttgggcccttaggaccgtgctgcaaagatgggaatggcctggaggggccacaggggtcccaggttacccacctcatctagggacccctgctgctgggctctttccacctctcagggtgtgcagagttccccagaagggctctgtgagaaatttcagttacagagctatcgggtgtggtgctatttataattcagaaaatttagaagccactcaagtatcttcacagcaaggagttggttacatgcattagagtaattagagtatgtgcatataaaagtgcaatattattcagccgggaaaaaaaaacctgtcaaagagttatattttttgatagagaaatcttttttacaagatattaaaggagcctgtaatcccagcagtttgggaggccaaggagggcagatcacctgaggtcaggagttcaagaccagcctgaccaacatggagaaaccccgtctctactaaaaatacaaaattagccaggtgtggtggtgcgtgcctgtaatcctagctacttgggagactgaggcaggagaatcacttgaacccaggcggtggaggttgcggtgagccgagattgcgccattgcactccagcctgggcaacaagagcgatattccgtttcaaaaaaaagaaagaaagatattaaaggaaaaaagtcagtctagaaaatagtatgtaccacgatcctatttttatttgaaaacatgtacaagataaaattttataatgataggtatgaactgagcgggggtgaaaaaaattttacaagggggtatgtaccatttaacagtgtttcagtatttgaggtgggtagattaatattaggccctatgattgtttcttcttgtctgtcttgcctacaatatatgcacatacagcttttttgatgaaaaaagttgacacaaactttgaaaatggaaaataaacaagatcttgccagccaccagcatttccttgagtgttcacctcagactgactgaacctcatgctcttggcagggcggtggcagggacccctgtgcgtctttgtggaagcgggaactgtcacagtccaggtgatgtgggctggcggtggcaacatgagttaaaaaactgttcttggctgggcgcagtggctcacgcctgtaatcccagcactttgggaggccaaggtgggtggatcacctgaggtcaggagttcgagaccagcctggccaacatggtgaaacctcatctctattaaaaatacaaaaattgggccgggcgcagtggctcacgcctgtaatcccagcactttgggaggccaaggcaggcctgaggtcaggagttcgagaccagcctggccaacatggtgaaacctcatctctattaaaaatacaaaaattgggccgggcgcagtggctcacgcctgtaatcccagcactttgggaggccgaggcgggtggatcacgaagtcaggagttcaagaccagcctgtccaaggtggtgaaaccccgtctctactaaaaatacaaaaaaattatctgggcatggtgcaggcacctgtaatcccagctactcgggaggctgaggcaggagaatcgcttgaacccaggtggcagaagttgcagtgagccaagattgtggcactgcaccccaacctgagcgacagtgagactctgtctcaaaataataataataataataataataaataggcctggtggcacgcacctgtaaccccagctactcgggaggctgaggcaggagaatcacttgaacccgcgagtcagaggttgcagtgagctgagatcacaacactgaactccagtctgggtgacagagtgagactccatctcaaaataaaaataaaaacgtgttcttcagcccagcaatttaactgctggaaactaatctagagaaataaaagctgcagtgagtgcatagatcagactctgcccagggttgcctgagagccagtggagccacgctggaccgtgggccttggccatgtgagccacccagcctgcctgtctctcctgcagttctcgtgggcctaaggtctcaggttcccaagactgtgacatgaaccgggctgtgaggcagcaaaactaaccctacacaccctagaaactccatgtgcctctgtcctcctgaccttgtctctctggggctggggctggattcgcctgttaatgaccatgtcctgggcctttatgcccactgttttttttgcctgctccgctcagaggggtcttggcctcattgttgatgagcagccgttagcagcctcagcctcacattccccttaagggcgggttcctccctgtcagggaaggcattgtaaactcaaacgcctgtcagctgtgaacctggctcttcctggaatcactccactcccctagtcttcagtgtccagaagtctcacagattctcgtaggcactcctccagtgtccaagggtgagaagggccctaaaatcttcactcacctggtggaggaacagggccctgctgctgactctccatgagttgcttccatggagacagtttcatgtcggataaaattatttttcccgggccaggcgcggtggctcacacctgtaatcccagtactttgggaggccaagacgggcagatcacatgaggtcaggagtttgagaccagcctgaccaacatggagaaaccccatctctacttaaaaaaaaatacaaaattagccgggcgtggtggcacatacctgtaatcccagctactcgggagaccgaagcaggagaatcgattgaacccaggaggcaacggttgcagtgagccgagatcacgccattgcactccagcctgggcaacaagagcaaaactccgtctcaaaagaaaaaaattcccatcagagatccccagtcctgtctagacagatcactgctttaagaaggtggctgtgacagttaggtagagacttaagtgatgggcacactcctcggcagccttagagcagcaggcagaagtggcccagagctccctgtggttctgatgtctagagcacgaccatagttggacttgacctgtggcaggttcacctgagtatgttctgtttctcaggtacccagactcatggtatcgtgatatcacatccaacaagaagttcttttcccttgctgcaacctacagaggtgccattgtgggaatgatagtagctgaaattaagaacaggaccaaaatacataaagaggtacgtacgtgtgtgcagtgaggacttggcagtcactgtcattggacgggccaagggggcttgcgatggaatcatgctgcctgctccacagccgtcgtccaaggagcctgtgacccaaggaatccaagtggccaacgacacttgtccctggctggtgcttttctgtgtgtgtgtgtgtgtgatttcatggtgcgtgggcctccagtcgtgcccagcagcaggcttcataaccactgtcgttctgaagcaggcatgagcgcagatgatgcattgagaatctgcagttacaacgtgctatgaaaatacccctgatttgtgttggcggcagtgtcatagaaaccgctaagactgcttcagcttgttgaaggaaatgctagttacagttagaggtcagggaaagtacagagataattttttttcctctaacttcacagagccctttaagatctaagaaccctttgggcatccgtggacccacctcagtctcacttcaggctagcaaaccccagtctgaatgtaaacagtaagaccatggccatattgttccaaatggttgagtttagtcaagattctgtgtgatgatgttggtcatcccagcatctgaggtaatgtttaccacccgaggatttagccaaggagggaaaaacccaccaacaactggcagatggttcaatttgtttggcttgaggttatttctttaaaagttagagaaggggccgggcgcagtggctcatgcctgtaatctcagcactttgggaggccgaggcgggcagatcatctgaggtcaggagttcaagaccagcctggccaacatggtgaaaccccatctctactaaaaatacaaaaattagccgggcgtggtggcaggcgcctataatcccagctatttgggaggctgaggcaggagaatcgcttgaacccacgaggcagaggttgcagtgagccgagatcgtgccattgcactccagcccgagggacaaaagcaagacttcgtctaaaaaaaaaaaaaaagaagaagaagaaaagttagagaaggcctgggcacagtggctcacacctataaccccggcattttgggcagatcacgaggtcaggagttcgagaccagcctggccaacatcgtgaaaccttgtctctactaaaagtaaaaaataaattagccaggcatgatggcgcttgcctttaatcccagctactcaggaggctgaggcacaagaatcacttgaacccaggaggcagtggaggttgcagtgagcggagattgcacttttgcactccagcctgggtgacagagtgagactctgtctataaataagtaaataaaagtgcaagaaggcctgtctctccctttaaggacccgaatccactggcatctaccctgttttgcctgtggtcatactctgtctggcacagcttttttctcctgagtcactttttctgccctagcttcctcctgagcttttttctttgatttttaagagctaagatgtagcagaaagcaagtgtcaacattcttttctctcctcttttttttttattgaaacggagtctcactatcacccagggtggagtgcagtgatgcgatcctgatcccggctcactgcaacctccgcctctcaagtaggattttagacgtgcgccaccacaccaagctaatttttgtatttttagtggagatggggtttcaccatgttggccatgctgatctggaatccctggcctcaagtgatccgcctgcctcgcgggagtgctaggattacaggtgtgagccaccgtgcccagcctgatctctcttgttaatgggacacgtggtcccccccttcccccaatgactcattcccctgaaccccatccccctccgggtggctttcctgagtgccccctggtgactgtgtgcctgcccccaggtggcggctgggtctcttcctcctctggaatgtgtttgtgttccctcgaggccgacatggggaccctttggctcatgttcccggctctcagtagagggccctctggcctgcacgctggcactcattcatctggccccttcctctcaggcttagtgagttcaaggtcagggcaaagtagaccctgttaagagatgtcagctggggaacagacacccttcctgcaggcctggagtaacaagagtgataaggacgccttcctccctggactgacatatctgggtgaactgtggcttgaagagggctgggagagcagggagcctggacaggctgaccccagcccagcacgtgggagcagaaaggccttcttgttctttacgagttggaagatgataagagcctcatgctgatcagattcatgactcccacccggaattccatctctagaaccaagagatggtgggtggctttacgcaggtgtggcggtgtcctctgcctgtgggggcagcagaaggggttggacggccgcccaagtctcactcctccaagatcacctggggcagcgtgcgattctttaactgaacctctaaaactttgcatttgtccactgtcctgcatccaggcctaccaggtgacatgcgtgcattcccatgaggcccgcgtggtgctgtgtagttgctgccttcatgccataactttaccttgtgctggcatcagagcctcattcccgtccttggctaggcctcccacacacccctaggagaagctccttttgtgtgtgttcttcttttcagctgtttttcaccagaagggcataaacgctctcatttccttggggagtgggggcccctctccagtacctcttgattctgcccctcccagtcggtgtccctctggctgtcgtgggaagtcggtgcggagcccgcctgggccgggctgtgcagtgagccgtgcaccagacgtgtgagcctgactttctctctgactcttcctctaggatggagatattctagcatccaacttctctgttgacacacaagtcgcgtacatcctaagtctgggcgtcgtgaaagagttcaggaagcacggcataggtaagggcagccgggcccgcggcttggcgcccaccccacccccttgccctaccccacccccatcccatctgcacccagtctcttccctggccccaacaactctggctcgtgaacatccctcagtctcatcttccatcctcgttcccgtcttgggccagaccttcatcatccctcccctgccagcacacccaccaccttcagccatcctctttccacatgcccccaggcctttctgctgcagcctcgctcagcccccaggatggagctgaggaaactggcacctctcacttctgctgccgccacacgcacaactcgtgtattcactgctcacgattcagagtagaaagcgtgaacacgcacgaggaagcaacactcaccgtttctccgatgtcccaccccactcggccacacggccagtgagcggcagagtcttaattaattttaaacccaggcccatctagtccatgttttcctgggctcacatttaccctgtttgttgtctgaaagggagtctccatgcgggcccagcccatgggagggcgctaccaggccacctctgcagtccctcccagcagtctgtagctaccaggctccatctggccatgagattttagggactttgacagtggtggtgaagaaaggctggtctctgatacggtgggccgagacatctccgagagactcatgcaaagcccccatcctagcccagtcatccttccttcctaactgctctgcctgcattacctttacctcttctccccaaggttccctcttacttgaaagtttaaaggatcacatatcaaccaccgcccaggaccactgcaaagccatttacctgcatgtcctcaccaccaacaacacagcaataaacttctatgaaaacagagacttcaagcagcaccactatctcccctattactactccattcgaggggtcctcaaagatggcttcacctatgtcctctacatcaacggcggccaccctccctggacgattttatatccttaacttctgggggagagggactgtggcttcctgtccataaggtggcagagccagtgagcaagttggagctgtggtccccctcagatgatgttcaggtggccaagcttatggatgcttctctcccttacctgatcgtgttgtgggtaaacctgacacacatttgggtaaatcgagttgcacatattaccatgttgcccaggctggtctcgaactcctaagctcaaatgatccgcctgccgcagcctcccaaattactgggattataggcatgagccctgcacccagctggagagcctcctgctccacttgcactggggatcagcagtgcacaaaacggacaggatcccctgtcctcccagagcctgtgctagcagaggggaaacaagtgcggagagaagagatttttactttttttgaatacttgggttcaaaccttccttataggatgcatgacccaaaggtatgcccttccctgcttcttcctccttaactttcactggcccctgacaggtcagagggaagccaggaaactttataatagtcagaatgtggcccaaaaaaatgctgtgcgtgtgtgtgtgtgttttcaaattcatgagtctaggatttattcattacatagaataataagcaggaaagagaggggtgaccccacactccacaggccgtctagcttatgtgaagacaggcatccagggggtcagcactgttgaccccctccttgtcatatggacagggctctgtccctcttgctgccacaaaggttgagaatctagggagaaccagaagcacctgcccttctgccaggccccttccccaccccccgtgcatccctgggtgtggtgtccacatgcctgctgcctcactcagaaggcccttctgtccccagaccccaccctctgttgttttgcacagcagaggccacttcgtctcatgagcctttccagctctgcagaggcttagcgggctctcagcctccgaagcctggcttgccatctgcacacagtcccacaggccactgcgcgggcccctgatgactgtgccctggcgagcgtggtcagggcaagtcggaatcttccttaacagagccccacggactacatccagcacctgggctctgcactagccagcctgagcccctgctccattccgcacagagtctaccgccaggcccacagcctgctctgcagcttcctgccatggtcgggcatctcttccaagagtggcatcgagtacagccggaccatgtgatgtcggctgggcagccgccaccaggccccacccttcggccgcccgcagagcccgccttcctgtccatctgaccccttctgttttctgcaaggagctgccagccatctaactgggctcgtcggcctgccccagctgcaggcccggtgctacacgggctcgggaacagaacatcgtgggcatgcgcagagcatgcccatccgtggcaggtacgccacagcagacacaaaggtatgggagcttggtgcctccagccacaaaagtggaaggccctggatgggcacagagaacggcagagccggaaggggccgtggggactgcagagtccaccaccttatgcaccagcacagcccagaggtttggtgacttgtgccaagctaacacagcaggctccatggcaactgggctgtgcacccgactttggatccatcagtgcctttatttgtgtggggaccgagaggcgcctagtggctgcaggcagacaccatggcctggagaagggctcatgctcctggagcacccaggcccagctgtgtggcccataggcagggtgtggggtgggcagagtgtctccgccgggccttcaccctgccctgctcttctctttcccacaggctcttcagctcccctccctgcttctggaaacctctgcctgctgccctggccctgcccccctgcgcatgcaccgtccccagggctgacccagtgtggctgcattcactgggaggggcctgccctcactgggcctctcccactccgctgcctgttcttgcagctccttcctggaaagctggaggggactttctcctgcaagggaggaacgcaagtattatggacacacttgaccgtaaaggcacaggagcctcggaacaagggggcgcaataaagggaatggcccgtccccttccagaaccagcccaaagaagcctggggggtgaggagtggcccccactcctccatgaggggctgatgaggggtgggcagcctgggggaggctttcctcgcaagcacagagctctgaggctcagccccctggcacaggcggtcacgcatcaggacggttcctactcctcagcaccttccgtgcagttaccagtgccctgggaggtcacactgcccgtcggaccttggcatgctccattcagctgacctgctgaggacaggcatcgccgagactccttgggtcctccccgccctccctcatgctgccacaagctgctgctccaaggcctggccacatgcagacaggaggaagctgagctcgacattaggcctcaaggctgccatctgtcttgtagggcctggccttgtgggcagggggcagtcctgtgccttgtgggccctcagcctctgagggcagagatgctgtcagtgccgcaggtgcatcacatacttctagcatcctctccaccctgcattccaaatgctgcttgctgcctgccctgccctccgatgcaggggtggggtggggggcggagtcccgcccagcatagctgcagtgtcacaaagccatggcagagggtcctagcggcgccaccctgccccagcctgaggaggagggagagggaggaacaaccctgggcagacggggcctcagggacctgtgtccttccgcctccagagctgcccagccacgggctctcagggtgctggggcagccccaggtcccctcttgaactcagctggggccaggggccctcagaatgaaggcaggcaccaggcaggagcagcatccccctccttgacggtgctggcaggagggccgcgccatgctgactgcttgaacctctgctgacctgacagtgctggcgggagggccgcaccatgctgactgcctgaatctctgctgaggctgcctgcctgccgggcccagctcagcgccctctccactgcgaatcagtggcgatcatgtgatttctatttctgccccacagggtaagggacgagtcttctggaaggctctgccatggacatttgtcctcgggctcagaggccccaccctgccccacacctgcccctgatcactgcagtgtccagcccagtgttgaacagattgtagcgttctgtctcattacgagcaaataaatagactttcattggagttcgtcacatcctgtttcccgcacccgcctggctgcacctcgggcctcaccctgtagctgaagttggcctcgagctacttgtcactggcaaggcccaaggatggcttccagataaaggggacagtggttttgtgtgattaaccctgtcagagaatgaggacctttggccaggcacggtggctcacgcctgtaattctagcactttgggaggccgaagtgggcggatcacgaggtcagatcgagaccagcctggccaacatggtgaaacctcatctctactaaaatacaaaaattagccgggcgtggtggtgtgcacgtgtagccccagctactcgggagcctgaggcaggagagcttgaacccaggaggcggaggttacagtgagctgagatggcgccattgcactccagcctggtgacagagcgagactccagaaaaagaatgtgaaactggggaagaggttctagagttgagaagcacattaggtccttttttcactggaaggtccccagcagctgccctgtctgggcatctccctggctgtaggccttgagctggggcccagtccaggcaggcggctccaagggtgatttggtgcaccctgctgtggagcctgaggtgcgtgcccacccagcacagacctggtgcttccgtcagcctctcatggaaacttctggtcaccctcaagggatgatattgttcctcttagagatgaggagaactggctcgggggctgggagttaccaaggagccacagtttgtgagtgttgggcccaggcctgggccactctgaagcctgcgtggctgctctgttacaccattcctgtgcctttgacctcatccagtggccgggagacatgcaacttgccgagggtcctcccaggagagggtctgaagcatctgcaagatggagtaggggtggacgctggtgccctgggaggccaggcagctgggcgcgctggacccatgtccaaagccatggggtgagtgaaaccagattaacccgctgagcttgcccacgggagcgtctgctggggagacacagtcttggttactccagcaaggacagttgcacctttgctgatgagtcagcttgcggttaagagggtaactctttggggcccttggtcaatcgtgtgaccagttagtaacttgcccaggtggggctgcggctcctcaggccctgcttcagtgaggccaggcaggactgccactgctccaggcctctcaccatagccccaccggaccgcagagctgggacacaaacgctcgtgctccactggggggcagaaagggagtgtgggacccagggagaggtaggacacacacaggatgcacctggacatagcacggaggccagccctgaacggagctggctctgccccaggcctgctcaggggtggagcccgaggcagccttgggtctccccgctccctgcacacaccacccaaggatctcctatagggtaggggtccttcatactttcaggacggagacagactcctggtcttccattcctagcccaccggcgttcagggactcacggggtaaggggcgtgcccagggatggtcagtgtattttcttttttttttttttttttgagatggaatctcattctgtttgcactccagcctgggtaacagagtgagatcttggctcactgccagcttggcctcccgggttcacgccattctcctgtctcagcctcccgagtagctggtacaacaggcgcctgccaccatgcccggctatttttttgtatttttagtagagacggggtttcaccatgttagccaggatggtctcgatctcctgaccgcgtgatccgcccgcctcggcctcccaaagtgctgggattacaggcatgagccaccgcgtccggctgaggtcaatgtgtattttcatgagcgtccgcttgctcaggccaagtgctgctttctccacatcgactcccaccccagcgtgccatgattgtggcttttttgcctctcagtctgttggagtgcttctcaaaaaggctttgggaggttttgcgggagggactgtctagaggccaatttagggccagttttctttggggccagcatgtggctgcagcagatgtcctctcgggtaagatcctggctacagctgtctgtggctgagttacagactgtctttttttttttttttttttttttttttttttttgaaacggaacctgctctctcccccaaactggcgtccagtggcgtgatctcggctcactgcaagctccgcctcccgggttcacaccattctcccgcctcagcctctggagtagctgggactacaggggcccgccaccatgcctggctaattttttttgtatttttagtagagatggggtttcaccgtgttagccaggatggtctcgatctcctgacctcgtgatctgcccacctcggcctcccaaagtgctgggattacaggcatgagccaccgtgcctgccggagtaacagactgtcttaaagcttcacagcctaagcaggggccattctgtttgcttccaattccagctgggacaggagtcagcagggactccatgtggtattagccaggcaggctggcggggctggaggacctgtgtgaaagatggccctacccacagggctgcccacagtgagctcagcagtggccatgggcttggctccttccttccatggcttcctcaggctaggctggttttgcaccataccacagtcccagggtagactccttacggggccactgacctcctgggaagctgccaggcttccttactgcccagaagtgacaccccgccacttctgccacattctactggtaaagcaggatctggagcctgtcccaattcaaggggagggggctacacaggggccagaacacgaagacacgtggctcatccggggtagcagaagggccactgaccatagcctgggacccccccccccacccacccaaaatctggagcctggggcaacctgtgctcctctctgagcctccactctttgttcagaagtgagtggagtccaggtgcggtggctgatgcctgtaatcccagtacttcaggaggccaaggtgggaggatctcttaagctcaggggttcaagaccagcctgggaaacatagtgagaccctcatctcttaaaaaaatagaaaatcggccaggcgcggtggctcacactggtaatcccaacactttgggaggccgaggagggcagatcacgaggtcaggagatcgagaccattctgcctaacacggtgaaaccccatctctattaaaaatacaaaaaattagccgggcgtggtggcgggcgcctgtagtcccagctactcaggaggctgaggcaggacaatggtgaacccaggaggcggaggttgcagtgagccgagatcatgccactgcactcctgcctgggcgacagagcaagactccgtctcaaaaaaaaaaaaaaaaaaaaaaaaaaaaaaaaaaagctgggcatggtggtggcccacgcctgtagtctctgctactcaggaggctgagatggtagggtcacttggctcaggagctcaaggctgcagtgagctatgattgttaaacatagggcccagcgtggagcctcacctataatcccagcactttaggaggtggaggcgggagcattgcttgaggctgggagttggagaccaggggcaacatagcaagaccctttctctaccaaaaaaaagtttgtaattagctggacatggtggcaactgcctttggttccagctactcaggaggctgaggcaggaagatcacttgaggccaggagttcaaggctgcagtgagttaagatcatgctactgcactccaggctgggagacagtgagacactgtctcaaaaaaaagaaaaggggaaaaaaagtggattaggcccctaacggtctccaagctccaaggactttgtattgctggcctctgtgcggcctcagttatgcccagcgtccgcagctggtggctggtgcaggcgtccttccatgtttactcagcagcctccctaatgtcagtctttaagtggtctcttggatccacctggcctctgcgtctctggggaatgagtgttgtgggagagagagaaggcagctgcccctccgccaccccatgtgactcatcagtggacctcaggcccgctgcatcccacccacacctgccccatcacagctgctcttgggtgcagcatgtaaacacctgctctctcagagctccccctcctggggaccgctacagccttgggtgtcccccaccccgggccatgcctgcatacttagaacaacccataaaaccacccaaggactgaagtctccaggatctgctgtcccagggacacaagaactgtccagggtgggtacaggagaagggaaggagcctggctgtcctgggcacgtcacatgcgacctggcaggagcccaaagcaggggtggcgctgagccctagcctgacccgggctgcaccggctggagtgaccagacgggaaggtcactgaggcaaacccaggtgctcccgtcttcttcccataggatggagacctggtggaatagaacaagtgtgttagtccgtcttgacactgcttcctgagactgggttatttataaacaaaagaggtttaattgattcagcgttccaggtgtctgggaggcctcaggaaacttacaatcaccatggaaggcaaaggggaagcaggcaccttcttggcaaggcggcaggacagagagagagagaggcggtggtggggaggaagggtggaactgccaaacacattttattatttttttctttttttgagacaagagtctcactctatcacccaggctggagtgcagtggcacaatctcggctcactgcaagctctgcctcccgggttcatgccattctcctgcctcagcctcctgagtagctgggactacaggcagctgccaccatgcccggctaatttttgtatttttagtacagacagtgtttcaccgtgttagccaggatggtcttgatctcctgaccttgtgatccgcccgcctcagcctcccaaagtgttggcattacaggcgtgagccactgcacctggcccaccgccaaacacttttaaaccatcagatcttgtgataactcactatcatgagagcagcatggcggaaccccccaccccccaccccatgatccaatcacctcccatgagaaccctccctcaacacatggggattacaattggagatgaaatttgggtggggacacagcctaactgtatcagcaggcttctcatccacagtaacagtgctcccgagggacaccggacaatgtctggagacacttgctgtcacagcttagaggagggtgctacagataccaagtgggtggtggccagagatgctgcttaacatcctacatgcacaggacagcctccatcccaaagaaagatcccatcccaaacatcaacagagtcgagtggagacaccccggcacagaggaagcccacacctgggtgcgcagagtctggtccggctgggaggagaagggctgtgctcatcctgcccagagggacctgggagctggggtcccgcggagcagtgacctcacctggtagggggcaggtggggccgaggtccacatccctgcctctgctgctgtcctccctggtgccctccctgaccccgccctgccttccttcatccgctgcgccctccacccacaatgccatggcctgcatttaggatcctcctgaggcaggaggatcacttgagctcaggagtttgagaccagcctgggcaacagcaggaccccctccccccaactcttaaaacaacagaaaattaggccgggcacggcggctcacgcctgtaatcccagcactttgggaggctgaggtcaggagatggagatcatcttggctaacacggtgaaaccccgtctctactaaaaaaatacaaataaattagccgggcgcggtggcgggcgcctatagtcccagctactcgggaggctgaggcaggagaatggcgtgaacctgggagttggagcttgaagtgagccgagattgcaccactgcactccagcctgggccacagagcaagactccgtctcaaaaaaaaaaaaaaaaaaaagacagtctgtaactcagccacagacagccgtagccaggatctcacccctgagaaggacatctgctgcagccacatgctggccccaaagaaaactggctctaaattggcctctagacagttctagactgcatctcaaaaaaaaaaagaaaagaaaattagccaggcatggtggctgaaaaggtgggctgttgagcccctacccaccctatggagccaagctcagcagtgtctcatccaggaagctctcacagacaagtatggtgttcccacaggcccttgccctagctcacgcctctcatgccctggcaactaagagtgggggcgcggcagacccatccctggagagacacaggactgtttttctcaccaaactggcctgatgacagacaggcagatggacaagaacgtgcaggccttggcttttattgagatcagagctgtgggctccccggcctctcagggaggcggtggcgggggggcctgattctgcactcagcccggcctcccaggtacaagtggctgactggagtctaagcaggctgcaagggcacggccatgcttctattgcttctgcccctccctcggaacctcctcctcctccctctccccatcacattctcccgaggcccaggcctgggcgctgggccgctgcctgggccaccccatgtggcagggccactgccgggggccgagcccctcctgctcaggctgcctcctcggccatcctgcccctcctgtacccagtcctggcactcgggatccctatggcctctccagggccccagagcgggttctcttgcacaagggacacatggcctcttcccaggtcccccaggacctcttgggcctgagcctagaaggactaggctgggggagggcacccttgtctgggtccatgctggaactggaagctgaggaaagaggagagaaaggagtcacttgagggacccaaggggaggctgggggggaggctggcagcccaccctggggtttccagaatccgatattcttgaaaacagaagggaggagggcaatgcttcctccttaacagaatccccaggggagggaggaggttgagggaacagaatggttcaagctggaaggaccctcatctaacctgaaccctcattttacaagtgagaaaactgaggcccagcaagggagacagattccaaggcccctcaccgagtgtggagctggggcagtcacccagccctccctcccagatcctccctttttctcgcaccgctttgtccctggtggattctccagaccccgcttagctgtgcgtgatgcagagatggggacagattcatcaagatcttggccttctggggcatggtgccactgtggaggcttgggagtggagaagggcccgcctgaggccccagcccaaccatcccctagggtcttcccccgtgcccagtcctgccttgacagagctcaccactgcttcccaggctgtccctgggcaatcgggcttccagaagggctgaacagaggctgttacgtgggcccagagtcccctgtggcaggtccagggcccaggctgtgccctcaggctgtggcaggcagcccccagccataagccggcccagccagtggctctcacactggccagtgggtggcgggtggctctccaggtagaggcccaggccccggaggtggcgcagccggaagttcttgggcttgcttccctgggcactggggcactgcggctgcggggaccccaggcccccctcgtagatgttggggggtgcgtcagggtggccggggcgtccttgggcctggctcactgcatctgcagaggagacagcgggagggtggtggccagccccccacagcagccatgaggggagggtgcagtcacatacctctgagaccagctcacatgatgggctacacccccagccaacctggcctcagtttacctgtgtgtcaaatagtctcagtccactgcctcccctgcccatgcccaagacacgactcctcttcccactcccaaccaacagggaggcctgggaagcctcgggccttggtactaagagtgctttcaggacctcaagtcctttctactaccctgttctgcccgctaccctaggaagagtattctggtccccacagagaaattgcacagtgggtttgagagaaagtggccagcccaggggctcatggcctggcccagtggccattcccctctcccaagcatacatgtccctgaggccacccctcggctttgggcccaggtggggacagaagcctatctctcttcctgccactcctccccacagcccggcaccttctcttatgtgcagctcagaaaatgcacagaccaaggcttccatggagggccagtgtggtggggaggagcaaccaggacttgggtgcagcagggccctgctctcccctgcctagggggtacattggcaggtctcccctggcaactggttcttatgacatcacggggaagactcccagccttcctggacccctagtttgggagaggacagtgcccaaggcaagggcagggtgaaagaaaggcatgggaaggggccagaaccctgggggaagtccctggtccctctggctggggtcaggccacataaaacagacagctctggcaaactggagagtccttctctcaggtgatctcttggggccagcttcctcatctggggtgggaaatgagggttcaggagtacagacctaggaagacctaggtcggtactttgaaaatgctgaaaaggggctgggggcggtggctcatgcctgtaatcccagcactgtgggaggccgaggcaggctgatcagttgaggtctgtgggaggccggggtgggcggatcatgaggtcaggagatcgagaccatcctggctaacacggtgaaaccccgtctctactaaaaatacaaaaaaattagccgggcgtcgtggcgggagcctgtagtcccagttactcaggaggctgaggcaggagaatggcgtgaacccgggaggcgaagcttgcagtgagcccagatcgcgccactgcactccagcctgggctgcagagcgagactccgtctcaaaaaaaaaaaaaagttaaacattcatctttccggacctggccaagcaggaagcgccatcatgggagctgacgtccgccacaagaaggacctaaaggttcggcgcaaagagcccaagagccaggatatctaactgaggctgtttgttggtcaagctgtacaggttaccgtccagacgaactaactccacattcaaccaggttgtgctgaagaggttgtttatgagtcgcaccaaccggccacctctgtccgtttcccggatgatccggaagatgaagcttcctggctgggaaaacaaaacggccgtggttgtggggacgcttaacggatgacgcgagggttcaggaggtgcccaaacttaaggtgtgtgcgctgcccgtgaccagccggcccacagcggcatcctcagggtgggggccaagatcctgactttcgatcagctggccctggactccctcaaggacggcggccccgtcctactctccggtcttcgcaagggccgacaggtgtaccggcatttcggcaaggccctgggaaccccacacagccacaccaaacgctatttccgctccagggaccagaagttcgagcgcgccagaggcctacgggccagccgaggctacaaaaacgaaccctcttattaaaaagattttggatgctgacaaaaaaacaaaaagttaaaacattcaattttctcttgtcacagacgacctgatttttctttttttcttttctttttttttttttttaagatggagtctcactttggcgcccaggctggagtgcagtggcgcgatctcggttcactgcaacctccgcctcccgagttcaagagcttctcctgcctcggcctccccagcaggtgggattacaggcacccaccaccacgcccaacggatctttgtatttttagtagagacaggctttcgccatgttggccaggctggtctcaaactcctgacgtcaggtgatccgcccacctcggcctcccaaagtgctgggattacaggcatgacccaccgcgcccagcaacctgatcttgtatgtaggaaatattaaataattcatacttgaaaaaaaaaaatcctgaacctagtagagctttttcagagctaatgaagttcagaaaaatctcaagtcataaaatcaccacacaaaaattaattgtatttctagatactagcaaagaataaaaagaataaaataggaatacatttaaccaaggaggtataagacaactctgaatactataaaacattgctgagagaatctaaagacttaaataaattggaaagcatcacatgttcatggactgaagacttaatattgttaagatagcaacactccccaaagtgctcagtacaattcttatcaaaatcaaaatggccttcatgtagtgtattaggcttctccagagaaatatagtcagcagaatgtatatagatatttacagagaaaatatttattagaggataaataaatctccttatataattttttctgagatagggccttgctccattgcccaggctgaagtacagtgacatgatcacggctcactgcaacctcaacttaccaggctcaggcaatcctcccaccttagcctcccaagtagctgggactacaggtgtgcaccaccaggcctggctaattttttaatttattttcattttttaatttttaattttttaaatttttgctgatggagatctcaccatgttgcccagagctagtcttgaactcctgggctcaagtgatcctcctgcctccacctcccaaagtgctggggtgataggtgtgagccgccgtgcccagccaagagaagatttattagggatattggcttatgtgattatccgggctgagaagtcgcacaatatgctgcctgcaagctggagaaccaggaaaactggtgctgtaattaagtctgggttcaaaagcatgagaatctgggtaggggtgggggtgagggctggtgtaagtcctggtgtccagaagtccaagaaccaggagctccaatgtccaagggcacgggaagaaggatgtcccagcccatgaagagagtgtgaattcacccctcctctgcatttttgtcataattgggcacccagcagattggatgatgcccaccacactggtgagggcaatcttctttttttttactcagtctagcaattcaaatgctaatctcttctggaaacgcttacacaagcacactgaaaaataatgttttaccagctatcaggcatcccagtcaagttgacacacaaaattaagcatcacaagcagaaatggaaaagctaatcctaaaattcatgtgaaattacaagggagcccaaataaccacaacaatcttggaaaagcaaatcttcagaaatcagaaacacggctgggcatggtggctcacacctgtaatcccagcactttgggacactcaggtggtcagatcacctgaggtcaagagtttgtgaccagcctggccaacataggcgggcggatcatgaggtcgggagatccagaccatcctggcaaacacggtgaaagcccgtctctactaaaaatacaaaaaaattagccgggtgtggtggtgggcgcctgtagtcccagctacttgggaggccgaggcaggagaatggcgtaaacccaggaggcagagcttgcagtgagccgagatcgcaccactggcactccagactgggtaacagagcgagactccatctcaaaaaacaaacaaacaaacaaacaaacaacaacaacaaaaaaaagtgaaaagacaacctatgaaatggaagaaaatattggcaaatcatatatctgataagggtctcataggcagaatatataaagaacacttacaattcaaaaacaaaaggatgttcaacccaattttgaaatgggcaaagaaaatgaatagacatttttccaatggaaatatacaaatggtcatcaaacacgtaaaaagatgttcaacatctttaatcatcagggaaatgcaggccgcgtgcggtgactcacgccaacatggcgaaactccgtctctacccaaaatacaaaaattagctgggcgcggtggcgcgcgtctgtaatcccagctcctccggaggctgaggcaggaaaatcgcttgaaccctggaggcggaggtttcagtgagccgagattgtgccactgcactccagcctgggcaacaagagcaagagtccatctcaaaaaaaaaagttcaagttgatcaacatcctttcaagcccttggcattgtcaagagttttttgttgttttagccattttatctagatttaatttttaggtttttaacgtgttacctgatattttagccagtttaataacttcatagtgatatctcattgtggttttaatatgcacttctctaataatagccttgatcatctcttcatttgcatattagccatccatatatcttcttttgtgaagtagcttttaaaatgttttctccattctctaattagactgtttctcattattgagtgttgagagttcttgatacattctggatacacgtctctttatcagatatgtgttttgtgcatattttcttctagactgtggcttatcttttgtttttcttaataacacgtgaagcaacatttatgggaggccattgttttggagcgagctcctgcacaaggtaccaacggaccagaccaaaccagaatggaatcgctagtgcaaggtgccacgtaatcaatgcgaacttagagacaggccagtctgccaaaacacagaagattcactgcaaccaacaaaaggggccctgtccacctaggctggcataaggaagccccctctgctttaacccaaagaaatgcatctgaaataacctgatgccaaccaatcgctttgtgcactacgctgtttccttgttcctgctcaagctaccttacaaaacccggctgctgtgccacgcctggcggggcatctccccatttcacacgtggaggccgccccttcctgccgtctcctcgcgcccccatgcagaggctagggctgccgggacccgcgcggcgcgagcggctcagggcccctttccggcctgttgtgcagcccgagccgtctgcgcgtgcgcgagaccgaggcctggcctgcctctgggcgcccacagtgatcccgtcctccgctcggcaaccagattccgacgaggagcgcgctgtgcctcggacgggggaaggcgggcttcctgagtatagtgcattttttttttttttttttttttgagacagagtctcgctctgtcgccaggccgaagggcagtggcgcgatctcggctcactgcaacctctgcctgccgggttcaagtaattcttctgcctcagcctcccgagtagctgggattacaggtgtgcgccaccacgcttggcaaatttttgtattttttggtagagacggggtttcgccatgttggccaggctggtctcgaactcctgacctcaagtgatccgcccgcctcggcatcccaaagtgctgggattgtaggcgtgagcccccgcgcccagccaagcatcgtgcattctttatagaaatgagggggaaataagcaatatggaaagcgcctagcgcaatatcaagcacgtagtaggtactcagaacctgtcacccagcgcgaaacgtccgcaaagcgtgtaaacagacgcccagaagctgggaagcttgcagccctcatagacgccggtatcgccacgccctctgccctcggcgtctcaggagcgctctctgccggcccgctctccccgtgcgtatgcacgtgccgccgcgtcttcgcttcgctttttgtttgtccctgaccgtgcgccgtccaagggtccattggttgccatagagatcgtcgagcgctgggcctgtgatcgctgaggggcgagcagttgcgaccctgggctcctggggacctgagcgttatgtctttccgcgacctccgcagtaaggcagccccgcgcccctgtgacctgcgggtcttccagagattcagggctcccgcccgccgggtcccctgtgtaggcgatccctgaggcttgcgctgccggaggctcctttcgggcctctgcgcctcagggaccgcctgacccgcggctgcaacccggccgagcgtcccaggcccttcttcggccatttctagcgaggatggaaagttctctatctgccactggccgcgtgtggctcagaacgcttgaaatgtggctagtgcagatgaataactgaatttttaagtgtaatttatttctgtttgtgtagctgcatgccgctcttcgctaccgtattggaaaatgcatggagagtttagagactattttttgagttgggttagcttagcgcttagaaaaccgaacagcaggccgggcgcggtggctcacgcccgtaagcccaacactttgggaggccgaggcgggcgaatcacctgaggtcgggagttcgagaccagcctgaccaacatggagaaaccccgtctctactaaaattacaaaattagccgggggtggtggcgggcgcctgtaatcccagctactcgggagtctgaagcaggagaatcgctttggaggttgcggtgagccgagatcgggccattgcactccagcctaggcaacaagagcgaaacaacatctcaaaaaacaaaaaacaaaccaaaaaaaaaacaaccagcaacgaaaccgaggagaggaggctgggtgataatcattgcggctaacattttttgagttttaacgatctgccagggcccgctctgtgttatgcgcatttcattttaatcatctgaacaactctgtgccccctgtatttggtagtgaggaaacgggcacagagaggtcaggtaacttgggcaggtgatacaggcggtaggaggtggcactggggcttgaattcaggttgcctgaactccagacatcctgaactccatctgcatcctttctgcagggctggtaaggagaagggagctcgaattcctttgctaagagggtggggaagtggaagaacgaggctaagagtgttggttacggctgggcgcagtgggtcacgcctgtaatcccagccctttggaagaccgaggcaggcggatcacttaatttcaggagttctagactagcctagctaacatggcgaaaccctgccgctgctaaaaattcaaaaaattagccgggcatggtggcgcgcgtctgtagtcccaggtacttgggaagctgaggcaggagaattgcttgattccgggaggcagaggttgcagtgagccaagatggcaccactgcgctccaccctggccgacagagtgagactgtctttaaaaaaaaaaaaaaaaaaggaaaggtagatgatgattgccaatttggtgtgatccgaggggtctcttaaagccagttttctcgtccaattgttggtgcctgaaattttagcattagagattactccttttggttatgaattgctcttttctacaatgtaaaaatatctaggaagacgcattaccttttatccatgcagccactgagcaccagagtgtgaatcctgccctctggggtttgaaggtttttggtggccacacatcatgcaggatgactgtctcctcccacatagtttttagagaggccagcaccctgccgggggacgtagaatggggttttgttggggagcgcacacacggagatttcggaatattttgatcttaaattaatgctctgcagttgtgcagtgtatggtaaggatcttactcaaattagtgtctattttgacaataacaccgcagcattaacagaacttgactagtacctagtggtcaggagtatttaggcagtgccttactgtgtgaaggaaaggctgctgctttcttttctgttctttttttgagacagtcttgctctgtctcccaggctggagtgcagtggtgtgatcttagctcactgcaacctctgcctcccagcaattctcctgccccagcctccccagtaactggaattataggcgcccgccaccacactcacctaacttttgtatttttatttttattttattcttttctttttttgagatggagtctcgctctgtcacccaggctggagtgcagtgacgcgatctcggctcactgcaagctccgcctcctgggttcacgccattctcctgcctcagcctcctagtagctgggactacaggtgcccgccaccacacctggctaatttttttgtatttttagtagagacggggtttcaccgtgttagccaggatggtctcaatctcctgaccttgtgatccactcgcctcggcctcccagagtgctgggattacaggcgtgagccactgtgcccggcaacttttgtatttttagtagaggtggggtttcaccattttggtcaggctggtcttgaactcctgacctcaggtgatctaccctcctcggctcccaaagtgctgagattacaggcgtgaaccacccgcgcctggccttttttgtttttgtttttgagacagggtctcactctgtcacccaggctggagtgcagtcacatgatctgagcttactgcaacctcctgggcccaggtgatcgtcccacctcagcctgctgaatagctgagaccacaggcatgcaccaccacacccagttaattttttttttaatctctgtattcacatttcccagaaaacagttacagagtccctttgtgactttgctgtttcctgtgctcacactttctgtttcattgtcttgcgaagtctgacctgacttgcagtacctaggtaggttatttgtgaacattgatggaccattttgaacatggatcttcaagaagagtgcagacagaccttaaataaccaggaagcacactgaatgtagatcttggtacatatgggaactcaacaaatgtttgtggtgttcatttccaagtcctgctctcttgaaagcactaaggcttttcctgaggtgaccccaacctatggatcaacaagtattagtattactgtttcttaatctgttttatagtaaatctaaatatggttgtatagttcaaccactctatttaagatttctctaaatacaaggcgactgatctttaaaacttgtgttatttgggtcctatgtggtcactaaaattaaaaaaaaagacaactcagaaacatgaatgtcatcctacggattcccctcagaaataaccactgttaacattttaaaacactttttaatcagctgaatttgagtcaaaccactgttgacatttaaaaatactttttcttcatgacattttataaggacgggtgtttcttccttttagcagtaaaaagaaatgagatactaaagagagaaatgaaattcacagctaatccctcaattccattttcatgtatagccatctacttctcccattgaacttaaatatatgctttttaggtagcatttttggtattttaaattttatctcctttttgctttcccttgtagaaagttgacaaatagtccctaaagctgtcaataggttggaaataagaaggaaaagtaaagacaatatctaagttaataagtagttgctgtgtgatggggaactgaatgaattgtatttttccttggacagatttcacagagatgatgagagccctgggataccctcgacatatttctatggaaaatttccgtacacccaattttggacttgtatctgaagtgcttctctggcttgtgaaaaggttcgaacggcactttattgacatctaagagtgaatactgggttttatttattagtcatctagaaaacaggacacagctgtgatgctgcaaaagggaaagtttttggaatttgacagacccagctgtattctgttacaaaggagttgtggctgggcacagtggctcactgctctcatcccagcacttcataatctcagtcattcaagactagcctcatcaacatagcaagaccctgtctccatacacaaaagaacaattagctgagcctgggtggtacacactcatagttccagcgactcaggaggctgaggcaggaggatcacttgatcccaggagtttgaggctgcagtgccactgatcatgctattgcacaccagcccgggcagattgagactgtgtctcaaaaaacaaaatcaggccgggcgcagtggctcacgcctgtaatcccagcactttgggaggccgaggcgggtggatcacgaggtcaggagatcaagaccatcctggctaacacggtgaaaccccatctctattaaaaacacaaaaaattagccaggcgtggtggcgggcgcctgtggtcccagctactcaggaggctgaggcaggagaatggagtgaacccgggaggcggagcatgcagtgagccgaagtgtgcagtgagccgagatagcgccactgcagttcagcctgggtgaaagagcgagactccgtctcaaaaaaaaaaaaaaaaaaaaaaaatcagtggagtttaaagaatgctgtgggagtgggaaatataccaggaagtcgtgaaaggagacgactattcctcagtaggatgctgggccaggctgctcttcagcccctcatggcagagtgacaggggcctttttgcacattctgatcagtacactggattagaaataatggagatttctttttctgtgaaaaaattgaatatgttatatgattcagggttggcagctttttctgttaaggaccagataatattttaccttttgctaaatataaaattcataagatctctattgcgtctcttctttttgttaaaatgtaaaaacagttcttagcttgcaggctgtacaggtcggaggctgcagtctgctgacccctggtttcaataccttgaagaaaataacttcaccaactctgctgctgcttagagctgactaatcggccctagcactgatctctgagtcaagggctgtcagccagggtagcagttctgattagcttcatgacatggtgagatctgagagagatttaattttataagctgagatccacatttagtttttgaaatctgtttttcttaggtggggatttgctcccttggtatttggttttgcttttgaagtttgccttgatctcactctcccacttggggacttggagagcgttgtgttccagacccgctgtcctctcagttgcccacattctctttagtagactttctccttggttaacccgtgctctctcctcttacctctcttgatagatatgagccccagactgacatcccgcctgacgtggatactgaacaggaccgagttttcttcattaaggcaattgcccagttcatggttagtggacacttattttgtggagttgtaaaattaaataaactagaaaggatgactccttgttagggcgactttcaaactgtgtaattgagtttttctttctttttttttgagatggagtctcattctctcgcccaggccggagtgcagtggcacaatcttggctcactgcaacctccgtctcctcgggggttctcctgtctcagcctcccgagtagctaggattagaggcacacgccaccacacctggctaatttttgcatttttagtagagactgggtttcaccatgttggctaggctggtctcaaactcccgacctcaagtaatccaccctccttggcctcccaaagtgctggaattacagatgtgagccaccacgcgcctggcctgagtttgctttctaaaaccattccattgctgggtttctgtggcaccatttcaccagcgaagttctttttgtttgtcttttaattcattatttgttaagaattttgtttatgccaggtgtggtggctcacgcctgtaatcccagcactttggaaggccgaggtgggcggatcacgaggtcaggagattgagactatcctggctagcagggtgaaaccccgtctccagtaaaaatacaaaaaattagttggatgtggtggcgggcacctgtagtcccagctactcgggaggctgaggcaggagaatggtgtgaacctgggaggcagagcttgcagtgagccgagatcacgccactgcactccagcctgggcaacagagcaagactctgtcttaaaaaaaaaaaaaaagaattttatttatttatttttgaatagataacatatttcatggctcacaaattgaaagtaggctgggcgtggttgttcatgcctgtaatcctagcactttggcaggccaaggtgggaggatagcttgagtccaggagtttgagaacagcctgggtgatgtagtgagatcctgtctctacaaaaaataaatttaaaaaaaattagatgggcctggtgacacgtgcctgtagtctcaggtgcttgggaggctgaggtgggaggattgcttgagcccgggaggttgaggctgcagtgagccgggatcatgtcattgcactccagcccaggtgacagagtgagaccctatctcaaaaaaaaaaaaaaaattaaaaacattatgaaacaaaatggagtaaaatgactttttaccctatctgccctgggccaagttccattccaaataaccactattttaaatctcttccagagtttgtgtgtgtgtgtgtgtgtgtgtgtgtgtgtgtgtgtgcaaataaaaatatatatttttcctttgttttacacaaatggtactgtattctacttgatgtacttactgtacactacaagatgtttagcatcttgctttacttaatggtatattttagagaactttccaaatacatatagaatttcctcattctgtttacgcctgagtggtattgcttgcatggatttgccataatttatgtaatttatataggtaggcttttaggttgtctgaagctttgctctttggaacagtgctgtaacaaataacctgtacatctcattttgtttgtgtttgagtgtgtccctagaataagttcttagatttgggattgctgggtcaaaagatatgtgcatttgtaattttgatgtcttttaccaaattgctctccatcaagattgtcccagtttatacaaccactcacaatgtttgagtcacttgaatgctttgcttttattaggttatatcccagttgtcagcagaggcattttcaactcacctacatgggatttagtttagacattacatggaaagggccttcaactttttttttttttggtctaaaaataggccaccaaggcacatataaaactcaacactaagaagctttatcaagcagatgggtatgcggtaaaagagctgctgaagatcacatctgtcctttataatgctatgaagaccaaggggatggagggctctgaaatagtagaggaagatgtcaacaagttcaagtttgatcttggctcaaaggtaaggacaacaaaagccttgtagtgggcgatggagcgttgatttcttgagctctgaagtggaaggagtctgctacagctccgctgcttttcttcctcctcagctgagggcagtttgtcagttttgtgctcatcagcatttggataaagtcaaagtcacaatccactaattcaactatttattaaaagcttagtatttgtcaggtagcattcaagcgctgaggatacagttgtgaacaaaaaggacaaaaatcgtgtgtttattctcttcagttaggggagtcagactgtgaacaataagaggtgtggaaggccagatgcagtgcaggctgtggagaataataagctgggatggggatggatgctgcccagagtgatcttaaatcgggtgatcaggaaggcctcatggattggatggtgtttccagcagagatccaagggagggaaagagtgagttgtgcgggtggcgggtggcgtcagggtgtctcaggatgataatttgttttgggctgggtgcagtgactcactcctgtaagccaaacactttgggaggccgaggtgggaggatcctttgatgccaagagttccagaccaacctgggcaacatagtgagacgccatttttaccaaaaaaaagaaaaaaattagctaggcgtggtggtacacacctgtggtcccagctgcccaggaggctgaggtgggaagatctcttgagcccaggcagtcaagccatgttcatggcactgcgctcccgcctaggcaacagaacgagaccttgtctggggggaagaaaaaaaatgtgttttgtgtgtttgaggaaaagcaaggaggccgtgtgatgagggttgggattgacagaccctctggcgcctgggaagcccctggaaagcctttgtctttgcctctaaggtgggaatcgttgggatccaagcggaaccttctgtgcttatttcccgtccaaagggttgctctggctgctgagccgccatcagaccgaagcaggcggcagggctggaagcagcgagcctgtttggagagtgaggggtgaccgtggctttgagcagagtgctggtgggacaggtgccgtcaggtgtcagggagcgaccacagcagcaagccagaaataaaggttaagccgttactctgaggcccaaggcctcagagcaggagacctaggaatgaaggccccggggctgggagtgcacctaagagtgtggccacgcagggtacgtgaaaccacagtgcactggctgagctccaagtctgctgcagggaagaaagcttcccctgtgaggcctgctaggtgaggccttgtcatggtctatagttgggcttgaaaagccacacacagcttttttgttttgtttttgttttgttttgagacggagtttcagtctgtggcccaggctggagtgcaatggcacgatcttggctcgctgcgcctctgcctcccaggttcaagagattcttctgcctcagcctcctaagtagctgggattacaggtacacaccaccatgcccagctaattttttttttttttttttgagatggagtttcactcttgttgcccaggctggagtgcaatggcacaatctcagctcactgcaacctctgcctcccaggttcaagtgattcttctgcctcagcctcctgagtagctgagattacaggcatgcgccaccacacccagctaattttttacttgtagtagagtcagggtttctccatgttggtcaggctagtctcgaactcctgacctcaggtgatctgcccgcctcagcctcccaaagtgctaggattacaggcgtgagccaccgcacccggctttgtatttttttttttttttttagcagagatggggtttcaccatgttggccagctagtctcaaactcctgacctcaggtgatctgcctgcctcggcctcccgtagtgctgggattataggcgtgagccaccgcgcctgtcctcacatgtgggtttttaaccaggagcgacactcgtcagcaagagaagtgtctagagattggggcatattttgatggtagatctcacgggatgaggcatgggttgagagtaagtcaggtgctacaggccgggtcttggggcagccgtgcggcagagcttgcagagctcatgggtgtgttccgcctctgtgctgtactctacgggaaccactggccacatgtggcaagcacaactgaggaactgagttgagttctgcattttctttaattcttaagtaatttaagtgaaaatggccacatgtggctattggttactatattagacatcactgctctgaagttttttgtgtgagcccctggaaggatgaagttgccatgtactgaagcagagaaggttctgcacatgctccatttgccacgccgattggctgtccaggtggagatggtgcacaggtagctggtatgtgaaactagagcccagggaaagcccaggctggagctgggagctggggagcaatcagcacacagatggtattaaagccttgagggtaggagcagagccagcagaaaagacggggggtccaggaatgaaactctgactcgctccacttttgagaagcagagaaggtgacagactcctgcaaagaagtttggggatgtgctgctcggaagggaagaaaagcagctagagccagagcaggctggatcctggaggactaaggaagagggaagcaagctatcaaagccatcagctgcaaatgaagagggagagttgttgctagtgggttgaaaatgagagccagaaggtgaggattggttgtccaggagagagggagagtgagcagagcagggagacgtttatgtttgggctccttagaagagttagcatattctaggaagaaggggtgacacacacatcctaagaaagaagcctgtgcacagggctcagtgctaaatcctcattgtggttgtcatcaccttcctggcaacagctgcccatctgtggagcccagaaccattgtaagtccttagtgggtgccacccgatttgcgcctctccaagcctgtggaggaaagtctgaggcagagaaggagggcaggggaggacgaaacacaggacgtcaggctgctgcaagaggatgtgtgtccctcaggctgtccctttgtgtggccgctctgctgccgtcaggcaccctactgtgacaaagtccaagtaggaagcacgtcagctttctcccagctatgccctcctggttgtggcttcagtttgaggtgacattaggttttttggagagacccaggcgtcctggaattggtctctttagtacttagatgatcatttcctgagcgtgtgtcccgcagcctgtgagcatgtaactggggaagcacatgtttgtggtcacgtgtcccaaccaaaggtaggagctgacatgaacaggctagtggttgaatgcatgttaaaaatctgtggctggccgggcacggtggctcacgcctgtgatcccagcactttgggaggccgaggtgggtggatcacctgaggtcaggaattcaagagcagcctgaccaacatgtagaaatcctgtctctactaaaaatacaaaattagccgggcgtggtggcacatgcctgtaatcccagccacttgggaggctgaggcaggaaaattacttgaacctgggaggtggagattgcggtgagccgagatcgcgctatcacactccagcctaggcaacaagaacgaaactccgtctcaaaaaaaaaaaaaaaaaaatctgtggctggctgaacatggtggttctgcctataatcccaacactttgggaggctgaggtcggagggtcacttgaggccaggagttagagagcagcctgggtaacatagccaagaccctgtctctattaaaaaacatctgttgctgaggtttctgtttttgttattttccttccagattgcagatttgaaggcagccaggcagcttgcgtctgaaatcacctccaaaggagcatctctgtatgacttgctcggcatggaagtagagttgagggtaagcattccagtacttccttaaccatgcagattttctcttcaaggttttctttttcaattctgtttctcccttttcagttctgatttaatgaaatacacctggttgaatgagctaatgtgtggaaaggtgatagaggatattagctgtccttcctgcttctggtgggcactggtctagctttatttatttatttatttatttttatttatttatttttgagacggagtctcgctgtgttgcccaggctggagtgcagtggcgcaatctcgtctcactgcaagctccgcctcccaggttcacgccattctcctgcctcagcctcccaagtagctgggactacaggtgcctgccaccacacccggctaattttttgtatttttagtagagacagggtttcaccgtgttagccaggatggtctcaatctcctgacctcgtgatctgcctgccttggcctcccaaagtgctgggattaccggtgtgagccaccgcgcccggcactggtctacctttaacttcttgtttaggagtggcagctccatggcatgtgactgagctgtccttgttgtgcccactggcagactttattgatcatgatgtttttttctggtgtactctgcttcagcattttctcaaaaatgatcttctgagcttgcagttccccgaccttgctgcccagtgcaaacacctggggacctctaaagacttctgaagcctggctttcactctggggtccttgttatggaatgtgacctgggcattgggagttttcagattctcccgggtgattctaacagcagtttgggaccagcaatcttggcatcacttccagtcagctgaagttgatgttgcagtggagactgatttgatttgcaatccttattccagccaatgccagccaagaagtatgtgccatcacctacatttaagtagctgtttaagactggagtggtgtttattttttatttttttaattttgttattttttttgagacagtctcactctgttgcccaggctggagtgcggtggctcaatctcggctcactaaaacctccgcctcccaggttcaggtgattctccttcctcagcctcctgagtagctgcaattacagatatgtgtcaccacacccggctaatttttgtatttttagtagagatggggtttcatcatgttggccaggttggtctcaaactcctgatctcaagtgattcgccttcctcggcctcccaaagtgctgggattacaggcatgagccactgcgtctggcctagagtggagtagtgtttaatccttacctgtaaagatttatggcatttgaagcatatgtgctcaatctaatgctttaaaactaaatgaatttctttcattcacttcctagcaagagtgccagccatggcttctctctctcactgccttgcctgtgttctggcataccctgggagcaaactggaagtggaagtctggggaagagggacttaggtgctagattgctatgtctgctcatcatatattgacccggcagttgccacctgatgaagtgtggttggcagaatgaaactgccactgacatctgctagctaattcagatgatgagtaaggtacctccaggctttcccctgttctgtttgtagtgcagtggtgtacatatgtctgtacatgtccctaagagactcagagacaggagctggccacttgctgattgccactagagctgtggcatcattgtgagacttcatttccatcccacggggtctctttcaacaccatcctgtaaagaatgatgaagtaaccagtggctgaaactgttcccaaggaaaccatgagaccctgaatgtagtacttgtcaaattctgtgtgtagtcatgatccgaggaagagcgcctatccagtgtttgtttttctttcattcagtaaacatttactgaggtgcagcctcagccacaggcaaggcactgagctctgcctccttgactaagtcctcaccctgccctcagccattcccaccaggtgcaccgtggatgaaaggaagcacaagacgagttttgacacagtgcttcaggaaccttgtcttactttgttcaggctgccgtcccaaaacacaataagctgagtgacttataaataacagatttgtttctcacagttctggagattgggaagttctagatgaaagcactagcagcttcagtgtctggcgagggcttgttccccacagatggtgccttgttgctgagtcctcacatggcagcaggggtgagggatctccccagggtttctcttaggagctaatcacctcctaacatcatcacattgtggtttcgagtttcaacataggaattttggggtcacacaaacattgtctatagtaaacctcataactatatccacattacaatcccatgtctcagaagttttcagcactgatatgatagtcacagatgtctcccttgataggttaatggttcatgctaggggcagggccatggtcactgttcttatcggttgcgtttgttagtgataggcaactgagagggacttcatgctaagaaagatgcttagtttgggagtcacctggacagaatgcaggtaaagaagcaaattggggctgggcatagtgactcatgcctgtgatcctagcactgtgggagaccaaggaacgtggatcacttgagcctaggagtttgagcaacatagtgagaccctatctctatttaaaaaaaaaaaaaagaagcagcagcaaatttgggagaaaagataatggatgctaagttcagttttgctcatagagttggggtcacctaggcctctggctgaaaaggaggaccttgagctctggagagagctgggtaggcactcagataatggaagacattataggaggtgatggtggcagtgtttttgcatcagagatccacatggcaataaacttcggagaatcagtctataaggcacatctagatctaggaatactggttttgagaactccttttctgaaaatatacgtaaatgattttactgtttcctaggaaatgagaacagaagccattgccagacctctggaaataaacgagactgaaaaagtgatgagaattgcaataaaagagattttggtaagatgactttgcttttatataatgttttttatgcctgggattcaaaaatactgatttcttgcccatacaagacagaacaagctaggcttagtaacaagggatgtgttagtggggaaatgaaaaactcaagaggacattcgagcttacctaggtcacttactatcatttttttcccctcgttataaataaaaacagcttctcatgttattaaaaattgatcagtttcagtaatttgataattatcagttattcaataattttaataaataatgctctattttattttgtttaaccaattcctcactgcttagtatttaaatgatttcagggttttctaaattccagacagcactgtaataagtagaaggatcactattgtttactgctcgctcacatcagttatcctctcatctaaagcagtcagttggaaggcagatcatgagggtgactctagactcagattgcttgggtttgaattccactgtgtgatattaggcaagttacttaccctctctgtgcctcattttcctcatctgtaaaatggcaagaactgcattcccaactgtgtggggtccttataaacatgaatcacgacagggcatatcaagcctcgtctctgatgcacaattgataatcagtcatcactggtgatttattttactcagtagacacggatgagggcccctgtgtacattcagagtaggcataaaacaagaatttgctatgagttgtacaaaattctaaaaatcataggtttttaaaaatatgtaattcttttgtcattaaacagtaatacctgctgggcagcccagcctagggagtcagagcctcacagcgggagaagggcaccacagccctggtgggagattggtgacagataggcagatgggtcagataagtaaaaatatggcaaggataatggagccacgttcctcactgttggagaaaaaagtcacaaaaatgtcacaaaaatggaaagagagaaaattagggtgaacttgaaattggaggtgttggttaaacgcatagttttcaatatatagataggtataggaataaattttgatatacatgtatgcacatttaaggaattacgtatatatgtatataaatgttttatttatatacatacacgtagagacacccacactcatacatttcttagctctgagcacacgtagcacctggcttaatgccattctccactaaaaggaaccaggactcttaggggaaaatggctaattccagagttgggcaggagaagtacgagaaagtaaggaagagttcaaaggaggaaagggaactattggaagcatgcagaagccaacttaagtgggcttctcctggccaaagtaaggacaacttaagcatcaaaataaataagttagaataattaattttatggtataatagaatgaaataggaaaccatgagttttcactggcataaaaaaataaatgaatattggaggctgaggaggagcaggtcattcacacagattcgaagtaactttccacaaagtactttttttttcttttttttttttttgagacggagtcttgctctgttgcccaggctggagtacagtggcacaacctcggctcattgcaacctctgcctcccaggttcaagtgattctcctgagtagctgggattactggcgcacaccactacacccagctaattattgtatttttgttttattttatttatttatttgtttatttttttagacgaagtcttgctatgtcacccaggctgaagtgcagtagcgccatctcagctcactgcaatctctgcctcctgggttcgagcaattctcgtgcctcaacctcccaaatagctggaagtacaggcatgcgccaccacgcccagctaatttttgtttttttttttagtagagatggagttttgccatgtttggccaggcttgtctcaaactcctgacttcaggtgatccgcccgccttgacctctcaaagtgctgggattacaggcatgaggcattgtgcctggcccgcagagtacttattaattacagaggggaaaagagtcacttctcagggagaagcctgccagtcacccccttaatcaagagatcaaagtgaacatcatcgttacagaacaaatcaaaatcatgcacgcctggtaggatgcagtcacttctgagtattcctgccaacgatgcatatctgactctaatgagacaaagccggattgaggggcattctacagattaaccagcctgtatgctcccagagtgaaaaggttctgaaagtcaaggaaagctgagggggcatttcagactgagggaggctgtggagatgtgataactggacacataggcagctcctatctgctgttggggacttcactgggacaagtggggacagtggagtggggctggagttagacggtggtagtgtgttagtgctggcttcctgttttgatgattgtattgtggggatgtaggagaaagtccttatttgtaggaaatacacgctaaagtattcagggtattggaacgtctggtcagcaacttactgtcacctaggttgggaaaaacgctttgtgttgtacaacaggttttccgtaaatttttgattgtttctaaatttaaaaattaaaaaaaaattattatacctcttatccttgccagtgttctaactgaatcaggtgaacacggcatgaatgtgcccttagcactaatatgttaaaagtagaacacccaagagaggacagggttcatttcttggtagacatctcttaagactcctttcattgttagaaaatatctgtgatgtttgatcattctaaaaacaaccaaaacaacatgggtacttaaaagggtttggggagtacaggccatttatttcagaaaccagggaaaattgcttgtgtttacacagctgttttgcattgtggatctttcttgtttgaggaacagatatgtttaaggtgggataaatttactaggttttaatctgactttggttcgaggaaacagttgccattaactgaagttgtttagaaaggagacccacctttcttcctgtgagggtgaactcgcatttctcctgggggctctaaggcacttgcagcaaatcgatgataagggtctgattattttcatgaaagtatcttagaagtggctagtgtacttagaccaaaaaaattagaccataaacgcattgtcagtaacagtggctggttccaaaacacaccatgcctgagagttgtggagagtgtctgggcttcgtaggccatttctctgtggagcccatagcttttcagagacttgcaggaaaacagagtaaccccttcgtgggatgctacacataggcaaagagctggaggggaagccccaccttggccaccaggaacttaatgcagggctggaaagccagaaccctggggggcagttccacgctcagctgggtggcagtccagattcctcataaagagattggagcctgaaccccaggcatgtgatccagccagccaccggacaagacgcatgtgaagacggcgcactaccagtgactctacctgcttcaaatgaaccttctcttaggatagggagacttgtgtcaccgtcagtgggcccgtgtcccccttcccttctttactcagcctctgttgcccaagggcctctgtccaactgttgccctggaccccttccagagctggtgcacaccagtgtggccattgccactgtgggaactgctttcgtactgtcttcagagtggtttctcctcgtttttagtctgtagtcaagcttctgttgccagggagagggaagaggaccttctctcaatcccagcaggcagtgggttagggctgggaccagctgtttctttctctcccctcctagtagagcagtacttggtgtgtgtgggtattctgtaagtcgggtgtttgtaactaggggcatggcccgaatgataaaaaggcagactgaccgtccagagtgatgtgcaccttgttctaaccgagtgagccagagaaaagactgcaggcctctccaccttgaccaggacactcttctttgcatcttcacttctttccctgggtagaaatgcctgcttttcatggggaaaaaaaaagagatacctttttctggacctgtgtgacattctccctggaactagtgggttaagtgagtcattgcttggggaagtgtctatttgtttgcttttgtgtttgttgagcataatgttgctatgcctgaagagttgcaaaattcttctaagaattaggatggctgtttttattgccaccttgtctcattatttcccattaaatatagacacaggttcagaagactaaagacctgctcaataatgtggcctctgatgaagctaatttagaagccaaaatcgaaaagagaaaattagaactggaaagaaatcggaagcgactagagactctgcagagtgtcaggtagatatgaacacttggagaatgagtagaaagatgtcctggaaagttcaaacaaactgggcgtggtggctcatgtctgaaatctcagctactcatgaagctggggcggggggttctcttgagcccaggagtttgagaccagcctgggcagcataatgaaaccccatctctaaaaatttttaaaaattacctcagtatggtgatacacacctgtagtcccagctacttgggaggctgaggcgggaggattgcttgagcccaggaggttgaggctgcagtgagctatggttgcatcactgcactccagcctgagccacagaacaaggccgagtaacagaacaaggccctgactctaaaagaaaaaaaaagttagaacaaagacttaagagaatagaatgtgatcttaactcttctcaagcaatgaaaaaaagccttacataagggtatcttcacctcaaatgtacatgtgttgcctgtcataacaagcagatggctaaactcattctctttactgcttgcggtatgtctggaaaactgcttaaagcttgaactgccctttaagcttttatagcttcttggaactcaaggcagagtaagtgaatccagacggggaaatccagacgtggtctcctaagatcttgccataaattaggtagaaacagaaacatactcctgcctgtttgttggcatagattttagactttatttaaaccttgatcattcctcaccagtcagtaattcatctttcttcctacgttacctcattggaaatatatttcccaggaataccgatggagaatagtggtgccggctctctctctcttctcttcctcgttctgtgcctctttccctcccccatgcttctgctctttctcccttttcattcaccctttatttttctttcttcttggctccctcctcttcccagctgcctactctgctcggatgttttgcctttttggatgttggtggctggctacaccctgcccactgtcccgaggtctgtggggaggcagcacctggaggcagcgacagcaaccacagggagcgccctggctcctccctgcccagcgcaaggccaaggcccttcccctcctgaaactggctctttacctctggagcctcagagagggaaaaaaaaaaaaacagaagtcattgccgccatatagattgatctccttgacacattccacttttaaagcatcaattcatttttgttaagctccaaatcattttaacagaaaagtctctttgttttgctctagttcaaaagattataattatttctgagtttatctgcttatatttttaaaagagtagaattttccctttaaggtcaataataagaaaaaagaaaaagttcagcaaaccagtatagatttttatggttttttttgtttttgttttttttttttgagttggagtttcgctcttgttgccgaggctggagtgcaatggcgcgatcccggctcactgcaaactctgcctcccggattcaagcgattctcctgcctcagcctctcaagtagctgggattacaggcggccgccaccacgcccagctaatttttgtatttttagtagagacggagtttcaccatgttggccaggctggtcttgaactcctgaccttgtgatccacctgccttggcctcccaaagtgctgggattacaggcatgagtcatcatcacgcctggcctttttaaaaaattttttatcgtttaaaaacctctttagactgggcacagtgattcacgtctataatcccagcactttgagaggccaaggcgggcagatcgcttgaactcaggggttcaagaccagcctgggcaatatggcgaaaccccatctctacaaaaaaaaaatataaaaaatagctgggcatagtggcacatgtctgtagtcccagctacttgggggcctgagacaggaggatcacctgagcccaggcgttcgatgctgcagtaagccatgatcacaccactgcactgtagcctgggtgacaaagtgagaccctgtctcaacaaacaaaaaaaaaccaccagccttaattcgtaacaacctgtggtcccctttttagaggattgctttaaatttataatatcctgacagtagaacattattattattattattatttcttttgagatggagtctctctgtgttgcctaggctggagtgcagtggcgcaatctcggctcactgcaacctccacctcccaggttcaagcagttctcctgcctcagccacccgagtagctgggattacaggcatgtgccaccacgcctggctaatgtttgtatttttagtagagacgaggtttcaccatgttggccaggctggtctgaaactcctgacctcagttgatccacccgcctcagtctcccaaagtgctgggattacaggcgtgcgccaccgcacccggccaacagtagaacattatacccaaataagataataatatatatatttattgatttggagagatgtgtctggtatgtgatttttttgcctttagagatggggtctcaatgtgtcacccaggctggagggctggagtgccacggcaaggtcagaggatcctcactcactgcagccttgaactccagggctcaatcctcctcctacttcagcctcccaaagtgctagggttacaggtgtgagccgatgcacccagcctgatcatttttaactctattgagattacggtatattgaaatgaaataaagattataaaatttcttggtatatttaattttttttttaaatgcattcctatctatatttatgcatagaaaagtctggaaggatgtatgtcaactatcaagcgcttatacctggtgatgggattatcagtaatttttacgtcattcttcatactttcaggattatttcaagtttttacaaagagcacatcttatttatgatgaaaaagaagtatgttcattttggggggagaaagcagaaaagggaaaatatttttaagcattacaagaatgaaggaccttctctaattaagggtttccagagaaagccaccatggaatctgaaactgtgaatacccatttcaaactactgcatataattcacctttcctttttatttcatttgcttcttttaggccatgttttatggatgagtatgagaagactgaggaagaattacaaaagcagtatgacacttatctggagaaatttcaaaatctgacttatctggaacaacagcttgaagaccatcataggatggagcaagaaaggtttgaggtgagctgagcctgtcctctgttcagccattccttctggtgtgttattttgtactgggtgacaggtcattttgttaatatcattgtgaaaaaaatatcagtacatgttttttctccctggtcagtctgaggattgctcatgtaatgtgtttgttttgctggcagtgtacactggactccagggttgtcaaatctttgatgtcatatttcatcaggtttggtcagttaagagaacagacagggccgacatgaggcctgtgtggctgcgtaagaccctgtgccgacatggggcctgtgcttgctttcaggccctgttgtcactgtcttgaaattcataataatttttaagtgcattttattttccactgatcccaaaaattatgtagctggtctcgagtgcagatttaaaagcttgcttggctttgggaggccaagacgagcggatcacttgaggtcaggagtttgagaccagcctggccaacatggtgaaacccctcctctcataaaaatacaaaaaattagccgggtgtggtcgtacacacctgtagtcccagctactcggcaggctgagacaggagaatcgtttgaacatgggaggaagaggttgcagtgagccaagatcgtgccactgtactccagcctggacaacagagcaagatcccatctccaaaaataagaaaataaagcttgcttagtcagttcacataaagattttcaaggcaaggtgcgatggcttatacttgtaatcccagcactttgggaggcttaggcaggaggatcactggagcccaggagtctgagaccagtttgggcagcataatgagaccctgtctctacaaagaagtaaaaataaattagctggacatggtgttacacacctgttgtctcagctacttgggaggctgagatggaaggattgcttgagcctgggagtttgaagttggagtgagccatgatcatgccactgcactccagctcggttgacagagcaagaccctgtctcaaaaagaaaaaaaaaaagggccgggcgcggtggctcacgcctgtaatcccagcactttgggaggccacagctggtggaccacgaggtcaggagtttgaaatcagcttgtccaacatggtgaaaccccgtctactaaaaatacaaaatttatctggtatggtggcgggcacctgtaatcccagctacttgggaggctaaggcaggagaattgcttgaacccaggaggcagaggttgcagtgagccgagattgcgccactgcactctagcctgggcgacagagcaagacaccatctcaaaaaaaaaaaaaaaaaaaaaaaaagaaagagattttcaagtcctggttaattgaatcaccagaatagctcattggagattgttttgtaaagaggaatggcagtttatttattgattgtgggaaataaatgtgtggccttgagcctgaccaaccatcttacaggttcctctcatccctgtgggtaaggccatttaggaaaagagtgttttagacccgagcatgagttgataaatgtggaatttagagcaaaggaaattgaaccaagttgtgatcagtttttgaattgccctatccttaacctgagaatggtcatttagactccattttcatgatgaaattggtctgcagtctccctttctcatgcccttgacagcttttggtattaaggttatgctaggcttcttacaatactgagcatttgagtttggcagagctattttgttgtccaggagggctaactgggagtacctaacgcatccgtgtggacacatgtcatcttgacgaggaattcattgctagcattactctgtggcagaggcaggccatggagaaatggtacgggacaggcacatttcgagggcactagaaagagcttggagtttagaacattttaaacattgggtacctgggaaagaacagtcaagggcagtgaaaagaaacgttggccatttttttgtattatctggggccacctctgggttcagagaacaaaccaaacagtatgcctcagagtggcaggtaggtggcccaggaaacttcccagggagcccctctaccctacccttccttcaacaagtacatctctttttctcttactcactctcgctctctgtcgttagaatacctgttccctcgaaataccccatgccggaaacacagtgctttatttttaatgtttagaacaacaatatataaagccaacttcctccctctgtctgtccctcccccccactctctctctttgtctctttctctttctcaacggggtctcactctgttgcctgccactctgtctggagggcagggtgtgattataactcactgtagcttcagacctcttgggctcaagcgatcctcccacctcagcttcttgagtagctgggactataggcacttgccaccatacctggctaaattttttaaatttgttgtagagatgaggtttccctatgttgcccaggctggtctcaaactcctgggctcaagtgatcctcctgccttggcctcccaaagcgtgggggttacaggtgtgagccaccacgcccagcccccattctctttcttgataataatcaaggccacattttatgatctgagatatttcctcctgtccccacccctgttcccatccttacctgtcccaccatttagcatcttttgagctggaatctgaaggcagggcaggaaagataaatgataaaatctatactttcttcctttgaaagcaggaggcctgtctctgccctaaaattagatgtgtctgttctgtgtccccaggtcatacaggcatgcgtgatgggcatttagttctcctcagaggcagggaaatgcaatcggagaagcatggggtggggcagctgcttcactctgggcgcccctgtccaccaggccacgaggcaaccgcagagagaaagggcagtaagtttcaggaccctggagttgctcaggcagtgttaattctcttccccttccttgagtttagctctttttttgttctgtagcacaaacttagcagtccttacacagtggtgaagaagaatagaacagtccagaaaagggccatctctcctgagtctgtatttcctcttccacaggaagctaaaaacactctctgcctgatacagaacaagctcaaggaggaagagaagcgcctgctcaagagtggaagtaaggctgggcttcgtagacgagcagtttactctggactagtattttcagccttgaaatatatatagagagatatatatatattttttaatatgtattttcttctttttttcagcagttttttttttactgtagtaagaacacttcactttacatcttcaattttgaaaagtataataaattattgttgactataggtacaaaaatattttcaaaaggcggttttctcacaacttctatattgggtaccattgtattcactcaagagtctggtttaaatatagcatttaaaacacatttcgttcttgtgccagttaagatagtgttttcccctgtttaaatgatagtttgaattatatatgatgcgtaactataagaaaacatggccctagatgtgtgtagggttctgtattttcaggctgaatgatggaaagcaagcactgggatgcagtgcagggagaggggccgctcgctttgtgatggtccccatgctgctgagatgccccccataatccagaatggctcagcaagacactcagctggagagacacagggttacgtccatgcaaagcctagattccgggaaggagctctctgtgaccaggcagcttcccttatccttgtgtgggcggcaagccgcccaggtgccgaggcaagagaccgagagcacgagctgttccagtataataaaatatataaaataagaatagttatactagatatagatcatagatatgattatatatgaatatcattaatcattagtttatagcaattactctttattccaatatcataataatcctcgctctacaatcataacctaggaaaaaacaggccatacagatataggagctgaggggacatggtgagaagtgaccagaagacaagagtgcaaaccttctgttatgcccagacagggccaccagagggctccttggtctagtgggaacaccagcgtctgggaagccgcccgttgccaagtggaccgtggtctagtggtagcgtcagtgtcaaggaaaaacacctgctacttagcagaccaggaaagggagtctccctttccccgggggagtttagagaagactttactcctccacctcttgtggagggcctgacatcagtcaggcccgcccgcagttatccggaggcctaaccatctcccggtgatactgtgcttcagtggtcatgctcctagtctgccttcatgttctgtcctgtacacctggctctgccttttagatagtagtagcaaattagtggaagtactaaaagtctctgataagcagaaataatggcgtaagctgtctctctctcctctctgtctctctgcctcagctgccaggcagggaagggccccctgtccagtggatacgtgacccatgtgaccttacctatcactgaagatggctcactctccttaccctgcccctttgtcttgtatccaataaatatcagcacagcctggcattcagggccactatcagtctccacgtcttcgtggtagtggtcccccaagcccggctgtcttttcttttatctctttgtcttgtgtctttatttctacagtctctcatctctgcacatggggagaaaacccaccgaccctgtggggctgtaccctacatccctgaacttcagtgtcaagtcactgtcagggaccggtagcagcccaggatcttcctgctgaattgatggccttgttgcacggagttcctcctcctcttgctggttgccctttcttttcttcagggtgaaatattctattcactctcatgttgagggcagcatacttgaggcatcaggcccacacacatgctcccacacacactctctctctctctctttctctttctttgccatttcccttgtatctctctcattttgcacctgttctgtgactctctcgtctgaatctcaggaaactttggaggaaggatagggactgctgggaaatcctccaggaacaaggttaggaaatttgaagggcctgtctagccaaagcagccctcccctttttagttccatgtcagccaggagcatgtgaagcagccctcagtgatcagcctgcatggggtttgtcccttgcgagaggcccagctcagctaggagccctggtttgttgcttgcatcccatgctgtccccgggccaggatgctaagacctgccattctgatcttgctttattcaccaagatttacctttgtgttttcttctaggagttctatagttttagctcttacatttaggtctctgatccactttgagttaatttttgtatatggtgtgagacagggggtccaacttcattcttttgcatgtggctattcggttgtcctattatcatttgtggaaaagactattatttccccattgagttatactcgcatgttgtcagccattaattttaattgtcactgtcagctcagtggtttcagtgtcagcatgcattaatgtcttagtctgttttgtgctgctgtaacagaatacctgagactgggtaattatatattttacataaaatatatacagcattgtatatatggatacatgcagtcatccctcaatatctgcgaagaactggtgccagaacccacctgtggataccaaaatccacagatgttcaagtccttttcatgtaacctatgcacatcctcccatatactttaagtcatctctagattacataaaatacctaacataatgcctatacatcacttcattcacatggattcaacatagtacttggtatgtggcaaattcaagttttgctttttggaactttgtagatcttttttgaactttgtagattttttttccaaataattcagatccatggttggctgaacccatggatgtgaaatccatggatacagagggccagttttgtatgtgtgtgtgtgtgtgtgtagtttatatatatatgtcatatatattattatatataatatatattatattatatattattatatataatatatattatattatatattatataattatattatattatatatattatataattatatattattatatgttatatattattatatattatatattattatatattatatattatataatattatatattattatatattatatattatataatattatatattatatattattatatattatatattattatatattatatattattatatattatatattattatatattatatattatatattatataatattatatattatatatattattatatattatatattatataatatatattatattattatatattatataatatatattatattattatatatatattataatataatatattatataatatattatataatatatattttataatataatttataatttataaatttatatttataattatatatgttatatagttatatattattatatataataatatatgacaattatataacatatataatatattagtattaggttatattattatcattataatcagaaacttacttgtctgaaatttaatgagccacagttctaggagcaagcccaagatcaaggagctgcatcttgccgcaccatcccatggcagaagggcaaagagagggcgagagagagcaagagatcaaactcacagcctcaagcccttttataaccagcattaatccattcttcaaggcggagccctcatgacctaaacacctcccagtatgccccacctcccaacactgttgcattgggatttaagtttccaacacaggcttttcggagacacattgaaatcatataatagcaattgactttagtttacctgctcacttctcaggtctgtattggtttgagttgtaagaagaaatcttattgagcctgaggtacatgtattaattttattttaaaattgattatataatttgatttgcattgcatgggataaggatttaatgtcttaatttcctggatagaataagaaatgaacaaatgacttttgcacacagaccttactgggcagagctgtttcgttgtgatcatgaagccactcctttgttttgcctgcttgtgttcctgctaggtaacgatgactcggacatagacatccaggaggacgatgaatccgacagtgagttggaagaaaggcggctgcccaagccacagacagccatggagatgctcatgcaaggtaccccggcgtctttcgctggacttcctccctgcgccctgtttcacagaacacctggccaggactggggcaggctgcttagtattgaggcccacaagcgtgctgcgaatggcccctagaagcagctcttgctcaggtttatcctgtcctgttgtttatggctcttgaactgctcagtggtcatgtttgctccttgtctgtgatcccaagactggatggttcatatttatggcttggtatttctcacagccacaagaacacattgcctctgccactctcagtgcagtgatatacttaatagcctgagaattaatgcagaaagggacttaaatgagcatctctgccttaaaaaaagttcttctaattcctttactcatcacaaaagattcaagcaacaaagctcagcgcagtggtgcacaccttattcccagctactcaggaggctgaggcagaaggatcatttgagcctaggagctcggagctgtagtatgtgatgattgtgtccgtgaatatccactgcattccggcccgggcaacatagaggggctcttaaaactaagttaagccaggcgcggtggctcacgcctgtaatcccagcactttgggaggccaaggcgggtggatcacgaggtcaagagatcgagaccatcctggctaacacggtgaaaccccgtctctactaaaaataaaaaaaaaattagttgggcgcaatggcgggcgcccatagtcccagctactcgggaggctgagacaggagaatggtgtgaacccaggaggcggagcttgcagtgagccgagatcacgccactgcactccagcctgggcgacagagtgagactccgtctcaaaaaaaaaaaaagagttaaaacaaaaaaagactcaggcaacaaaatttgtagagcaaatgtgaattctctcctggggtcttcctcatgtcccactcccacctgggagggctcatggctagtggccagggtgggtgtgtctttacagattacctttctgtacatatacatacgcacacacatacacatacaaagatcacctgaaaaaaatttaacctgagtgcaaccagacggtatgtatggttctgcaacttgcttttgtttttaaaaattaagtacaattggaactcttcctctgtcagcaatagatctgccccctaattttttttttttttctttttgagacaaagtctcgctcttggtccccaggttggagtgcaatggcatgatcttggctcactgcaacctctgcttcccggagggagcaattctcctgcaatcccaagtagctggggttacaggcccgtgccaccacacccagctaatttttgtatttttagtagagacggggtttcaccatgttggccaggctggtctcgaactcccaacctcaggtgatccacccgcctcggcctcccaaagtgctgggattacaggcctgagccaccactcctggcctgccccctactttttaatggctatgtcatattcctagcaggactgtacccatgatttactgggcgttctcgcattgatatttcccctcttttccttgtatatacatctttctgcatgtctgcatatctttaggttgcatcattaaaagtcaaattcttaggtcaaaggttccataaatttttattttaatactataaaattctcctatatttgcctttaaaaacatttcttatctaccacctgttaatgtttggagcacagttgcttttttttttttttttttttttttttttggagacagaatctcattctgtcgttcacgctagagtgcagtggcacgatctcagctcactgcaacctctgcttcctggtttcaagcgagtctcctgcctcagcctcccgagtagctgagactacaggtgtgaaccaccatacctggctaatgtttaaaaaaatttctgtagaaatgaggtttcattatgttgcccaggctggcctcaaactcctggcctcctgtctcagcctcccaaattcctgggattatacgcaaaagccaacatgcctggccagaaaacaaatcttgaatgctatttcctgctttattttccaagatttttatgacttcttcatgcttttgttgttctcaggaagacctggcaaacgcattgtgggcacgatgcaaggtggagactccgatgacaatgtaagtcccccgctcccctcagtggttctgtgcactctgggtttggctgtccccatagatgggagtggctgagttgctgtcagcagccagggagccgtctatggtcagcccggccgtgcctcgatgcgtggcagggtttggcctcatgaggctctggactcttcgttgctcgtggatggctcatctcttttcaagtgaatgtgcttgctctgctttttttgccttctcactgttctttccattctcgctttccaaagatggaagcagcaccagctctcttaggtaaatgcaagacttccagctccaagaagcaggttggttttctgttctgcctcatgtgtttgtgggtgtctgtcagccctcccggggccagccaggggcctctccctaggagtgatgcttcctctctcctgggcaaaaaggccactcaaaagagatcctgtggtgacagcgggatcactgaaggcccctgtgctaaagtggaggcgcaggcacggagcctggaggcggggaaagctcaggccgggccatcctcaggccctgggccgccacctagaaatgaaggaggacgccgagggccgggctcaggaccaacccccctccctgttctgtgctggggacggaatggtgaagcagcactgtccccagaccaggccctcgaggtgccaggcatgaggctgagacataagctgccttgagctttactgagtggataactccctggagcacttaagcaaaaggggattctaggggtcctcagtgaggtccagtcatcagggctctgccgcccattgctcaagcctacgttctttgttgcgtccctggcagtgctgctcggcccacacagcaaagggcgactcaacagagactgaccccaggctgcctccatgtgccctgaatttacagggcacagtctgtagagaagcagagagagcaactggaaaataattttcctaacaagctcgggtgtggatggtatacagcgtctctccgtcttgcccacccaagacagaagcagagggagtgtggcgtgggtgctggcaatgctgaggcagcaccgcctgcctcttctccagggtttgccttctctctcctcagagcgaatgcattagtcgcagctgagctttatgcctggtggtcacttgtttatttcaaggaggctgtgtccatgccgccctccaggcacagggttccatgctttacgtgttcaggcatccaacacgtgtctgttgagtgcctgccacatgccagtgctgtcgtggattatggggaacgcagcaggggcagaggcaagcccctgcttcatggctcacaccccagcaataatgatggattgtcggatcagggctcatggtgttaacaggaggaataacagcttcaggggacagggagtgacagggaacaaggagggggtggcgtcttctgcgaggtcagtgaaggcccctgacgtggtggtgtttgagcagggcctgagtggagggagcgagcgcatgggttggcggcacctgggcatgtggaatgcactcctcgcatcgaggagcagaggcagctggtgtgattgtgggtgagtgcgagaggcagcaggggccatgcagagctttgcagggtgagatgaagactctgttttctctgagtgtgaggggaaggccctgaagaatcatgagcccagaagggtcaagagctgatgatccctgtttgagagaagccagttaggaggcgcctgcacccgtggaggtcagaggtgacggtgcttggccgaaggtgtggcagcagaggtgttgagaaatggtcaggtcctgggtctctctaagaaccatcaggttttgtgaattgattggacataggctgttagagaaagagaaaaatgagggtgcctgggcttggtctaatcagcagaaagcagagtttcattttctgagatggggccgacttgacaaaggggcttggaaggcagatcgaaagtttgattttggacattctgaatgtgacagccacatgctagggttgagtagccaggtggaatttaagtctggagttcaagggccacgtctgggctagagattgaattttgggagccacccttatttggttggtatctaagccacaaggatagatgtgactgcctagggagagcaagtagaatgagaagagaggcgacccaaggtcctgagctgcatctgccctgcagaggtccgggaggaaggggcaggcagaggaggctgaggggcgtcagcagtgaggaagggggacctggactagagaaggggccctgggggatggagaagatgggttttaaggatgaaggggtgattccacagctcaagcaggatgaggcctgagaatcgatcccagtccgttgaatgtttccttcttgacaggagcagtgctggggtcagtaggtgagagcccgggggaactgaagcagtcgtgaggggcacaggtgtggacagtgagttcaacgactcgctcaggagctttgtgtgaggggagagagacagggcagagcagctggagaggaaggtgggattacctttggggttttttttcaagaaggaaattacagcatgagtgtgcaccgacaggaatgatctagatagaacgaccagccatcctggtttacatgggacgcaggaactgccgttttaaagctgggctgagttggtcaccctggagccctggatccgatgaggagagagagggtgtgtctttcactttgctccctttttttcttttttttcttttttttttgagatggagtcttgctttggagtgcagtggtgcaatctcggctcactgcacctctgcctcccaggttcaagcgattcttctgcctcagtctccggagtagctgggattcactttgctccttataccaatgtctatgttgctttccatccacaatctacaaaaagccaaaacaggcctcccttccctctctccaagcccctgtccttcttgccatctgtagggggagtctctaggtccagtggccctcagcgcagatgcagagtgcttcttagacgctgcgggaaagccagcccctgcagcaccacacccagatgcacctgcagtttggaggattctggttggatgataaattccagctggcagtacatagcctcagtcccatctgtatgccctcccacagcctgcttgccactctgccagcctcttccttcacacagggatgctgctatagaaagggaggcagagagtcttaggacaagatgtcaggaatgaggcaggatcccccgttgcatctgccatttttttcctataggaggactcggaggagagtgaaattgacatggaagatgatgatgacgaggatgacgatttggaagacgagagcatttctctctcaccaaccaagcccaatcgaagggtccggaaatctgaacccctggatgagagtgacaatgacttctgacccttttgccaagggaccctggcagattaaaaccctcagacttgtaggtaaatgggaacttagaaggttaggaaggtaacccctgttttgtttactaagctggctggactcatgatcactgaagcaatacttatttctgctttagcctcctatgtttgcattccatgaagcttaaataagaattgaagcaaatccctaagatttatttttttccaccttatttatcttctaaaacttgaggaatgcatgtgttcttagtgattcacatccacgggacaaaaactcaagaagaaataagagctgacgccacacaagtcttggctgcttttgttactatacattttctctgagactccagcagagttggggctggaacttggcactggggactcatgtttggaatcgtaggggaacatctggctgttaatcacttgcacagttgagaacatttcctatacatcggcttttaattctagctcttatttcattttgtaatcttattttctttcgtctgcatgttcacaataccaagcattaaatgtattttaataactaaacttttctgaaagaaggttagctaaagttaaatgaaaacttggtttctttgaaaatcaggcaatagagacaggctccagatgaggaatcctccattttctgtccgaagctgacattcctctggcagtccagttcaccttggattacagccaccttcatgtttccacggttggtactaaatctggaaactctggtgacctgggctgccctctcagaaactccagactcccatggcaatgacagccgggacacttttcttccctccagccagggtttctctaaaggagctttgttttgtctaaagtgtggcaagacatagtgcacaacacagggacaaaggcaggtttcctgcagctcgctacctaagtgtttctgtaggggaaggagccaattaagaaaaagtgttggtacagattcatgtttctgatttaaaaaaacaacaacacaggattgaattaagtagagtaatagcactagaagaatttttctgttgtgaaattagaagtggagttggtttttttcttttttcttcttctttttttttaatatgaaaagtacttagctgggagtggtggcaagcgcccttgggtccagctactcaggaggccaaggtgggaggatcacttgagcccaggagttttagactagcctggacaactaagtgagactccatctctacaaaaaattaaaaaattagccaggtgtggaggggcatgcctgtggtctcagctattcaggaggctgaggcaggagaatcacttgagaccaggaagttgaggctgcaatgagccgtgatcatgccactgcactccagcctgggtgacagagtgagaccctgtctttaaaaaaaagaaaaagaaaagcacgctgcttgtaaaaagcgtacagtaggtcaggcgtggtggctcatgcctgtaatcctagcactttgagaggctgaggtgggtagatcacctgaggtcaggggtttgagaccagcctggccaacatggcgaaaccccacctctactaaaaatacaaaaattagccgggcgtggtagcgcatgcctgtaaccccagctactggggaggctgaggcaggagaatcgcttgaacctaggaggcggaggttgcagtgagccgagatggcgccactgcactccagcctgggcagcagagtgagactccatctcaaaaaaaaaaaaaaaaaaaaaagcatacagtaaataaaaaagcacaaaacagttttcacttattttacaattaaaaagtcagaagacttctgaagttacttatcttttaatacatgtatttaacaccatacttcatattattaaataggttttacttaaaaatataattattgtatttgtacctgtcagatataaatacttattcaggagttcacaggtacgaaaagatacacataaattttaggaacttttgagttatttctgtcatttttgcttttttctctttcttttcctaaattttatgtataagattacccctaaaaaaaaaaaaacagccagtattcagtgaattcaccagtaatttgaaatgcaccatattgtaaatgatccactgacagggaagccagcgtgttggagccatgccagccacctcagacaccgtggctctaagatgcggaagagtcactgcatcttcttgaatgttacagatttggtttgcctgaatgtgacttgacttctgttttgaaaaaacatacgaatagagttctattttccttatgtgatgctttcttctaacacactttaacacagaagcctaacctagctacaaagagcctatccacagacataggcaacagctccaaagggtatttcattgtgtcacctgcttctagatcatctgttagttaactgactttgtgcaaggtctcaccatgtatagcactgccttgcttgagcacggaagtttctgtcaacagcaagctttatgtgctctatcatttttattaaagtatttcagtcaatagtgacccattgtagaatggatgcaggattcacatgtgcaagtgctttgtgacctggcaccatttggttttggccaagcagcagagcagacctcaggacctaacgaggatggttgtgattaggtcaaatagaaaactagcaggccattgctgacaatttttactatataattagaggacttcctaaaatgctttaaaaaaaaatgtgtatggatggaaaatacaaaggaatttttcaaatactcaatttttattggtagtagttatcaagaacaaagtcctcggacttctgatgggaaatctgaactgctgtttctcttttagcgtacaagaagaaatagatccctctcattagcactttaatatcagtgtcacgtgtctggaaggaaattgtattcatttaggtaagcaacacactacataaatatcatagctgttagacccaggggactctcaggtgccagaattggggactcctttaattggaagggagctaaagggtctacctcctacctagaagtcctttctatgtggatatgaattaaattctcttgtctgttttgctctgatggggtctgtgtgggctagctggctctggtgtgtgcctgacgacagactgaactccttaaccatttcagacagcttgaagatgtatgatcattatttgaaaagggagagagggaggactctttgttttctccaccagtttggctcctgaggtttcttcagcgttaggtttctgtagggcccagctttctccagtgtttggctactgcaactctgtgttctgccagtctcttaactcagacagaaacaatgcaaaccagcagacagagcatcaccttgaaagtactaaaacagctgtcaatctagaaatctctgccccgcaaaaactgtcataaatactgcaagacccatgttcagatttccccccttttacaaataatgttttgttttatttcccagctactacaagtgatccaaatgttctttatagcagactttttcctgcagtctaggatccagtcagagatcttgcattaaattatatctctgtaatctttaatttcacgctatctgcaatgttttgtgtttttcatgacattgatgtttttgatgaggtcaggccatttattctgcagaatatctgtcaatttggattttttctaattgttctttcatgattagaatcaggcaaacattttttgacaagaatacatcagagacgactccgtggtgcatcagactgggggcatgtgatgtctgtgtgtcccattattggcgatgttcaattctgtcacttctgttgaggctgcatttgccagatttcagattaaggtacctttttccctttgtaaattaggatatcacctttgtggggtgccgttttgagactgcaaggatatcatcttcccgagtaggccttcatccatggcctcagcatccatgatggttcctgtccggatgctcacttttgaagaaacatttcaaataatagtgattcctttccaattcaaaagtaatcattgctttatagtcttcataaatattttctgtggttatttagttgatgaaagctgttgatgtccatttggatttttttccctccaacacaaacagctgcaggaattggtgccacatagaggctcagcttgcctgtctccatggaagctgtggccacagcagtggctttggaagcctagtaaggaatgacatcactgccaggtgcagtggctcacacctgtaatcccagcactttgggaggctgaggtgggtggatcacttgaggtcaggagttaaagaccagcctgatcaacatggtgaaaccccatctctactaaaaatacaaaaattagctgggtgtggtggtgcgtgcctgtagacccaactacttgggaggccgaggcaggagaatcactggaacccatgaggtagagcctacagtgagctgagatcatgccactgcactccagcctgggtgacagattctgtctcaaaaataaataaagaatgacatcactgaatacactgaatgtgctattgataaccagtgtgccagactccagacaacatgtgccaggcatcacccatgtctttgattttgtaataaataaaaaatggggccaggtgtggtggctcatgcctgtaatcccagtactttgggaggcccaggctgatggatcacctgaggtcaggagttcgagaccagcctggccaacatgatgaaaccccgtctctactaaaactacaaaaattagccgggcatggtggcgggtgcctgtattcccagctactggggaggctgaggcaggagaatcacatgaacccgggaggcggaggttgcagggagctgagatcgtgccactgcactccagcctgggcgacaagagcgagactccatctcaaaaacaaacaaaaaaggcaaaatccttggagaactcttactgtctctgtttccagaatcctagaattaaaactttcatttatcttcacaattttcccatagctttttcatgtctgtaaggatgataccctgaaatcttcttcttgagaagataaagaagggtcccctctgttacccctaccaaacggatgctcctcacgggcttgaggtggcagctcatctcagagcatgggatgatttttaaccaggtgagtggaaaggggcagtaataaacatttttaaaggttggggacacatgaagtcctcagggtgtaaagctggaaccagcctcctgtactgctcagctttcaggcctttggcccctagtcccttgggggtggcccctcccttctctgtgccataacagagtacccgtcaccccctgcctggaccactcctgcagcagaagaggagctcacgacctcctccggcagcacctctccttcctccctgcagagcccggctctcgtgctgagcaagcagcgttcccagctcccagacaggccccccagaagtcggcctttctgttcaaaagcttccagctgagcatctgcccattctcctgatccgtccaccaggatcacatttcaacagtgcacgtgggagcatttgtcttgatggcctctgagatcatcctggccccggagtccccaatgtggtttccctggagactagaagagtagggttaaggcagggctcaaagcctgcaggttctctttagtagagcaggccatacaatagaaaatgcaggaccccatgcaaagcctttgtgcttctaggatcccctcgctacatggacaaggctcagggtacctccccttagaccaggtttccctataggcctgctgaagcgtctgggggtcagctggctctcagaactgggcaaaaggcagtgcgccacctggaagcagttctaagggtgagcaggaagggcaggtgcactcacttgatatgctggagcctgtggtttccagacagtgctgtggcaatgcatatcgccccgtccatccccagagaattctcttgaagactaagtggaaaagagatggagacacacggtgagccatcagggcagaaggaaaacacccggggaagcaacagtgcattgtctgggggcagtaacccaggcagatgtgtccacaggtgccatggcaactccaggtgggagttgaccctggagacaggtgtctacgagtggccagattgtcccacgcaagtgcgctggaggatgtaaggccataaatgcaagatgtgagtgacttctgactgaagctaagcacactcaacaaacccagctgcagtggaatgtggactataataagtctgattgtttatattcagaaggaaatagctacagaagaaatcaggagcattttattccatcagggaggacccagcagagaactctgctgctccaggatgcaggtaggtccctccagccacttacttgagtctccggagacttgagtttaccttcagagcatttgccagggctttggctccagccaccccaatggcatttcctcttaagctgttgggaaagacaggaagcctaaggcatgggtacaggctgagaggtgatactgacccctctgcgggtgggcttggggctgcttggtagaggaaacaaggacttcagcagtcacaggaggccagggctgtgccttcctcactccagggcaacagggcagagctggctctgggaagcagggcacacaggggcatggctggcctagccaggagggttgttggagccttcctcctcttccatttcaaacagaaaagcggggctgagacaggagaggcagccctccatctgggcaggtccccagtgctcccagcaagggcaggaattctgaggacatgcctgagcctcagagctgtaacctcaccccaggactttggatctgcccagagaacaagatcagcccccctgggacccataaaccaggcctctagacgtgttcagcctggcaaggccaacccggagaggagggcaaatgatagcgactcccagggaaaggcatgaagtggggctgggaaactggtatacttgcactgaaatgaagatcaccaggatgatttgtgagttgtctgtaaactttgtccccatatctattcattgagaattcattgatttctttgggctaaagaccatagatggagactggaatacttactcgagaatctccaaggttctgttcacagccaaggcttcccctagcacctgggcgcctgaagcaccaattgaggccacctggagactggggcggagagggtgccgtcagtgtgagccggctgggcccacctccctccgcatactccgttccctttcaccaccccttgactcaggatggaaagtggagaaacagcactgagaatggttggccagcgctgtgtctaggcactccatctcctacctacactgtctgttgcctaagacagagatctggatgctaaggagatgagaaatagaggctgtccctggaagggctcggggagaatgctccctgtacctcctcattactactctctaggtgtttgagcccccaactgctaatatcatatttcctatattaggaaaatcaaacacaccttccttgacttgtaaacaaaaataacgtccaggccaggtgtggtggctcacacctgtaatcccagcactttgggaggctgaggtgggcagatcacctgaagtcaggagtttgagaccagcctggccaatatggtgaaaccccgtctctactaaaaatacaaaaattaggctgggtgtggtggtgcacgcctgttatcccaactactgtatgggaggctgaggcttgagaatcacttgaacccaggaggtggaggttacagttagctgagattatgtcactgcactccagcctgggtggcagagcaagactcttgtctcgaggaaaaaaaaaaaaaaaaagacctctaacgtgaaaggatggcgaagggaccggtttcctgactgctgcgcacatctaggacttactagagagcagtgagggctgtgttgaccttcagtgcacgggccaccgcacacgctccgtcatccccgatggcgttctcctgtaaactagacacagagtatgacccctttgggtgcacggggcacagggagcattctagcaaggccctgccgcacttggacctgccaggtttaaccgactacacacaccatagacactcccagggtttcctggggataactgcccttcctccacaggccctgcagcccgccgcctcatactaagcacacagaggcgtctggggcctgcatgagtctgaaccgccagaggcaagcaggaaatgggacatatagagtgactgtcagcaggggcttgggacccaaaaggggatgcttttcacagccaaccagaaaatgaacttaaagccctcaatccctgagccattcttgtttgtcttgttttctcttgagacagggtctcactctgccacccaggctggaatgcagtggtgagatcacggctcactgcagcctcaacctcccaggctcaagcgatcctcccacctcagcctcccgaggagactaaagtacttaactagagacggggactacaggcacatgcccccatgcccggctaatgtttttattcttttatagagatggggtctcactatgttgctcaggctggtcctgaactcctgggctcaagcagtcctcccaccttggcatcccaaattgctggcattacaggcaggagccaccacgcccaacctccttggccattcttgctaattagggctttgtgtcattttttccccttctaagttggagggaactagcaggccctggtgcagtgagtgactgagtttagctcaagcgcacactggtatgttcaaggccaagagctgtttgcattcattattttaacagacatttgagtgtggccgggcgcagtggctcacacctttaatcccagcactttgggaggctgaggtgggtggatcacttgaggtcaggagttcgagaccagcctggccaacatggtgaaaccccgtctccactaaaaatacgaaaattaggctgggtgggtgtatttttagtagagacagggttctctgtctctactaaattagctgggagtggtggagggcacctgtagtcccagctactggggaggctgatgcaggagaatcacttgaacccaggaggtggaggttgcagtaagccgagatcccgccactgcactccagcctgggcgacagagttagactccgtctcaaaaaattaaaatgaaaaaaaaaataagaaagacaacatttgagtgtgtctcatgtgctaggtgttgtataaggcagcaggcctgagtccccctctcgaagctcaggtgggaagacatgattaaatgagcaggtacaacaggccaagtgcaggctgcagggaaaagcaagcagcatctcccaccccagggtgtcaacagaaggctcccagaagaaataggtcaaaacccgaacccaaagtggggagtgtgcctggctcagctaaggaacccaaacgaattgaattcctggggaagtgagaaatgagtccagggagggacaaaggaagcagattttaggggtcccagaagccaccctgaggggctgtgtgtactttactctgcaggccctgggcaaccattcaaggatggcacccaagatgggacagagctgctctggaaaggtctctggccagcagtgtgagaggatggactgaggtggaggctaccacagggatggaggtgagtggtgccgatggcctgggcaggggcagtggacgcagagggaatcgagtggatggcagggacacagaggggaccgacccaacaggacttgacaatgaataggaagcaggaggtgggtaggcacagtgcctcacacctgtaatcctaggactttgggaggccaaggtgggaggatcgcttgagcccaggagttcaagactagcctgggcaacatggtgaggccccatctctttaaaaaaaattgtaaatattactttaaaaaataagttatatgctggatgtggtggtttgcacctgtaatcccagcactttgggaggccaaggtggaaggatcacttaaaggtcaggagttcgagaccagcctgaccaacatagtgaaaccccgtctctattaaaaaaaaaaaaaaaagctgggcgtggtgttgggcacctgtaatcccagctactcgggaggctaaggcaggagaatcgcttggacctgggaggcagaggttgcagtgagccgagatcacgcctctgcactccagcctgggcaacagagcgagactccatctcaaaaataaaataaaagttatagaaaaggaagtgggaggtgagagtgaaggtcttgtttctagcttgcacagttggttccattcacaagatggggagccaagaagcaggttttcaggagagagaatgcagggaccctgcacccgagcaagatcccgaagggaggtacagagggggtgtggacgcgcaggtctagggttgaggagagagggctgggacacggacgtgggagtcgttgggactttgaagatcactggagcccagggaaaggaaaagagctccaggaaaagagacgccaggcaagcgaagatgacataggacgatccctgaggagccctgcgcagaagagccaaacagaagaaaagaggacgaggcccagacagaggggacatcctggaagctgaaggagaagaaatggtcagggagaaaggccgatgaggctccaagggttaaacctagagttccctcacgccccagcgactccactcccaggtatatccagccaggagaaggaaagctcacgtccacacagaaactggtgcacaaaggtccacagcagcaccgttcctaacagccaagtaggaacaacccaacgtccgtcagctgatgaatggagaaatgaaacctgtgtacccatacaatggatatcattcagccttacaaaggaactaagtattgagacaggctacaatgtggatgaaccttgaaaatctgacaccaaatgaaagacaccagccacaaaaggccacgtgtcgtatgattctatttttggccacgtatcgcacaattccatttatatgcggtgtccagggtaggaagatcatggagatggtagattagtggttgccagggttgggggaaagggagaatgggtagtgagtgctaacggggtgatggaaatgttgtaaaattgattgtgatgattgcatcaccgaatacactagaaaccagtgaattgtatactaagtgggtggatcttctggcgtgaagattatatctcaatcaagctgtcatatatctatgtatatatgtgtatgtacatatatgtatgtgtatatatgtatatgtgtatatatgtgtgtgtatatgtgtgtgtgtgtatgtatatatatgtgtgtatatatatatattttttaacagggtctcactctgtcgcccaggctggagtgcagtgacgcgatctctgctcactgcaacctgtgcctcctgagtttaagcgattctcctgcctcagcctcccgagtagctgggattacaggcatgtgccaccatgcccggctaatttttgtatttatagtagagatgggatttcgccatgttggccaggctcatcttgaactcctgacacctcagatgatccacatgcctcagcctcccaaagtgctgggattacaggcgtgagccaacgcacccggccaatatatttaaaaggcagacaaggactgaaacatgccagctggccttagggaagaggagtgccaggggtcactggattgagcctctgcctgatgggtaccaggttttcagattcccctgtcctcaacagcccccgccctgcagcccctgggcaggccaacttactctaagctggtgaggctcctgttgagctgtagtgcttgtcccagggcctgggcagcgccggcctggatgaagttccactgcaggctgggcagacacagacacatgtgactatgtgactatgtgactatgtggccctggggcagagccaaggaggctctgatggcaggaggtggaatccctgcaggatgtggcaggagaattcctgcaacccctgcccagacttagttctcagagggtcacatgtactccctggttagccgtggccagagggccggggaataagccagaaaagacacctccaaatggcctctgcctggaggcccagctgtgaccacctcttaacacatgtctgtctgtgggtcaggagagcacaggatggggcacagtctgctggcagcaggctagcccgggcagcccctgagacctttgcagggggtgtccccaaaccaggtgtggcctgtgcatcgttggtttgggtggagcccggcagctctgcagaaggggaacagagcagggtggagagctgcagactcactgaagggaggtgagggtgcggttttctctcactgccactgcgatggcccgggcaccctggtcgtggaggaggttggctgtcaggctaggaggaagggaacaggagcaagtgagccgggggccggctgtgaagcctccggtccttggtcaccagggattccagggcttgataccagatcacccagccagcacgagggggtgcttcctggggatacgttgcccaatggcatggtaacatcctcatccatccccaccaggtgaagcagacggcgtcacactagcctcaccctcgtgcagtttacactatgagagtgggggacttgccacccgatgtcaggtctcctggctgcaccctccccagccagctccttctccaaccctgtgacgtggcgagggtgcccgtcagcccaggctcggtgtgggtgtggtcatggcatgaacagcctgtggagtcacaggcccccaccacgtactccaggttcttcagggtgctgttggcgcagagggcatgagcgatggcctgggctccctcgggactgatggagttttctcgaaggctgaaaaaaaaggaaagacctgagcttctgaccgggcagatgaggtgtctggcaaagccaagcccaggtgtttaggcttcttgaagcccaagaaactgcaggcgggggacctagagttctgcatagtctgggctgaggtgtgaaggagccagtgctagtgagccagtgctgggccagccaggtgcccccactttaggaccatccgcagtacagggagaggacaggatgacagggccccagaggtgcgaggggacaggtggctcagcgtgcatctgggaagggagcggcagaatgggccactgcgggcagcagctatcccctgcaccccaagagagcaggaaaagggccaggctgccaggaaggcttccccagccatagatttccctgagacaggcttcccagtgccaagtccctgcagacaggtgcctcgtcaaagaaacgccctgtttggagagggtggccaggacttacctgaggctgaggagggtctggttggtgcagagggcccccatcagtgctgccactcctgcgtcactgatggaattgctctgcaggctgcggaaagaggaggcgccctgggtgtggctgtcccaggacccagagggagctgccctgtcccagtctgggacagcaggcactgggctcaacagggagttgggggctccagggacagtggtggccacactgcttctcttctcatctctctttcctctcccagccccccaccttctagcctctgccaggtcagggcaggtgggttcagcacaacaaacccccaaatgtagaccctgccttgatgtgggtggccccagacagcctcagagcagggtgtgttgggtctgcagcccccagagggagtggcgcagcaggctccccaagtgtgggtgtagcgctgagctctcctttcccctaccaaagctgctgcagctgactccctctccagccacccatgctggcttctcaaggacacttggagctcatcattccaaacactccagaccctaccccagcccccactgtctagggaaatggagctggtggggcaggggctactgaggacagtgtgtgcccagggttagtgttggcagggaaatggccctgggggacagccatttttcaggactgccggcccactatctactggaaagagaacccagggggaatcgtcaccctggcaggtggactcactccaggctctccaggccctggttcaccttcagggcctcagccagggccttggcacctccatcaccaatactattactggagaacctgcaagagaagggatatggatgagccagcctctgggagctgccaggcagggctgggcagagggatcagagtcagggaagccctcctgggagggctggctctgttgtctcaagggtggccagtgcacagtttgttctgcctgaggcctgttggctgtagtctctgcaagtgaccacctgttgtctgtaagaaatcaggatagcaaagtccctcttgactccctggcaagaagggtcaacccttcagtgataagtattttggggggtttttgtgaagatggtcaggaaatgttttcttctgccagctgggaagacagtaaatgtgagcccgagaaggttggggttcacccagtcctgggaatctgagtctccattctcctcggttagtgcttttggagtccaaagtcagctaaccagcactcacacttccatccatctatccatccactcacttattgatttatctacttacccacccactcattcataaatccatccattcgtccatccatccacctactcacctacccacttacccattcatccatccactcatccatccacctacccatcagtccacttagctatcatttcgtctgtccatccactcatccacccatccatccatttgtccatccatccatccactcacctattctccactaattcattcagccatgcctccatccactcatctacccacccatccattcatctatccattcatccatccatccacccacccacccactcactcattcattcactcattcattctaccatccatctatccactcacccatccatccatccatccactcatccatttatccatccactcatccattcaaccatccatccattcacgtacccatccacctatccacccatccctctctacccacccatccacccatctattcacccattcaaccatccatttatctactctactcattcattcattcatccacatacccacccatccatccatccctccatctacccactcacccattcatccactcatttattcaaccatccatccatccatccacccatccaccaatccacccatcaatgcatccattcatccactcatccacccatccatccatccatccatccatccattcattcaaccatccatccatccattcaaccgtccatctatccatccatccttccattcactcattcatccactcagtcattcatctactcgttcattcaaccatccatccatccatccattcaccagtcctctcacccatccatccatccatccatccactcattcatttatccattcattcacccatccatccatccatccatccacctgcctacccatccaccactacccacccaaccatccatccacccacccatatactcatttaaccatccatccatctatccactcattcatccatcagtccactcatccatccatccgtccactcatcagtgtatcccttcattcatccatccatccatccatccatccatccatccatccatccatttacctagccacccatccacctagtcacccatccatccatccacccacccatccatccattcacctatccatcaatccatccatccatcctcaggctcacaaatatttgtgctgggttgggcattgtgctgggcactgaggatactagtgtgggcctttcatatgtctcacatgagctctttcagactcctgttctgcttcaagggcatctgccatccgctgggctcccatgggcccgatgctgttcttctgcaggctgtgggagaaaagagaggggtcctttagaaaggctggtcacagccattcccaggccaaggacggttcaggttcaaggtcagggacaactagtgtgccctctacatttattggagcaggtggggagggcgttctccagatgggtctttggattgttgcctaagtgataatggaccaacattatgatgagggatagtaaggggtcagggcagctgagcctcccttgcaaggagctagaaagcagagatcagtaggtgctgataatgcccagcaacctcccgaatggggacctccatggacaagtctctctggtgccttacctgcagtctgcctcccatctagaccagcaggctgcctccaaccctaagaaacctccctaggggccaggtacggtggctcatgcctgtgatcccagcaccttgggaggccaaggtgggcggatcacgatgttaacagatcgagactatcctggccaacatggtgaaactccgtctctactaaaaataaaaaaattagcggggcgtggtggcatacacctgtaatcccagcaacttgggaggctgaggcagaagaatcacttgaaccagggaggcggaggttgcagtgagccgagattacgccactgcactccaggcgggcaatagagcgagactccgtctcaaataaaaaagaaaaaagaaacctccctaggaagaccctggcttaggttcctcttctgaaaaagctgcttcctcttgtcctaaatctggtggagggagacagcacgggagaaaccctgtcctcatcctacaaggacaggcaggcaggacgtctcctgtgtgaggctaaatacaaatcctaaaaaatgtaattttccctggttccaaaaaggaaagagactccttaccaccctcattttctcagagcacttcctgagaaaacttgaggttgcaaatgctgcctctgtccctttaagatgtatgtaaatctttttaaaagcaaaatcagcctctggccactttcacagcctgggaatgtctttcataagggtttggagccatctctttgaaatgtaaacattaaggaacaaagagtccctccttccctgccttcgggaattaggctaggtatctggcttgaagctctaaagtacctgcgtgtcatagagataaaagctttacttttcctttggataaaagcaattagggaccacaaatggccactccaattatctgctgtatttaggataaacggcaaatggtgctgcctggccctcttgcctgaggacgagggtcctgtctgcttggctctagaaaagtgagctttctgtctttacagtctcattggtgggttgccccgatgcaccgtgcagtcagtttaatgtttatccaataattgttgtattctttcctacatctgtgggttggtagaaggtattttattttatattttattattttattttatattttaattttattttatattttaattttatttttttttgacagagtctcgctgtcgcccaggctggagtgcaatggcacgatctcagctcactgcaccctccgcctcccaggttcaagcgattctctcaacttagcctcccaagtagctgggactacaggcttgcaccaccatgcctggttaattttttttttttttttttagtagagacggtgttttactattttggcccggctggtctcaaactcctgacttcaagtgatccgcctgccttggcctcccaaagtgctgggattacaggcatgagtccctgcgcccagccaggaggttttatttttaattatttccccaacagctgctctctcgaaaagtaatgggcatcaggggccatccagatgggtcagaaggcctcaggtcctagccccatccattcttcctagcaggtaataggcagagaggcccttggaggaggagggagaagggagagaagggggagagaggagatgtgttcactcactgcagcatggagagggtccggttggaggccaaggcctcagccatggacctggcaccatcatccctaacggtgttgccctggaggctgcagagacaagaagaggctcatcactgatggagcagaagctggaacccaggggtctgaactctctctgcagtgggggcacctctgtggagcaaggggttctgaccactacgtgccctcaccgcccaccatgcagggagagcagtggaccctttgcaccactgcctggggcttaggtttttctttgagttgctaagcatttgcctgctggctgggaacaaggtgcttctgctctctgaataaccacaacaaagtcatcaattgccctcattacagctgaaagacacaggatccaagtgttggtgagaatacagagaaactgcaaccctcacgctgctggtgggaatgcaaaatggtccgctgtctgtggaatatggtctggcaggtccttaaaaggttaaacatgggttgaccatgtgacccagcaattccattcctaggtatatcctcaaaagaattgaaaacaggcactggaagtcgtattcaccaatgttcacagcaacgatattcatataaccaaaaggtggaaacaacccaaatggctgtcattaggtgaatggatcaacatatcatggtctgtccatcccgtggaatatgattcagccttaaaacagagggaagaggctgggtacagtggctcacacctgtaatcccagcactttgggaggccgaggtgggtggatcacttgaggtcagcaatttgagaccagcctggccaacatggtgaaaccccatctctactaaaaatacaaaaattagctgggtgtggtggcacatgcctgtaatcccagctactcgggaggctgagacaggagaagtgcttgaacctggaaggcagaggttgcagtgagctaagatcacgccactgcactccagtctgggtgacagagtcagactccgtctcaaaaaaaaaaaaaaaaaaagttaaaataaaatggaaggaagcattgacacatggtaccacacggatgaagcttaaaaacatcatgctcaatgaggaaagccgcacaccaaaggcgagcctatataaatctatttacatgaaatgtccagaataggtaaatccttagagatgggaagcagattggtgattgtgaggggctggggaaaggggagaatgggaagtgactgtttatgggtatgaggtctccttcaggggtgatgaaaatattctggaactggacagatgtgatggtggcacaacattgtgaatttgctcaatgccactgaactgtacactttaaaacagtcagggttttttttagacagagtctcgctctgtcgcccaggctggagtgcagtggcgcgatcttggctcactgcaacctccgcctcccgggctcaactcaacctcagcctcctgagtagctaggaccacaggcacctgtcaccatgcctggctaactttttgtacttttcttttcttttttttttttagtagatatgaggttttaccatgttggccaggctggtctcgaactcccgacctcaagtgatccacctgccttggcctcccaaagtgctgggattacaggcatcagcctctgggacccgcctaaaacagtcaattttatggtacatgaatttcaccctaataaaaataaataaataaataaataaataaataaataaataaataaataaatgaaaacagaacagaaaagtggtacccactcagctaagtatagatataaccacaggcttttaaaagagacataactggctgggctcggtgactcacacttgtaatcccagcactttgggaggccaaggcaggcagatggcttgagtgcaggagctcgagaccagcctggtcaaaatggtgaaagctcgtctctactaaaaatacaaaaaaattagccaggcgtggtggcaggagcctgtaatcccagctacttggaaggctgaggcaggagaatcgcttaaacccaggaggcagaggttgcagtgagacaagatctccagcctgggtgacaaagaaagaatccgtctcaaaaaaaaaaaaaaaaaaaaaaaaaaaaaaaaaaaagagacgtaacaaaccacatcacaactctgtcccctgctcaggccacacacacaggctcaagtctagggaagagctggaccctggaaacttgcgtagggcataagatccccagtacccaatgggatgggagccagtatcccatgcctgccatctttgtttgcttgcttgttgagagagtttcactctgtcacccaggctggagtgtagtggcgcgatctcaacttactgcaacctctgcttcccagactcaagcgattctcctaccttagcctcccgagttgctgggattacaggcacctgccaccacgccagctaatttttgttttttagtagagatgccatttcgccatgttggccaggctgctctcgagctcctgacctcaagcgatccacctgtctcagcctcccaaagggttgggattacagatgtgagccactgtgcccggccccatgcctgccattgtgaatcacctcccattctcataggtggtgcctgaggagagggttttctgggccctctcttggggtcacaacacagggagcaggtgacacacacctcagggaggtcagggtgcggttgatcttcaaagcgtctgccagcgccttggccccttgtggtccaatggagttaccgcggaggctgaaggaagagagaaagagacacctccttcatctgtctcccagagagggaaggggaaacagaaactgcattgaccttgaaattcgtgatcctctaagggaatgtgtaagggcttaggatctcatgtttggtggaaccagggcagagatccttatataaacaaggaaggagtttccccacgactgtctcaggtgttgggggaaagaaagcagcacctgatggactagtgggcttgggccaaatgtggagatgagaatgatggccccagatgcagggcaaacatctggtgtgtccctggctgtagcccggcaactgaggagccatggttcagcccggctgtccttctgccccaccaggaaggcatgtgcgctaaggtgtggcctccctgtgtcttattcccacaggagtcttagaacctgctccaaatgaagtatggatattatgtccagatgctacccaggggctgaatcatgggaatcagggaagaacagacaggtaagacccaagtcatttcctaggagggaggggacttcacaagatgcctcacaactcttctggttccaatggcaaaagttcggccttggttgtccttacttactccagagaggtcagacttctgttgaccaagagggatctggccagagctttggcccctttgttactgatctggttctccgccaagctgcccaaggaaagggagaggagtggttattttaggcatgcacatctcatggcctcttcctcaacgctgtgcccgtgattaatcctctaggctcccccacatcatcagggtctggacataggtggagatgaggtgacccctggagcagaatgccaggcacagcagagcccctgagcctgggcagcgtagggccagagtgggaggacagaccctcatcatggcaaagggtctcaggaaaaagtttaaccagaatccagcacaacagcttctacacaaacagcacagcaaagaaaatggaaatctcggaagcctaacatgcagatggcagccagtggtgtactggtaaactggctcccaggaaaaacaaaatttcaaaaactgggctgtgcgtggtggctcatgcctatacaatcccagcactttgggaggccaaggcgggagcatcacttgaaaccaggcgtttgagactagcctgggaaacatagggagatcttgtctccacgaaaaacataaaaattagtcaggtggcgcacctgtagtccaagctacttgggaggctgaggagggaggatttagcctagaaggttgaggctgcaatgagccatgatgacatcactgcgctccagcctgagcgacagagtgagaccatgtctcaaaacaacaacaaaacaaaaaacaaatgctagcaaactgatttgtagtatctgccactttccatggtataaatactcccagcaacaccaagttcaagcacctccaccttgcaaaattcctgaaaatttaacaatcagctttcgtgaactggtacaaacaaatttaggcacactactgatcctagcctcttttctagtgcaaaatggcaaatggtagagttatttaaaattaactttaaaattaaaaaaaaaccacacacacacacacacacacacacatcttgatttgcctcaaaagcatggttctgggaatatggtggtggatcaactcaatgttacttcatgtatccagctgcagaaatagtagctgtccaggctctttgccgtttgtaggcattcagccccatgggatatagtagttcaattagaatccccaggctggtgctcttctttttcttttttcagacaggatctcattctgtcacccaggctggagtgcagtggcatgatcatggctcactgtaactcgaactctcgagctcaagaatcctcccacttcagcctcccaagtaactgggaccagaggtgcacgccaccacacctggctagttttttaattttttgcagagacagggttttactttgttgccgaggctggtctcaaactcctgggctcaaacgatcctcctgccttggcctcccaaagtgctggaattacaggcatgagccaccgtgcccagcctggtacttttcaagctatattgaagcaaactgttcactggaataaagtctcttttctctaaattccttttcagagaacttcaattcacagcattcgtccaggccacctctgtataaatgttctcaaattctagagtgcttccatccctctgggacttttatggcattttataagttgtatttaacttctaggtgaaatagggatgtggcactgaggatcaactacagagagaggtaaagaagagcatgtggccagagaagagatttttggcttcattcagaataatttacttttatttttatttttagtaaagatggcatcttgccatatgtttgccaggttggtcttgaactcctggccttaaagaatctccccaccttccagattgctaggattataggaaggagccactgtgcctggcccccgaataatttctgagcactacctagtctgctttaagcaaaactaaaagttggctattttgtcatgtgctaaaaatgcaggaggcgctcacagaggaaaaaatattaataatgagaattgtcattcttttacttttctttttttttttctttttttttttttgagacggggtcttgctctgtcacctcggctggagtgcagtggcgcaatcttggctcactgcaacttctgcctcccagactcaagcagttctcctgcttcagcctcctgagtagcagggattacacacacccaccaccaccacgactggctaatttttgtattttttagtagagacagggttttgccagtttgaccaggctggtctcgaactcctgacctcaagtgattcacgggcctcagtctcccaaagtgctgggattaaaggcatgagccaccgcccctggcctagatatccttttaagcccatttttaccctcttaaggcacagaaatgacttcttcaaactcacacagagcctacacctctaaacatactccccagtgccttatttttgttactgaattagtgtaaattgccattaactcagataaagattacttcagaacccagaggcttgtatgagaatgaagaattacccctggccacagtggctcacacctgtaatcccagcactttgggaggctgaggcggatggatcacctgaggtcaggagtttgagaccagcctggccaataaagtaatatagtgaaaccctgtatcgactaaaaatacaaaaattagctgggtgtggtggcatgcgcctgtagtcccagctactcaggaggctgaggcaggagaattgcttgaacccgggaggcggagtctgcagtgagccaagatcgtgccactgcactccagcctgcccaacacagggagactccgtctcaaaacaaaaaaaaaaacaaaattagcccttgggttctcttctccaaactcacctccctaggtctgcaacagccaccctcagaggatcagtcacatcgattcaaccacaaaccccgagtgtgtgtagtttctcagatccaggaatgttattccaggagacgtttcataagcacacattcaccatgtgaacttttgtctaattacaagatgaaggtttttttgtttgttttgttcttttttgagacggagtctcactctgtcacccagactggagtgcagtggcgctggagtgcagtggtgcgatctcggctcactgcaacctctgcctcctgggttcacgccattctcctgcctcagcctcctgagtagctgggactacaggcgcccaccaccacgcccggctaattttttgtatttttagtagagacagggtttcaccgtgttagtcaggatggtctcgatttcctgacctcgtgatccacctgcttcggcctcccaaagtgctgggattacaggggtgagccaccacacccggccacaagatgcaattttaattaaaaattgtttaaattgatttaaaattaaatttgaaattaaattttaattaaattaaatttgaaatttaaaattttaattaaaaatgcaattggctgggtgcagtagctcacgccagtaatcccagcactttgggaggccaaggctggcggatcacaaggtcaggagttcgaggccagcctggttaacatggtgaaaccctgtctctactaaaaatacaaaaattagccaggtgtggtgggcccctctaatcccagctactcaggaggctggggttagagaactgcttgagcctgggaggcagagattacaatgagccgagatcatgccactacactccagctggggtgacaaagcaagactgtctgggggggataattataatcctgtgcctagaatgctgttggacagcaaacttggagaggtgcttagagaacattgtgcctggcattatgtcagcacacgtagtgctgtggaaacacctgcctgtgcacagcggtgtctagtcccgccaggtcacctccctcttcctactgatgaggcacctgagcctctagcactttctggaattgggcagaaacaagcaggctgcatctggagccacatgctccaaagacacttctccgtggcagcgccgctggccagctgagcagaggatgatgggaagagggttccataccccacaagaccataggcaccctggaggtcccctgggtctgtgttacctgatcttctgaatgcgacagtccttcccactcagcacgctgcccagcagctccatcacggggtcctggaactggttggtgtccagcctggccaaggggagcagtgacagtgagtgtcccacccgcccacgggcagggtgggggccctggcccggggcctctgcctctctccatcccatgcagcgctatcaccgcagctctgagatctgcgctcagccccagtgctcagacctttcccgtgagagtgaacaggaggctgggtgcccacgagacctgcggttcctgtgcagaacggcatcttccacgggctgtcgtcctcaccaccccacataccgcctgcctctgcgggacacctggatgaccctcagcctgtgtcctttcctccctactcactaaggtccagagtggcgggcaggggacaggctgaaagcattcagcgggtgtgcagcttctatcagactggatggttctgagggggttatgaattgaattgtgtccccacaaaagatatgaagtcctaaccccctgtgccccaagtatgtggctttattgagaaatggggtcactgtggatgtactttgttaaggtggggccatgctgaagtggggtgagcctgtaatccagtgtgacagtgtctttttaagacaagaaagcactggccaggtgcagtggctcaggcctgtaatcccagcaatttgggaggctggggtgggcgggtcacctgaggtcaggagtttgagagcagcctggccaacatggtgaaaccccgtctctactaaaaacacaaaaattagccaggcatgatggcgggcacctgtaatcccagctactagggaggctgaggcaggagaatcgcttgaacccaggaggcagcgtttgcagtgagctgagatcgcgccactgtattccagcctgggcgacagagcaagactccatctcaaaaaaaaagagaggacagcaccatgtggagacagacacagggagaagatgaccaggcgacgggagagactgaagtaacgcagccttaagccaagggttcccatcaaacactggaagctagagaggaaggaaagaacctctcctatatgtttcagagagcgcatggccctcctggcaccttgatttgagacttctggcctccagaactgcgagaaaacacactttagttgttttaagccaccaagttcatggtcctctgttacggcagccctaggagactgacagagaagcttggtggtggggaggggacggcttctgctctctcctctgccccttccccagcccctgccccctgccctggtatccacctgagcttccggcagtagagcagctggggcagcaggctctgaaggacgccctggctgaggctcagggacaggttggcctcctgggcacaggcgtcggacacctgcaggaggtaggccagggcagcgcggtgcgcgggaccagtcagcctggccagggccccgctctccatggcctcctccacgctgcgggccagctcggtgtgctgcagctcatgcaggcagtgcaacacgttgatggcccgtgcacagactgcggcatcggggcgcaggcagccctgcaggagctcagccacctgggtccggtaggcctggtgctcgccttgggccagcagggagccggccaggagggcattgaccctcggagacaagaggccggagaggaagcgcaggaacacgtccagcctcccgtcctctgcctgcatggcccgctgggctgcgctcctgaaatgcgtgaggaagcccagcctgggccaggatacgccgctctcagtgaagaggtcgaagatggccctcctggatgcgccatagtaatacgcggctgccacaaactcctgcagggacaggtgggtgaagcagtaggccactgacgatgccaacgtctcctctctctgcaggaagcagctgcacggggcgccctgcagcagagcgaggtctacaccaaacgccttcatgtcttgctcgtaaaacacgtatttcttcttgagcagcccatggaaggccagacggcccaatgtccccaccatcttgcggccaccatgggccacctgctcgatgcgagggcttgccttgcccttctcctgcccctccccgctgagggccatcctaaagtaccatgagtagagctcgcacagggtcctcgggggccacagctctgcatcctggggccccgtcctgctgcgccacaggtggcctagcgccatccccgtgagcctgcagaaggctgggacggtgcacatcaggtacagggccctgtcagcctgcacttggctcagcatccagcccagaagggcctggtcctcggggaacatctgctccaaacacaccttgatctcctcctcgttaaagccccggatctccgtcatccggtccaccaggccccctgggatctggccagatgcactgggacgggaggtgatccagatggaaacttccggaaagaggttgccacggatgatgttggtgatcaggtggtccaccgggatctccttctttgggtccgtgcaggccacggtgttggagaagtccagaggcgtcctgcactcatccaagccgtccaggatcaggagggccctggctgggactgccaccgccaggctgggctccccgacgtgcgggaagaccgagcagatgagtcggtcggcacacagcttctcgtgggtgttgagatcccggaaggtcagaggcagcaccagcgagaagtccttgccgacctgcccatgggcccagaggcggacgaagtgcctcaccagggtggtcttgcccatgccggccaccccgatagtgatggagacccggggtgggacagacacccgggagagaggcaggaagagccggtccagggcgacggtcctggcggggtgcccgcccccgcgggtggcctccacctgtgtgaagtcgtgttccctcagctgcaggtccgtcaggccctccaccagcaggagggaggccagcctgtgccagggtccgcccagctccgggccacctcccaccttgctcagcagggccttgcggtgcctctgtatccttgagtctgcgggacagaggccagtggggaggtctggtaagggaagagtgggcacaatcagcccaggtgttccccaccccgcgtctgcctcccaagccggtcctaccattgctgcagggccccagcggggcatccggtgtcctatccagggcctgcggggcctgggagccttgactgcccttcccagccagcagatccatgagggctttcacctgctcggctggggagcccgtaccgtggccctggccggcctccctgcccgtccgcacctcttgcttcctcatggagtcggggatcacctccaggagctgtgaagagagggcctgaacctgctgcctgccgtgccccccatccagcagcctgggacaggtgagcaagtccccaggaacggggtcagggatcccctcttcctctttcctcagcctttgggtggcccactggcctggcctctgagaatggactggaagggccatttgttcctgggtggtagcaatgatcacacgaatgcaggggcccagtggatgataactggggccctgagcttgtaccccggccctgccacttaccagataggtgactgagggcaggctgagtcacctctctgcgccttggtgtcttcatttgtgacctggaaatgatgatgaggttacaagtaagtttgctcaaaaggagggaggaatgaaagaaggtactctgttggaacatgtgggaaaaagcaaaaaaaaaaaaaaaaaaaaaaaaaaaaggcagcagcagccactctggggacgctacactgtgtgattctgactaacattctggaaaaggcaaaagtatggagacaggaagacagtgaaagaaagggtcagtgggggccaagggttggggaggaggggtgaatcggtggaacacagacaattcctagggcagtaacatgactctgtagggtactacagtggtgggtccatgtcattatcattatacatttgtccagacccacagaacgtacaactccaagagtgagcccatggctgggcacagtgactcacacctttaatcccaacactttgggagcctgaggtgatggatcgcttgagcccaggagtttgagaccagcttgggcaacatagtgagaacccatctctaaaattttttaaaaattagcctggtatggggtgtgtgccagtagtcccagctacttgggaggccaaggcagcaggatcgcttgagcccaggaggtcaaagctgcagtgagccatgatcacaccacggcactccagcctgggtgacagagcaagaccccatctctaagaaaaacaaaataaaacaaaaaacttaactcttcttgctcctgagttagagcaaaaagcaaaaaaaaaaaaaaaaaaaaaaaaaaagaatgagccagagtatacactatggacattgggtgatggcgacatgtccgtgtaggtttactgattataatcaatggaccactgtggcaggggacggtgatagtgacagagtctgggtgggggcaggcatggggtgtatgggaagtctctgtactttcccatcaatttttctgtaaacctggccagacgcggtggctcatgtctgtaagcccagcactttgggaggtcgaggcgggcagatcacttgaggtcaggaatttgagaccagcctggccgatatggtgagaccctgtctctactgaaaatacaaaaattagccggggagggtggctcgcgcctgtaatcccagcactttgggaggacgaagtgggcagatcacctgaggtcaggagttcaagaccagcctgaccaacatggagaaaccccatctctattaaatatacaaaattagccaagtgtggcagcacatgcctgtaatcccagctactcaggaggctgaggcaggagaatcacttgaacccgggaggcagaggttgcagtaagctgagatcatgccattgcactgtagcctgggcaacaagaacgaaactccgtataaaaaaaaaaaaaaaaattagccaggcgtggtggctggtgcctgtaatcccagctactcaggaggctgaggcaggacaatcacttgaacctggaaggtagaggctgcaatgagctgagattgcgccactgcactccagtcggaggggaagagcgagactccgtaagcctaaaattgctttacaaggaaaagcttattaattaaaaaaaggaaataaaagatagaagaaggaggagtcaaaaaggagaaaacgctggttctcagagcggctgtttttcttactatgttcctggggtctcctgggagtgcaggagctcctgggctcccagcagtgctgtttgccctctgctcgtggggattgtgatgcagagatgctgagaggcaaagccaaggccccccactcccatttgcctccttgttgccaaggctggttgtccccccgcccccacagccctcccacacccaagctgtacactaaggccgggaactcgcccccacccaccctgctcgcctcctcaccgtgcaccctggccacagcagcccctccagtggggccccaggaactcaatggatggggctcagccttccgttgtccacagttctaggagaaaaaacacaatgtggccagcagaggtgatggctcactgctgctgatggcagccctgcattcaaaaataacaccaggtgttgtcactgcatagagaagcaggttggaccccacctgtccacagggcatttccctggttctcaatgtttagcttgctgttaggctgggcggtgtggctcacgcctgtaatcccagcattttgggaggctgaggcaggcggatcacctgaggttaggagttcaagaccagcctggccaacatggtgcaaccccatctctactaataatacaaatgagctgggcatggtggtgggcgcctgtaatcccaggtactcgagaggctgaggcaggagaattgcttgaccctggaaggcagaggttgcagtgagctgagatcacgccactgcactccagcctgggcaacagagcgagactccatctcaaaaaaaaaaaaaaaaaaaaaagcttgctgtctgcagccctgggattcagcaggctccctggccttggattagcagtggggagcctagctttttctttctttcttttttttttgagacggagtctgctgtgttgcccaggctggagtgcaatggcgtgatctcagctcactgaaacttctgcctcccaggttcaagcaattctcctgcctcagcctcccaagtatctgggattacaggcacatgccaccacacctggctaatttttgtaattttagtagaagcagggtttcaccttgctcaccgggctggtcttgaactcttgaccttgtgatctgcccacctcagccgagcctagcattttaacacaggtgatgctttttatctggaaaatgataaaagaagcttagcaataagtaaatagtaaagtaaaaataagtaaaacagtaaagtaaaaataagtaaaataccatttttcaggcattcaggtcatggtgttgaagaagtaaggagtgcgatcaatttgaggttgctggcacccaggccagctgaactaacctggaacattaggaacaggccagggcaaggccagtctccttatgctgccccaaagcctgttcttttattcttctaaatgtcaaaaccaagagggataaaaaatatgggattttgggctaggcacagtggctcatgcttgtcattccagcactttgggaggctgaggtaggaggatcacttgagcccaggagtttgagaccagcctgggcaaagtagtgagaccgtagctctacaaaataaaaattaaaaattagccaggcatggtggttcacgcctgtagtcccagctactcagtaggctgaggtgagaggactgcttgagcctgggaggttgaggctgcaatgagcagagattgcaccattgcactccagcctgggcaacagagtgagaccctgtcttaggagaaaaaaaaagatgggatttgaattgacattgcctcatgtgtatgggtccatgtgggtaatttgaggtccttctttagatccttctgtaaaactttatattttttctcatctcggtcttgccagttccttatttgtatctaggtatttttaaaaacagtttttgtcgtatgatgaatattgttggtataaaagatgattgatttttattttattgcatgtctcatcaacatattaaatattcacattggttttcatcattttccagttaattttcttcaggttttcaaattacttcagcaaggctgggcgtggtggctcacacctataatcccagcactttgggaggccaaggtgggcagatcacttgaggtcaggagttcgagaccagcctggccaacatggcggaaccccatctctactaaaaatacaaaagttagctgggtgtgatggcgtgtgcctgtaatcccagctattggggacactgaggttggagaatcgcttgaacccgagaggaggaggttgcagtgaggcgaaaacgcaccactgcactccagccggggtgacagagagagacaccatctcaaaaaaaaaaaaaaattcttcagcaagaagaatttttatctctttatttctgaaaaccatatatatatatatatatatatattattttttttttttttttttttttttgaggtggagtctcgcactgtcacccaggctggagtgcagtggcacgatctcactgtagcctctacctcccatgttcaagtgattctcctgccttagcctccccagtagctgggattacaggcacgcaccaccatgcctggctaatttttgtattttagtagagatggggtttcaccatgttgaccagactggtcttgaactcctgacctcaagtgatccacccgttttggcctcccaaagtgctcggattgtaggtgtgagccaccgtgcccagcccaaaaactataactcttattttgaacaattttaccacattggccaggcctaccccttccttggagcaataaggttgttgcaggccttcttgttttactctagactagaccaggagtggttcttgcccaaactgttaggtgtgatgtttgtgacagatttctagttttcttctccgatagagaaagatttattttgttctattaccattcaaatactattatgtaatatttactgaaggcatactgtgttctgcatattctgttaagcactgtatttccataatttatttctcataactctcaataccattatttctcccattttacagatgaagacactgaggctcagagaggttaagtgacttgtccaaggatacacagctgggaagtgggagttgggatagaaatcaattcctcactgacaccagtgcgtgtgctgtataatctactgcctcttaaggtagtttacactttttttttttgagacagagtctcaactcctgacctcaagtgatccacccacctcagcctcccaaagtgctgagattacaggtgtgagctgccgtgcctgggcaaaattttttaagataaggaatatctgttaaattagcaaattactttttagcatatattgatataaacatatgatttatttctcttcatttattcaaccagcaaatatttatggagagcctgttgtatgttctaggccctggggatgtgaaggtgaccaagttagatcaagtccttgacctgcggtttgacgggtaagggataatggcaatggaaaggaaaacaagtcaataagcaaggcagtttctgctggtggttagtgctgtgagtggaataaactgtgagtgacaaagaagcctggaattctagggggaggaggagcagaggtggtaattggcggctggggaaggctgctgtgagaggcctctgagaaaaagctacctaggagtagagagggtgagaaagagtcatgcagagagctaggggagggacatttcaggccaaggaaacagcaagtgcttagaggaaatgttgctggaacatggtaagtgagcaagtggcaccaccccctcagggctggaaaagccagtcaccgttgttgtaaggagtttggatttgttctaagtatggaggggagccactggggggagtgacatgagcaatggatatcagatctctcctggaatccatgagctacactaaatgattttctgatattgaaccaaccttgcattctagaatacagtcttccatttgtattattaaatagaagatgtatatattccatatatgtaaaaaatgtgtgggctagcacaagaatagatacataagtcaacagaataggatatagaggccaggaacaaatatatatttataatatctacacattaaggagtttggtaacatgacaaaaatagcatttcaaatcagtgaaaatggcattggggcaattgaccagcctatgaaaaatattttccagctgtaattcacattaaacacaaaatttattttcaggtcaattaaggagttaaaagttgtaaacacaaaaccataaaagcacaataagaaaatatgagataatattttaaaatattatttaggtaaaggttttttacagtgagacgtaaaactcagaagtgtcagcctgggcaacatagtgacacaccatctctacaaaaaaaaaaaaatagatggggctggtggtgggcacctgtggaactagctatggggaggctgaggtaggaggaccccttgagctcaggaggctgaggctgcagtgagctatgattgtgccactgcaatccagcttgggtgacagagcaagaccctggctttaaaaaaaaaaaaaaaaagcagaattcatgaagagggagactagtaaatttgtcttaattgaattaaaatattaaataattaaatatttagtttgatattaaataattaaaatatttgccaggcgtggtggctcacgcctgtaatcccagcactttgggaggctgaggcgggtggatcacaaggtcaagagatcaagaccagcctggccaacatggtgaaaccccatctctactaaaaatacaaaaattagctgggcgtggtggcacgtgcctgtagtcccggctactcgggaggctgaggcaggagaatcgcttgaacccgggaggcagaggttgcagtgagccaagatggcgccactgcactccagcctgggtgacagagcgagactccatctcaaaaaataataataataattaaaatatttataagtaataatagatgccataaagttgaaagaaaaactataagccaggagtcaacatttgcaacatacatggaaaaatatgaatatccttaatatataaagaacttataaatcaataataagtaaccaaacagaattatgaaccccaaatgaaatagaaaaaaggacacagataattcatagaagtataaatgaccaagatattgaaaagatgctcagtgtcactaaggatcaagaaaaaagcaaaagaataaactatcatttttcatacgtctcattggtgaatattataacataacagactgcattggtgagaacatggaggtagtgggaaattttttttttttttgagacaggatctcactgtgtcacccaggctggagtgcagtggcatgatcagggttcactgcagcctcaacttccctgggctcaagtgatcctccaaagtagctgggactacaggcgcatgctaccacatccagctaatttttgtattttttgtagagacagggtcttgccatgttgcctaggctggtctccaacttctggggtcaagcaatcttcccaccttggcctcccaaagtgctggaattattggcatgagccactgtgccaggcctgtagtgggaatcttaattcatagtgggtggaagtataaattagtataacaattctggattataataaccattatctgttgtcattaaatatcttttgtcctagaaattccacttctgggaatttatcctaaagaaatatgtgggccaggcgcggtgactcacacctgtaatcctagcactttgggaggccaaggcaggcagatcatctgaggtcaggggttcgagaccagtctggccaacatggtgaaaccccgtctctactaaaaatacaaaaattagctgggcatggtggtgggtgaccgtaatcccagctactcaggaggctgaggcagggaattgcttgaacccaggaggtggaggttgcagtgagccgagatggtgccactgcactctagcctgggcgatagagcaagactctatctcaaaaaaaaaaaaaaaaaaaaatcaaatatctaggaataaatctagcaaaatttgcaagacctctatactgaaaactataaaacattactgagagaaattaaaaaacatcaaaaggagggatggaggctgggcaccatggctcacccctgtaatcccagcactttaggaggccaaggtgggtggattgcttgagcccgggagtttgagaccagcctgagcaacatgggcaaaaccctgtctctataaaaagtacaaaaaaaaaaaaattagctgagcacggtggcgcatgcctgtaatcccagctactcaaggaagctgaggtgggaggatcgcttaactcccgccgtcaaggctgcagttagctgagatctcactactccactccagcctgagtgatagagcaagaccctgtctcacacacacacacaaaagctagcaattatctaaacattcaaaggtatgtcagcccaaatgaagcagtgctactgtctgcctgatatgccagaggccaggatacggggtcctctgtccttcactgtgtgacattagggtgtggcccaggtggacacagcctcctgttgttggatgtccatgtgcacccaccaggtgaccagccctgctgctgggggcgggagtggccaggaggatgagaggactgcgtggaagaagtctcagctctggtagggcatcatttggggtcttattgattgattgatttaaaattttggtaaaatacacataacacaaaatttaccattttaaccattttaaaaataattttccttaaaaaatagaggcagggtcttgctttgtcgctaaaaaataaagacagggtcctgctttgttgcccaggctggagtgcagtggtacgatcttggctcactgcagcctcgacctcctgggctcaagtgattctcccacctcagcctcccaagtagctgggattacaggtacaggtgaggaccaccatgcttggcccattgtaaccattttatctttttttttttttttttttttttttttttttttgagatagagtctcactctgttgcctaggctggagtgtcgtggcactatctcgtctcactgcaacctctgcctcctgggttcaagtgattctcccgcctcagggtcctcagtaactgggattataggcacccaccatcaataccatttgtatttttgtagagacagggtttcaccatgttggccaggctggtcttgaactcctgacctccaaaagtgctgggattacaggtgtgaaccactgcgcccggccttgtggagcacggcttttaaataaccaacgctcggcctgaccacccagagatttgattggtctggcaagggcccccacgtggatctagtttaagctcctccggtggttctaaccagagttgagaaccacgggacccgagcggggctgggagaggaatgagggagggacagtgctggcaggagtgaggggttggggcgaggcaggactcacaagcgcctgggaaggcggggacggggtgtagggggctggcaagcacccctgcctctgtggcctcattagtctctcagtattgggagtcagcactccctcctgatcagacacccatctttgtggccccatgaccttgggtccagggttgccagattcagcaaattaaaatacaagacaaacctgggcacagtggctcatgcctgtaatcctagcactttgggaggctgaggtgggcagatcaccttgaggtcaggagttcaagaccagcctgaccaacatggcgaaaccccatctctacgaaaaatacaaacattagctgggcgtggtggtggatgtctgtagtcccagctactctggaggctgaggcaggagaatcgcctgaactcaggaggtggaggctgcagtgagccaagatcacgccactgcactccagcctgggtgacagagcgagactgtctcaaaaaataatgataaaatatgagatatccacagataattaaatttcagataaacgacatataatttttagtataagcatagcttatgtcatactggagacataccaaagaaatggattatttgaaattcacatttgaccaagtgtcctgtatctgatctggcatccctgctcaggccccattcagacgaaacgtggctttcatcctggacactgtccctaagaaggacagaggagggggtgcaggtgaaccaacccccctgccattgccagcacctcccaggaccagccccaaaggctgatgggggctggttacctggctgccaccgctgccaggccctgcacgcagccctaacatccccctggcaggctggagccttccacagacctctcagccgagtgaggtcgcgaggccgcagacgccactatggatggtcaggcggcccctgtgagcgcagctgaaagacagagagactgaggacaggtgggactcgggttgctttgggggatctgaaggccagaggtcgctccacagctggtttgagctgctgcgagcagggcgaggccagagggacgagtaggtgccactgctgcctcctccccgggagcctcccaggtagcaccaggtttcacccctagagctttgtctgtgagcgaaggtgaacctgaggccttcctggtgtggtgtgggctcaagcccagttcctcaggctcagcaagtggcctgctgcctcattcctgagaagcctcagtcccgacggactagccgcctctgcccatcacccgcccacctgatctgtgcctcagtccttgccgggacctgctgggtccttccctgccacttggcgcccgggtgggacttcccagtgctggctgcctacctgggctgccagtatctcccaccacggctgcttggatgctcctctcttcccacatcctgcccctgccccctcccagggccttggaattcaggactcggttctctcgaggtggccccagcatcatcacttgagctcaaaagccttcccgaaggaagaaggaagtggcacctgcacctcagggccctaccctgctcactgcatggacccctggagtccaaggggtggagaggcccagccctggggagcccagcaccctgggacagaagaagaggggtgcagcctgcagcctgtgatggccaacagtgagccccaggctcagggtcacctccagggaggggtccagaaaaacaccagggcctctggagcctggccataggggaagaccctgcagccaacacccaggctggcccagggcagtggcacttcttccgagaaggcctctgcggttgccgtctctctcgacccttgtctcacccaaggctgtgggcaggagaggccctggggctgcccactcgcctgggggcggcgcctgcaccctccctgcccctcatgacctcgcccctcctgtgctgtcacctccatctacaggtggggtgctgaggcccagagaagtagcctcccatggggggtcccagtgccaggaagggtgcccaggtctgccgattccccaggccgtggctcagcatcaccactgcctgcccgcagcaccttcaagatgcttcctgcttctcctgggccatcactggtacctgggggagctgggttttgtccctgggacctgtcctgggccattcttagttacctgttttttcttttcttttttgttttgttttgttttgttttggagacagtctcgctttgtcacccaggattgagtgcagtggctcgatctcggctcactgcaacctacgcctcccgggttcaagcggttctcctgcctcagcctcccgactagctgggtgggattacaggcgtctgccaacatgcctggctaatttattttttatttttagtagagatggggtttcaccatgttggccaggctagtctcaaagtcctgacctcaagtgatccgcccaccttggcctcccaaagtgttgggattacaggcgtgagccaccgtgcctggccacatctcttttttctacagcatgagccagtcctgccccaggagacagcttcttggagtctcgtggagtctccccagtccccctccccagagtagctcaggccttaaggccactgtccttcctgccagcatcccttctccctcccctgccctgcactgaggtcacctggacccaacttacctcccgggcctcgatgctgctccagggacagcaagactggggggcctgggggcgtccatctccatgctcctgggctcagccctgctccagctgcgtggtggtagatgccctgggaatccctgtgccagcctgagttctcaggaccagggatcagggcacttaccacgccaaccaaccaaccgtgtgggggccgagagcagtgcagccccgaccttctgcagccccaccgagcccaccggctgtccctgtggctccgggtcctcacctcttcctgtgctgggctccacctcattcttccttcctgtctgatttcaacagccaacagcctcgcagacacatcgaggagccggggcaccctggcttggtcaccgcccccgtgcaagttaagtgcgggggcgatgctgggggtcttgactctgggattaagtgtccctgcaggtggcatgctcaggataaagtggctggtgccaaggctgttgacacatcacctccatcccgccacaaaggaagctgccccgccatcaacaaatgcttgttttcaggcgggtggtcaggaaatcaagtgagcagcctgaggtcacgcaactagagggtgaccccagcaggactggactgtgccctgccacctccaggccacccctgtggctctccttatttatttatttaatttatttatttgagacagagtctcgctctgttgcccaggctggagtgcaatggcacgatctcggctcactgcaacctccccctcccaggttcaagagattctcctgcctcagcctcctgagtagctgggattacgggcatgcgccaccatgccccgctaatttttgtatttttagcagaggaggggctttgccatgttggccaggctggtcttgaacgcctgacctcaggtgatccacccaccttggcttcccaaaggggtgggattacaggcgtgagccactgcgcccagcctatttattttttgagacaggatcttgctctgtcacccagactggagtgcagtggtgtgatctcggctcactgtagcctctacctcctggggctcaagtgatcctcctgccttggcctcccaaaacacggagataacaggtgtgagccactgtgctccctcttttaacacctcttgctttcttttctctctgtcacccagtaggcacctctgactcagctgtgccccataacatcttcctgtgagcaaagggctccccagaggcaggtcacctgtaccctaagaggaaacagcagaatgttgccgtccgcggcaggagatcgcactcggcccctggaagtggacctcagtgggtggcctgccctgacagggaagggcgtgagggggaaggacatggcccagagcaagccacatgagaaaaattacaataaagtatgggacatccgctggggacagggagcaagcaacatggggccactgagggaaggaggtgacaaggtgggagccaagggacaggggtcctggggtctgaattttcctcagcaagcaagtgggagccagcaatggttgtagagcaggagagtagtgggtctggactcatagagcagcttgtggctcaggggaggtaggagggttagctggttccccagagcctgtgtgggtgatgggggggagggaactgaggcagcagaccagaagtgctcctgcacattcccctgcctgcctaccttcttttgtccctccttcctctccctccctcccaacaatgctttctgagcacccaggaacctgctgggtgctgggaggacacgatggaccctcgagaaggctgcccgaggctccaggcaggcagagtgcagacccagcagctgcagcctcggctgtggggagcaacaaaggcgcctgaaaccaggccgcccacaggatgttggaaaccacagggcccggtgggtatccgtcacataaaaggggccagaggctcacactgcctccctttgtggctcagggggatggatgcggagcctgagaggacacagcctcatccacgggatcttggggagcagcccaacccagcccagcccagccccgccccgccccgccccgcccgttcctccccctcgcaggaatgtccatcagtccacacagggctggtcccattccccactctgcccgctctgctgagaaccaggtgggccgtcctcctggctcctggtggaggtgggggtgctgggctgggggctccctaactgttctcactctggggctttctgtccacccagagctggggtcagccagacaggaagcgacctcagcccttcctaactcagcaacagcgcaaggcccctgcctgcaggctctttctttgtaagtgcccttgcctgggcccaggctggggtgtggctcccctgtgactgccttgaggggctgtgcccaagccatgccaggttggggccaccaaaagtgggacaggcctggaggcctgttcatattacagtgaggcatagacagacccgttttctgatttagttgttaccagtgaaagttctgctgccagtcttttattctccccctttagaaatgtttttaatattgttttcaaaatagagacttggccttactatgttgcccaggctggtctcaaactcctgggctcaagtgatcctcctgccttggcctcccaaagcactgggattacatgtgggagccaccgcacccggcatgccagcttccttctcagtcactcctggaaggtaactctctctcgccttgtccatgaagaggccccattgcctgccagtcttgctgcaggcgctgtgagaaggcattttccatctgtcaactggacctagttttatgttgcccgggtcagcgtcatccctgtagcaggggccaggtctactcctggatgccaccacgcctctgtgggttcctgcagtgactccttcaaccctttccctctggaggaatcagctgcttcacagcttgtttcaggacaaggaaatgctgctttgtacaggttcagggccagcatccagtcccctggctgggtggcagtgcataaaccaagcctctgcccagcgctgtcagcccagggagcgtccagcagccccaactgaatccaaggtcaccacaaggctcgaatccagtccccaggccatgcctcccctggccttgggctcacactgcactcaaggctcctaacccagcttgttaactacttggaacccctcccccaacccatctttaccagccttgaagttctgaactttcaagtcatggcacataacacatacttccccaaaccacaaaccctgcgaggccggacaggggccccgagtcccccacctgcaccactccctctcgcttccctaacaccagggagggggatcagcccatcaaggaagcagtgcgtgatgccttccgaaacaggccagaggccagcctcagattgatcacagctgatctcagcctctcaaattgttcgccccgggcaccgtaagctgggaggcctgggcctctccgctggttcacgtgccaggacatagtatgtgcgccagaaatcacatttcaccccctaaatgctgctgagccctaagatgcagctcacaaacccctcttctgggaggctgtccctgacacggcccttcaagccactggagcccgactccccaccaggctgggataggccagcgtctgtctcctccactggaccggacgcaatggtaaaggcatgtgctgtcttggtgagttgtggggtggggcctgaatctgcttttgtagcaactcccggctgaggcagcagctgggggtgcttgggccccactttgaggtgcgggggctggagcttggcacccagccagggctctgttggatacgggtgtgtggattaatggatgaacatctgcatctctggtctgggaactgaaatgaggagacagcaggcccaggttactccaaagtaaagggcaggtgcaaggtggggacttctgcaggcgtggggcacgggctgaggggccacggtgcctccaggtcccccgtttcgctcgtggtctccctggagtgtggcagccagattttaataaagcctttttggtttattgcacatcatataaaactgactgcactgtatttgaaacagacgaggacattcacaaggatggagaaaccaaggtttccttctttcctggccctcatcttcctccacactgctcctgaggctggaggcagctttaacccaaagaatggaatccgctagtgaacatgtttgttttgtggtggcatcagagttgttctgggcccttgtgcactgtccagtttggagactgctggtaacaatgacaagtgtccgggtagcacggctgggtcaggagaactgcatctgggctgtggcagtgcagggagcctcaggacacctggtctcaggctggcggtggctggggttggcctgagtgctgaggaggacgggcccgggctgccggggcaggctggacctgacgtccatctcaggacagacatgtagggcagctgtgcccaggactggtgggctcagagggtggcaaatgtggcagaataggccatgccctggccagctggtgatggcccactgccccctgggacagctgagggccctcttgggttaagggagacacactgggccgggcgcagtggctggcgcctgtgatcccagcactttgggaggccgcagcaggcggattgcctgagctctggagtttgtgaccagcctgagcaacatggtgaaaccccgtttctactaaaatataaaaaatcagctgggcgtggcagcgtgtgcctgtagtcccagctatctgggaggctgaggcaggagaattgcttgaacccgggaggcggaggttgcagtgagccgagattgtgccactgcactccagcctaggtgacacagcacgactgtctcaaaaagaaaaaaaaaaagaaaaccaaaaagggagacacactgtgagcacggacagaggaaggggctggagtctgtaaatccagtgggtgacatgctccaaatgccaccctagaaagcagagcccagaggaggaagccctggattgggctgtggtcatcatcacagcgcagagctgatgtggtccccaggcccagaaatgcctgtggaggcctgacccacgctgggtgtcccaggtcctccctgcaaatggcgggggtgggggctgctgatggcaggttggggtggggtcgggatggccccatcagttccgctccaccttcttcttgccccgaggctgccgcctcctgccctggagcttctccctgcgggtggcggcagtggtgaaggtgatacagtgggtgtccaggaagtccaacagcctgcgcgaggacacacggaggccgttctgcctcagctctgcctgcagctcccgcagctcaaagggctggtacagcagcaccttctggtacagggccggcttggagcggatgtagcacctcagcgcctcgtctgtgtccgccgcctgcacggctgcctgcgaggcactgacctccccctcgccctcctcttcacctgcagactcaaatgccgctccaaactcacaggaggaagaactgaaaagagccagaccaggacgttgtgcaacccctttctctccagcccctgagaccatgagcctctttaaaggaaggaaggtgtctacgggtcccatggagcctggcctgtggcacgatccccagcaaggcaggacgggcctgagagatccctgcaggctacgccagcgggatcctgccccagccagaaatgtctagcatgtggggcaggaaccaggaggcctgcgcagggctggggtcagggaaccagccccctaaacccacctggttttcccacaggtcaaacccagaaggtgacgggggtttttgaagattggccattaggtctcactcgtgccaaccctcacgcccacgggccagaggatacatgaggccactgaccccatcgcatccatccggttacctctgtgagctcaaggagctgtcactgccatccacagaggtggccacggattcttgagaggctgggatctgggcgtcatcattgaggcctggaggtgcctccttggtgggcgacctgcttgggggtgtgatgctttcatgatgcttcctttgatgtcgggggcccttggtcttagcaggtcccttgggcctatgggccccaggtcctgtggtggcctcctgctgggcatggacccctgcccttgaaggcttgtaggtctgggaggcgagggtctggcagtgaggcgcctgcaacagcggctgtgaggactggctctcgtcctcggagtctgagtccagggtctggtgagtgtactggaatatctccttcagcttcagaaccatctggcgtttaggcagagggcggactccaaacctgacggaggaacaggtggatctcaggacccacccacacagctggtccacactccacgttccctatcttagcaaagagtgatacccaatgcattcagcgaatggcttgtgtgacaaaccatagatgcctgacttctgtgagcatcagaggttagtgtctattctaggcgccaactaagcttactctgaatattccaaaagaaacattgccagccaggcacaatggctcacgcctacaatcccagcactttgggaggctgaggcaggaggacagtttgagctcaggagttcaaggccagcctgggcaacatagcaagaccccgcctctacaaaaaatacaaaaattagccaggcgtggtggtgtcacctgtagtcccagctactagggaggatgaggtaggatcgcttaagcccgggaggctgaggctacagtgagccaagatcacatcactctactccagcctgggcaacagagtgagatcctgtctccaaaaataaaaaataaacaaaagatatgctgctcccagttctgagggatggtggcagcagcagcttccccgggtgcccgagtggaagagcagtgtcatgtggatgtgagagttaaatgttcttttaaaaaaaatcaggcctccgccgggcacagtggctcacgcctgtaatcccagcattttgggaagccgaggcgggtggatcacgtggtcaggagttcgagaccagcctggccaacatggtgaaaccccgtctctactaaaaatacaacaattagcctggtgtggtggcgtgtgcctgtagtcccagctactcgggaggctgagtcaggagaatcgcttgaacccgggaggtggaggttgcagtgagccgggactgcgccactgcactccagcctgggcgacagagcaagactctgtctttcaaaaaaaaaatcagacctcctcactcagactgctctggctagggggccatttccatctacatggaatatggggacctgctgcccaggggtgacatgcacgaatcctgtgtgttgcctccctggggaatggtacgcagagagaactgggaggctcaccccggcacccagcagtcacacatgctccctaaggagctgactgcagacctttcttcccaagcccaggccagctgcatccaccagacccagagaccacacggggggcccttccgcccccaggtgtgtgaaacccagttacttatgggagggaaaagaccactgtgggcaacaagctttgaagaccgccaacctatccagttccttcttcagcaccggcgtctccataatggaatactgtggcatcggcgttatgggcactttggggggcaagttcttcttccgattagcaccttctgggtaaaacaaaagaagcacacgttttagcatgagggacacggatttcccacatctgatcccagtagcgtgaccaagaggaataatgcacttgaagataacccaagcatcgttttgctccatgaaagcaacagtggtcaccccttccctgtctggagcaggggcttcccaatgatagcatcggtgacacgcactgaggaccacaccttgtataacacgggtgccgggtgaacagagctcctggggccactgaacccaacagcccggcacgtgactaaaacttatgcatgtaaacttaaaaatatctgacccacagtgacaacttgagacaatgggccacactgatactcttcaaacaggcttagacatcagttttgctttttaaaaataattcatcaatttaaaaaaacccagttaaaaaatgggcaaaggggccgggcgcggtggctcacgcctgtaatcccagcactttgggaggccgaggtgggcggatcacgaggtcaggagatcgagaccatcctggctaacacggtgaaaccccgtctctattaaaaatacaaaaaattagctgggcgtggtggcgggcgcctgtagtcccagctgcttgggaggctgaggcaggagaatggcgtgaacctgggaggcggagcttgcagtgagccgagatcacaccactgcactccagcctgggcgacagagcaagactctgtctcaaaaaaaaaaaaaaaaaagggcaaaggatgtgaacagacatttctccagagaagatctacaaatggccaataagcacatgaaaaggtgcccgacatcattagtcatcagggaaatgcaagtcaaaaccacagtgagataccactgcacgcccactaggatggccataacaaaaaacacagagggtttgggcaaaatggcagaaccctatctctacaaaaaaaaaaaaaaaaaaatacaaaaaaagttagcagggtgtggtggcccaagtcaccaatgtgggcagctgtttgtggctggttccagctactcgggaggctgaggtgggaggatcacctgagccaggaaggttgaggctgcagcaagccatgaacacgccactgcactccagcctgggcgacagagcaagaccttgtctcaaaacaataacaacaacaacaaaaacagaataacaagtgttggtggagatttaaaatggtgcagtcactttggaaaacagtctcgcagttcctcacaatgctaaacacagttgccatatgacccagcaattccactcctaagtacagaaccaagaagaaggaaaacatgtctacacgaaaacttgcacatcaatattcctaagtggcattattaataaccacaaattaaaaacaacccgtgtgtccactagtagatgaatggataagcaaaatgtggcataccatcagtggggtattagacatacaaaggaatgtatgcccaaagccagggcaacatagcaagacccagtctctactaaaaaaaaaaaattagctgggcatggtggcagctgcctgtagtcccagctactcaggaggttgaggtgggaggatcacttgagcctgggaggtcgaggctacaatgagctgtaattgcgccactgcacttcagcctgggtgacagagcaagacccctgactcaaaaacaggccaggcacagtggctcaggcttgtaatcccagcactgtgggagaccaaagtgggtggatcacttgaggttaggagttcgagaccagcttggccaacatggtgaaaccccatctgtactaaaaatacaaaaaaattagccgggcatggcatggcgatgggcgcttgtaatcccagctactcgggaggctgaggcgggagaatcgcttggacccaggaggtggaggttgcagtgagccgagatcgtgccactgcactctagcctgggcaacagagagaggctccgtctcaaaaaaaaaaaaaaagaataaaaaggaataaaatactgatccatgctacaacatgtatgaatcttgaaaactgtatgctaactgaaagaagccagacacagacacaaaaggccacatattagttatatatggctctgtttatatgaaatgtccaggacaggcaaatccatagagacagaaaggttcttggttgccagggctgggggaaggggaaggtgagagactgctcatgggtacaggatttttgagatgatgaaaatgttctagaattagagagtggggacaattgtacaacactgtgaatgtactgagaagcactgaactgtccattttaaaagggtggatattatggtatgtgaattatatctaaataaagctgttactttaaaaaataataggctgggcgaggtggctcacgcctgtaatcccagcactttgggaggccgaggtgggcggatcacctgaggtcagcagctcaagaccagcctgatcaacatggtgaaacccgactctactaaaaatacaaaaattagctgggcgtggtgctgggtgcctgtaatcccagctactcgggaggctgaggcaggagaatcccttgaacccgagaggtggaggttgcagtgagccgagatagccccactgcactccagcctggtgacacattggaaacagtcagactttggttcttctgccttttatgaccatggagccctttgagcccccgatgaaagcggcaggctctgtctcctgagaaaagcacgattcttcctgtggccgcagcgtcgtcctgaagcccacctcagatctgctgtgcagcctcctgcagctgttctcacagcactgcctgggaactggttagaaatgcaaattcttagtcaccctcccgaagcaaggctctggggcaggctgggccacgggcgtgctataagaagctctccaggtgtttctgaagcccctgagggccgaggacactatcagtggcctcattcatctggattttgggaggaaatgggcccccaggccgcaggcaggtgctcactcacagcctggcctttctcccagtcatgctcagcccagcccggcctgtccttgccctccccggaggtgcctggatgggagcagcagcaccgagggggccgacacctggggctctgactctccccggggactgaaatgagcagggaggtggcatccctgcacctgggaggaccaggaagaacaggcctaacagcctctcacacttgtcccacctgattctttttttaattgaggtgaaattcacataaaaaaatcgtaaagggaataattcagtggcattaagtattcacaatgttgtacaaccatcacctctatctatttgcaaaacattttcaccaccccaaaaggacaccctgtatcccataagcagtcactccccattccccctccctccaacccaggccaaccactaacctgcattttctctggatttgcctattctagacatttcatatccatgagtgcagacagtacatgaccttctatgtctggcttctctcacccggcagcatgttttctgggtcgtccacgcggtagcgtgtggcagtgcctcactcctctttgtggctgaacactattccattttctagtggtctagatggaccacgtttggtttccctgttcatctcctgacgggcatttgggttgcttccagcttttggcgattgtgaacagcgcttctatgaacatgcatgtctgagtccctgtttttaattcttttggatatacaggtaaaagtggaattgctgggtcctgcagtcaatctacggttaacattctggagaaccaccctggtccaatcttaaggcatgccgatacttgctgaatgagttgtggcctttggaggtgccggctccgtgttctggagaagggtccacagatgtggatttttaacacatgcccaggtgagcactggagccaggcaagtttgggaaacactgacttactggctgagaagtgtagcatgagaaccagcccggctctcctccactgtggaggggagtctggaaggcagcggaagtgtcatgcctcaggtcagcaggcattcagagggcagcccctgggtctcatgactgatcttcccaccctcttagtgtaaaatagtaacaaagacagtccccttccccagctctcctggctactcactgggtgtctctaacccttcgggcttctgagctccaccagcgcttggcatctgggccggaggaggggtctctggaggcctctgctcttccccgtcccaaacgtcccacagagccgaattcagaaagctcggcctgctattccccagggagcccgcgcccgaggacttctcttgcaatttcctctgggtagtgcagcttcctcggatgggggtggtgtccaggagtcccggggagcgacagtcacggctgtcggcggcctcgttcatcctgcggctggggctgctggtgctcagggggccggtccgctccaggttccagtggtcaatgggaattggcgagaggggctccatgtgccagcagcagtcgtcaattggaattggggggtcactgtccagtggggggcttctgttggcctgatgggaggccacctcctgctcatcgtcactgtctccgacttccaccacttcacccgctggggtctggttcaggaagcttggcccaggcggcgagtgtttcaggaaccgcctgctgaagtgggcgcggtcccctgagatgggatgtggagccagcggagaggagtgcgggtggcccccggggtggggacgggaagggcttctgtggccttgccttctgccgtcagaagttcctggagagacgggagtgaggcatgaggacggtgtctggggcggtggtgtctggggcctgatgacagaaaacttctgtgcgacttcgttcccttccctgtttcctactgaggccctgggcgtgtgctgagtcaccgcctgcacggccagcccgctcctgaggctgctgatttgggtctgggaagaacagtcacggcttctgctggccagcggggtggcgggcaccagccacgaggtgtctgtggtgctggcctcgctggggctgctctcacggtcacagaacagccagggagcccctctcctgcccaaagagccccgattctccggcagcgccccctcatcctcctgctgcagcacagcttcgcttcttggtgggctctgggaaggttcctgatctgcatcaacatcaatgatggaaaacagctcacaggacctagggctaatttctagagctttcttttcttccagaggatcactagaaatggacttcattttggtttgttctagctccagctcctcatccgagtccagtaagaggatgacctcatcttcttcgttcagtttggatgaagatttctgagatctggagctcgaatggtcaggatttgactgggttaggtcaatagacggagatttttctgggaacatcaggacccccttatttctgcactccagcacggaccgacgctctttgcctttctggtgccctggctctttagacagcgtgaggatgctcctgtcccttttctgctttgatggcacagctggagacagcaaggttggggagcccacctgggaagttccgccacgggaccggggtgttgacagggacgacccacttgtgtgatgagacccgcggggactcccgccctggggaggccccaataggaagcggcacgggtgcggtggagatgcctgccagggagccaggcgatgagaaacctccagccccctttccctgacagcgccactttgttcctcgggctcacttgttatttgggacggctctgagatctctccctgagttgatgagaagagctgttcgtaatccccggcatcatctgagtgcggaagagagccttcttttctctctgcctggcagtccctggaagggctggagcagctggaatggccaagcgcctcctctggcgcctcctgctcaggggcctctgctccccgtgcccctgagtgctggccctggggtggcgggagagcgcactgtcccatcttctcccaggtggtggcggcctcatctcttcctggctccaacggctccatctcctccaccttgtcccactgtttctgcacctggacacctgctaggagttgcccagaaaccggactgccaccctccagccagtcagcgtcctcgccggcacccgctgccctttcttcctggagaagctttcgctgagtagctgcaaattcataaatttcttccatttctgcttcattcacgttttcttgatcttcttcgtggtccttggatttcaacaaagtctccgcttcctcctcttcatctgcccacattgacctcaagagttcctggaaattctcggccctgctttcgcaattctctgcttccttctcctcccatggtttgccctctgagtcagtggcaataggcacctgttcgcacaggtgaacgagctcactcacgccaaacctgcaacacgaaacatcgacagtcatcgcccctctgcgtggagatgggctctgggtgccccggtggggtggcggaccagagcagagtcttcaccaggaggaatgaccatgacccaggccctgcttccctttgaagacggtgtccacactccttgccagaaacacccaggccacttagttccagaaaccggggactgacaacacttaaagcagggcttcctaactatagctgcagacataaaggggtgtgtcggactgaatgtaaggtaacagggattggcagagctacaaaactggggagtctgtgctgcctcagaggctcttaagatatggtgtcagagccaggcattgtggctcatgcctgaaattccagcactttgggaagccgaggatcactcaaggccgggagtttgagatcagcctggacaacatagaaagtctccatctctacaaaaaaatgtaaaaattagcctaggagttcaaggctacagtgagctgtgatcatgccactgccatccagcctgggcaacagcaagagactctgtctctaaaaggataaaaaaggtcatgcatggtggctcatgcccataatcccagcactttgggaggcggaggcaggaggattgcttgaggtcaggagttcaagaacagcctgggcaacacagcgacactccgtctctccaaaaaataaaaaataaatgaaaagacatggcatcagacacaatccacagcacaccaagtccttgagtcagcccaggccaacgggcaagccagccagccacctgcttgaaggctctgtggcccgtcagtatatttccaactccagaggctgagctgttcctttcctaagaaagcagcggagggaggacgcaggctcggatcagcggcccaggccctgtccagaggcacaacacttgtccctctgagctgctgcctctctcctaagatgctggctggacaagccaggagagctgtggcatctgggatgcagcctaagcattctctccatgcctgttttatgggactctggaaaggactgctgttgttcaggtctagtggtggaacaatcactgagcagcagtgttggggggcgctgtagccaagggccattctcttatcacacctagggggttaaaaaccacgggactcaatagagtcctcctgatccagtgcttggcacccctgcaagggtctgttctggcctgactttcacctaacatgccctgttccacagggtcatcactggtcatggacttgggattaaaaggtataaacaggactgttagttctcttggcctcagccccgagccctctgcagcacaaccctccagagctgttaacctgccagtcctcgtcagttaatttcaaaagctggggagcaatccagacctgtgggccagggagctcagctcagagctaaggccaggaggaaggccagtgtccgcagtgtagagatagtgcaggaacgtgcgggcggcctcggtgctcacgtcacccagcaggacacgctgggtcagaaccccgtcctctacagcggagaagccttcattgttcacctgcaggtgaaatgcaacacagagggtttactgatcagagagttgtaacttggagcaaagcagacggtctggggtgtcctgcaagtcactagtctttttatttttctttttagagacagtgtctccccttgtcacccaggctagagtacagtggtgtgatcatggcttactgcagccttgaactcctaggctaattttaaattttaattaattttattattttgagttggaatctctctctgttgcccaggctggagtgcagtggtgagatctcggctcactgcaacctccacctcctcggttccagcgtattctcctgcctcagcctcccgagtagctgggattgcagccgcccaccaccatgcccggctaattttttatagtttcagtagagataaggtttcactatgttggccaggctggtcttggaactcctgacctcaggtgatccaccctcctcggcctcccaaagtgctgggattactggcgtgagccactgcgcccagcccctaggctaatttttaaatttttttgtagagatgggctctcactgtgttgttcaggctggtcttgaactcctggcctcaagcgatcctcccaccttagtctcccaaagtacggggatctcaggcatgagccgccgtgcctggtccctagtcttaaaagcagctccatgccccaggaaaagcattagccactgtttatgcagatttttggccaataattttacaggtgaggcctaacactcctcttttgtcaaatcgtattgggactagatattccaggaccccgttaagagtcctcctgatagacacatatgggatccagaactttgacaaagactgagaatagctccctgagttcctgcccacactcaagtcaaatgctttcaagtcagaaggcaggttcatcagcaactcatccctgaggagatcaattatgagcctttgtaattatgcaaatagagaaaagagaaaacaattctgggaaacaatggattttctttttgttttgttttgtttttgagacagagtcttgctctgtcgcccaggctggagtgcagtggtgcaatctcagctcattggaagctccgcctcccaggttcatgccattctcctgcctcagcctcccgagtagctgggactacaggcgcccgccaccatgcccggctaatttttttgtatttttagtagagactggtttcactgtgttaggatggtcttgatctcctgaccttgtgatctgcccgcctcggcctcccaaagtgctggaattacaggcgtgagccaccgcgcccggccaaacaatggattttcattcaacagaacgaaaacactgatgtttcccagttgtgaggccatcccctcacacccactcctaacctcaagcgtgggtctttatctcttctccacgtgttgcagaaacggatggttgggagggagaaggtgagaacatggtggggcaggaagtgagggagagtgggggggtggaaagggcacctgagacatgggaagacctggttggagaaaggcaggaggagagagggagagagaggaaaggagggcacacggcagcccacgtacttacatactggatgaggagcgggcatcgggcataaagcacgaacttgtgggcgtaaagcacctccccgctgtccgtctgaaactggacatcactcaggtgtgggttattgaccatggcgccaaagtcagcaaccagcagcccgagggagagctgaagcaggaggagaggaagagccgtcacctccccacctctgctctgctaactgggcagtgggaagctccccgcatggaggtggcgctagggtgggccgggagccaggacctgcattctcctttcctctccaaaacgcttcccacgatggcctcaacctctgagtgaccctaaggccctgagtagcacagaagagcaaagcactagcttgttcctctggctcttgccagtgggttccctggcccccgtggagatgccagacatggggctagatgtgaactcacagtgctggcagctcccgcactgagtgggacaggctgcgggatacctgggctttgaggaggtgcacccatcccctgtgacggacaagcaccctgagtccaagcagctcggggacctggccaagaggacagccgggtccagtctgtgatgatgtccctaggctggccttggcatgaagtgcttggttgacactgacatgcaaatgggaggaggtccactctagggaaaagccagttcccaccccggttcttccccagacagcgcactgacagggaggccaggccaggctgctcagctgtgctctggagcccaggacccgcacagaggggagggagagcaagcccttggtgagctcccaactactgaggaacgagcagagcgtgcctggatggggcaaccgcgctgagaaactgtggtccctctacactcctgggacccaggacagggcaggctctggggcctcaaccccaaggtgccccatggagtcacagacagaaaaggcagaagtctcgtggcagagcccccagaggggcgctgaggtggctgtgggtccgtggctctgctcacggatgtcaggatgtggcagccttctggaaagcagaggccttgagaggccactgcacttgcgttgggggccagaggccagcggtgagccaaccccaccacacacatggcaagtgggatggccgggaccagagagcgcgggccagagccagttcttaccaaggtgcggccgcccctgtccgggtgcttgtcctgcgatggcaccacaaacccagtcagaggaaggccgccgggcaccacgtccaaccctgagtggaggattcacaggttaaaggaacgtcacagcccagccacatccaccaccaagaagacagcgttgaccacaggctgagccagcccctgcggtgcctcggaaggtgcttgctatccgaggacaccttcatgcaaagcaaacccgcacaccctgtctcaccaccactccaccagggaggtaagagaagagcaaaacagacagttcacccagaggattcactcgctgtgggcagacagctctgtctttggttaaagtggaaggaaaatcatgacagagttgtctacaccacattgacctttgagaaaaaatgaaagcgcccagaggctgcgtgttctcccaccaggtcagagctgccgtcgcggcggcacaagagccagtccatggcagcctcagccgcggggaggggaggcccgggagggcagggctggccctagagtcccacccagcatctcacctgcagtcccttccgagccagccaggcccccactgccgggccacgggctggcgctcagtccctccctcgccaggtccacgaggtcctgcagggcctggtgctccctctggctggccgaaggcgacgggcccctggagccacagcctgcagtgggggtgccgtggagagcgggtgaccttcgctcgctcagctctgagtgctcaggtggcaccagaggcggcacgggctcctgcataaggccctgaaagaagccagtaaggagagtgaccacgtggtcactgtcattgacgcacacactgcagaagccatcacatgtggtatgcacggctggacctaaaactacagagcaggatgtgggctgtggggacagactgtccccggggctccagccacagcctggagcagtcctgggatgcttttccccagcactcatgtcaacatgctcctcctctgtcacggccaaggccaggcctgtggcatctgtttgcacaaaggcttgtcagaggccaggggggcccaggcctgccgccctcctgaagtcctccaagctgcctcaggcagctgcgtactgactgtagggctacctgccgcacgactgtctggagtgtgtgctccgaatgccagtttccgggctccatctgaggcattttgccagttgccctgggactctgttttttttttttttttcaagacagagtctcactttgttgcccaggctggagtgtaatggcacggtctcggctcactgcaacttccgcctccccggttcaagcgattcttctgcctcagtctcccaagtaactgggattacaggtgtgtgccaccatgcctggctaatttttgtattcttagtagagatggggtttcaccatattagccaggctggtctcgaactcctgacctcgtgatccgcccacctcagcctcccaaagtgcagggattacgggcgtgagccactgcgcccggccgggactctgcattttcaacaaactccaggaacacactctggtggacaccaagggtcctccctgatcctacccagagtaccatgtagttgctggacagagaagaaagctgcagccaccaagtgcccctctggcctcctcccgcctctgcctttccttcctggactttccatcacctggctgtgggtacccagtgttgcagttctgggattgccaacctcccccaaaagcctatccatgtgcctgaggggagggactcacctgggcaggccgctggggcacgagaggagggaccagcctggccgtgtagaagtcctccatggcccaggccccagtcagtgcgctgccctcccacagaaagctctgcttgcgttcaggtggaggaggacactggcccgctctttcccacccttcctttaaaatcctgctggcaggaagtggtggcgtgctagacaattccacttcctcagagaggagcagggccacacggtcctctatctgtcggcctgtggtttcagagtcctggactaacaacaatgggggggataccgggggtttcttcttgcgacttttattctctagagagaaacaaaagcgacaccatcaacggtggagtcggtccactcacccgggacctgctgatggcctctcccagggtcactcttctgatcacacaaacctgcttctggtcttatcctctcagaaaaggcactttccagcctgagcgctggtacagccgcacccggctccatctccgaccgggacagagccatggccaccagcaggtcctcggacggtgcctcgtccaccttccgcctcttccgtggctccttcttgctggtgggtcctctccgtttcagacctctactgtgatcactgaagctagaaaacagccaaagagaaaagttactggggctagaggagtgcacgcttctcaggttggtcacactggtctggagagggctgggcctgagagaaaagtgacggatgtggacctgccaggcagatgcgtcccccacttccactgccttgtgtgaactcattcaattccaggccagaagttcaacatggcccaggcacaggagggtctgggttccttcacgtgctgctgtccagcaggctcatggcagatgtacggagccatctgtggtacctgcacatcctcatgtggccaagcccatccaatggagtcaacaatcgatggctctgagcaggctccctggactcccaccaccttcacccatcaatacttccgatgctccttacacggtcctggccacaccggcagaaaaggatcccttccctcctgcaagggctccacggcagtgcctctgtccatggccagaaggaagggcttcccagcttaggctgccgatggtcaacattataccagccgccccgggactctgcactttcaacgggcagcagctcgtttggtttggaggaaatgaacaggagtttccggctggagagaacctaggctgcctgggtgactcccaataagctgggcaagaaggaggagggcagaggtgacaaaggaacttagcacaaaccgggcccaccttccctgcaatgcagtcatgcctctggcttttgcaaaagctcatgctctccagggtgccagggatggctcaagttcaccttcccaggaacgtggataatcacagcctcccagagggaaaggagctgcctgggcagcctgggaccctgcttctgtgaagggaacacagactgtgttccctcctcactccccagcaggccaggtttgggctgtggggaaagaatatgaggcactctggccggggcatgcgttctgatgaccacaggcttggcctttggggagggaggggttcaaagaccccatgagggcatccagctcctgtagttttctactctgacaaccttctaaacggatccacatacatctagtttcagtacttggaggtattctaaaggcagacatactttatctgagcaggtgcttttggcgtggtcctgccaagaaagaaacaatggcttagatgacgtctattctaaggcctcaaggcttgcacccctgccatgctaaatacagatgcgctcctccaccaagagaatcccctctgccctctgccatctcagccccgagccagctcagctgcccatgacctgtgtgcaaagcagggggcgggacaaacagctatcgcctttggccttccctttgctcctgacagcggtctcaaacctggaggagtcaaaggtccaagatgcctttgttcactatgaacctggtgtcagctctagcgtcctcagcagcagggcagcgtggagcagggccagccctctggcacttgtgtggctgtggtttgcatgctgaggacttgtttcctggctgtgagcaaggcaactcattttaacttttaagcattaattcatgcaagatttttaaaaaatagggtcctacacttctgttgcaccaactttgttgttgtttttgtttgttttatgaagacaggttcttgccctgtcgcccaggctggagtgcagtggtgcaatcacagctcattgcaaccttggcctcccaggctcaagtgatccttccgcctcagcctcccacgtagctgggactacaggtgtgcagcaccacagccagctaattttttaattttttgtagtgatgggtcttgctatgtagtccaggctggccttgaactcctgggctcaagtgatccttccgccctggcctcccaaagtattgagattacaggtgtaagctaccgtgcctggccaatcaccaaatctgtgaactgtgctgagtaatcttatgttaacagtgtgaaaactggactgtgctgaggtggaaaccatgctgtccaacaacgaaatggatggagtaaagtgactaccaaattcttagatgtggtaaagcagtagtccccaacctttttggtaccaggaactggtttcatggaagacaatttttccatgggacaggagtaggggaatggtttcagcatcaaagcattccacctcagatcatcaggctttagattttcataaggagagctcaacctagattccatgcatgtgcggctcacaacagggtttgtgttcctgtgagtctaatgccaccactgatctgacaggaggcggagctcaggcagtaaagcttgcctgcccgctgctcacctcctgctgtgtggccaggttcctaacaggccacagaccggtactggtccgaggctggggggttggggacccctgcactagagggtaccgactgtgggatcatgggattggaaactcaggaaggaccttgaggaaaacagtgcgaagatcatttctgcacccccctaaaggggcaggtccagagccttccagaatgcagattctgtcccctcctcactcccttctagactgtgcccgatttccgccctaagtgtttcatttccagaatcaaagagggctctttttccctccaacactataaaaagctttttttttttttttttttttttttttttggagacaggatctcactctgtccaggctggagtgcagtggtacgatcttggctcactgcaacctctaccttctgggttcaagtgattctcctgcctcagcctcccaagtagctgggactacaggcatgtgccaccatgctaatttttgtatttttagtagagacgagattgtaccatgtcggccaggctggtatcgaactcctgatctaaggtgatctgcccaccttggcctcccaaagtgctgcgattacaggtgtgaactactgcgtccagcccataaaaagcttttttaaatagaaaaagccctgagtgcacacagcattatttggcttggttttcttccttttcgtcgacttacctgaacatgggtgggctgctgctaccctcaggctgtgctgtctgcagccgcacagcctgaagcaggagctgggggccaacctccatcttcacagcacactgcttcaagtgactggttctgctctttaaggtaagaaacggtttcccacaaatcgggcactcagggatctgaggcacagaaggtcttagtgtcttttcagcttcatccaagcacctgaaggaaaacagtcaatacaggagaaccaccctccccaggaatgtggattggagcaaatgtgggtccaggtcaacacagacgtgctgtggtcaaagcaagttccccaaagccaatcccctctacacagcctggctccgtctcccggcagtcagcccctagacactacacttaggtatctgtcagcaaagttggctaaagaaagcaaggaaagattaaatgcagttacatgatgacttagaaattccactcctaagtagagaccccaaagaactgaaagcaggtacccaaacaaatacatgaaacccatgttcacggcagctctatccacaatcccaaagggtagaaatgctccaaatgtccgccaatggacgaaaggataaaccatggtcatattcctcatctaagaatgggaaaaacacagtctagccatacaatgagatactgctcagccataaaaaggaatgaagcctgctccatgctacaacatggatgaacctcaaaaacaacatattaagtcaaagaaggcagacacaaaaggacaactgtgcaatttcagaatcggcaaatccatccagacagaatgttgattagtggttgtcaggggagagaggggcaatagggagtggctgccaatgggtgtggggattcttttgggggtgatgaaaataatccagaagtgattgtggtgacagttgcccaactgtgtgaatatcccaaaagtagtgatttgttcagtttaaatgggtgaactatatgttctgtgaattgtatctcaacgaagttatttttaaaaaggggtaggttgacaacaaagctgaggtgctgttgtcatggtaaggtgtggagatccgcactccagccctggggtgcttggggattctggtcacatacacgggagaggcgacggcccaagctgcccccacctgttcacatgctgttcccttcgggtcacgttcatggctgagaggttcttttgacaaatctggcagaagaacaaacccttttcctccaggctatcatcatgtgccgatgctcctacccgtgcaaactcctgctgcagggtcaaggccaccgcagcgtcgctctctggggcagggggcccaagcccatacactgtggagaagcaccaaagatccgtgagaataaactccaaagacaagctcaccctcagacctctgctctgtcagctcctgcagaccatggggagcaggtggaacgcaaagaaaccagaacccagctccactctgcaggctggtgacttggacactgtccagtgagactgggcactaatcagcactccgggaacagccgtctccaactttaacatggatatgcattacctgggaagcttgtcgacactcagattcaaattcaaggggtccaggtgcagcctgagactctccgcatttctagcagcctccaggcttggcgatgctggcagcacaggaccactctgagtagcaaggacctaaactttcccacttctgctgaagttggctacctcgggcattgcaagttcacaaggctcatattccaacaaagctagatgttctcttcaaaactcaccctttcctgctgaccttttactgcccatgataaaaccagggcagagtgaaatgcctttggcgtttaaaaggcagcatctcttacttagcatcagactcaagaatggactgattctggtcttgagatggctcccagggtggcccatctgatattgctggagcagacccctgtcactcacaagggatatgccctgaacgcctcataaatccccaagttcttcatggctgtggcctaccagtgcctgccactgaggccagcaaaacagcacaccttcattttggtgccctgttttgtttgtttgtttgtttttgagatggagtctcacactctgtcgccaggctggagtgcaacgacgcgatctcagctcactgcaacctctgcctcccgggtccaagcgattctcctgcctcagcctcctgagtagctgggattacaggtgcccaccacacctggctaatttttagtagagacagggcttcaccatgttggccagggtggtcctgaattcctgacctcaggtgatctgcccgccttggcctccccaaagtgctgggattacaggcgtgagccaccgcgtccagcctggtttggtttcttaacaaacaaatggtttatctctttctgagcacttgctgggtgtgatgtgaagatacagagagaactgagtcaaatgctgggcaggggcggagctcacaccagctgggtgcctcctctgcaactcacatgtgcgtccaggactgatgcctcggcaggacatcaaatcactgcctgctgtggaccctggggtggcctgagactcctccgtgctactgcagtgaaatctgcaatgcaatgccaagatcctgcatacttattagctgtaggtctgccgataatggtttcttcctatttcttttccttttgtatattttcatcagagatgagaatccatattgttttggggatggagaacaggagcacctggcattattacgcttattgggccggtgccacaccaagtacacagcagctatggggcactgtcgccaccctgtctcacctgcagccaatgagcctctaatctactcagagtggggcaacccaatggttagaggaaggagttaacgatcccataaagaaataaatccagaaagtgggaaatcttataatacaattagcctagcctcttcaaaaactcagtgtcatagggctgggtgtggtggttcacacctgtaatcctagcactttgggaggctgaggagggcagatcccctgagctcaggagttcaagaccagcctgggcaacatggtgaaaccccatttctagtaaaaatacaaaaaaattagccgggtgtggtggtgggtgcttgtaatcccagctactcaggaggccgaggcacgagaatagcttgaacctgggaggcagaggttgcagtgaaccgagattgtgccactgcactctagccaagcctctgtcaaaaaaaaaaaaaaaaaaagtcagtgtcatggaaaacaaaaggaaatgggggactattctagaatctagaccttaggatactgctgagctacagcaatatgcagtgtgtgaacttactgaatccttgttcagaaaaaaaagaaaccagctacaaaaaataaccttgagacaaccagggaaatttgagtttgaactggacgccaggcactattatggaattaagcgtgctaatggtattgtggttatgcagcagaatctaggggtaaaggatcctaatgtctataatttaccttcagataatatggaagaaaaatatgtacgcttggctaggcacggtggctcacgtctgtaatcccagcactttgggagactgaggtggacagatcacaaggtcaggagttccagaacagcctggccggcatggtgaaaccccaactctactaaaaatacaaaaattagctggacgtggtggtgcatgcctgtagtcccagcttcctggaagctgaggcaggagaatggcttgaacccaggaggtggagtttgcagtgagccgagattgcgccactgcaccccaacctgggagacagaccaagactccatctcaaaaaaaaaaaaaaatgtatatttataaagacataaacaaatggccaaatgttaacatttgttaaatctagattgaggtataggggattaggggattcattgtaatttttttttttttttttttgagacagggtctcactctgttgccctggagtgcaatgatgcaatcacagctcactgcagctcaacgtcctgggctcaagcaatcctcccacctcagcctcccgagtagctgggactacagttgtgcaccatcatgcccagctaattaaaaaaaaatttttttttgagtcagagtcttgctctgttgcccaggctggagtgcagtggtgcaatctcggctcactgcaagctctgtctcccaggttcacgccattctcctgcctcagcctcccgagtagctgggactacaggcacccaccaccataccttgctaattttttgtatttttcatagagatggggtttcactgtgttagccaggatggtctcaatctcctgaccttgtgatctgcgcacctcggcctcccaaagtgctggcattacaggcgtgagccaccacgcctggcccctaaaatttttttgtagagatgggggtctcactatgttgtccaggctggtctcgaacttgtgacctcaagtagtcctcctgccttggcctcccaaagttttgggattataggcatgagccatcatgcctggcttcattgtaattaaaacaacaacaacaaaaaaaccttttctgaaaggaagagttctttgtgaatactgagggttatctttttaaaaggaaaaaactgaaagggaaagctttcataataaaaagtcataatttttaaaaaaaggaggccaggcacagtggctcacgcctgtaatcccagcactttgggaggccaaggcgggtggatcacgaggtcaggagatcgagaccatcctggctaacaaggtgaaaccttgtctctactaaaaatacaaaaaattagccaggcgtggtggtgggagcctgtagtcccagctactcgggaggctgaggcaggagaatggcgtgaacctgggaggtggagcttgcagtgagctaatatcgtgccactgcactccagcctgggtgacggagcgagactccatctcaaaaaaaaaaaaaaaaaaaaaaaaggaagagggccaggtgcaatggttcacgcctgtaatcccagcactttggggagctgaggtaggcagatcacttgaggtcaggagttcgagaccagcctggccaacttggcgaaaccctgtctctactaaaaatacaaaaattggccaggtgtggtggcacacgtctgtaatcccactggctggggcaagataattgcttgaacctgggaggcggaggttgcagtgagctgagatcatgtcactgcactccagcctgggtgacagagcaaggctctgtctcagaaaaaaaaacaaaacggtaccttatcaaggaagctaggtgggaaatgatcccagagactcttcattctctggctggatccagtgaagtggcaaaggtaaaacatcaagcagagagcctatccacagaagaaactcaacaaatgctgattccttcccgcctcccttcctcagagttgtattaacttatctctgtgtggaagacagaaacacactcatcataccattccccgccatcatctcctcttgaggatcctttgggacattttcttcccgcgcagcctcgagggagcactcttctgaagcgtgtctcaaacgctcggggtctgctctcttgaactgctgcattcgctgtaggaccaattgtgctgtgcggggtttggagggacttggcactgctgttgtcaaacaggaaggaggaggctgggagtcgctgttgggcacattctctggcaaggaggaaaatattcacaaccatctgttgtagctggagaaataaaagacttttctaccagatacaggttagacgcaagtttcaagagtcctttatcaactagtttaggtttgactcacaaatgtgaagaggactggttgcttgttggtaacctctttgtttatggcaatatagacataaatatcaataacaggaggggaatgggatgtgactgctaatgagcatggggtttatttttaggatgataaaactgttctaacgttaggtagtggtggtggttggacaagtctgtgaatatactaaaaaccactgaaccatacccttttaaatggtgaattttatggaatatcaattataccccaataaagctattattaaagaaatattaatgacaaaggtttatgtcctagatcagttcttctttaacttgggatccacggatgatcttcagtggggatccatgaaccccatgaagttgtgtgccagttttgcagatacgcgcatggatacgtgttttgggggaaccatgcatagatttcatccgactggcaaagagcacgagagaccagtaaagttggtgaggcaacactgctgatgccttccagtagtctatgcgacctgagactctaccaccactctactgagaggttattaagatcaggaagtgagggcaaaggaaatttagaaacagaactcaggagctcagagagcccatggtgtattatatatgcaagggtagttttcagttttgcatgaagaatgtgtagtaagcatatagctcagtataccaagggcagcagggcaagaaaactgctttaaacagttaaaaaattatccaggcacggtggtgggtgcctgtggtcccagctactcgggaggctgaggcagggaggactgcttgaacctgggaggtcaaggctgcagtaagctatgatagcaccactgcactccagcctgggtgagagaccaagatcctgtctctaaaaactaagtaagtaaataaatcaataacaataacaaaggaaaagattaaaaggtcttcagagagagaaagaaagaacctgaagattctcctgggacttgagcccacacagagtcctcatgcggccctctcagcagcctatccaaattggctggcccagtccaacttacccactttggaataaattcaagaaaacaagagaagcagcattattgtgttgtttgtgtaactcatgtcaatcatataacagaatttcataggaaattctgaaagagcagaggactccaaacacaatcatgtgaaaaattcacacgggttatgtttttcttgactgttgtttaaaccaggagtcagccgggcgcagtggcttacgcctgtaatcccagcactctgagaggctgaggcacgaggattgcttgagtccaggagttcaagaccagcctgggcaacatagtgagacctccagctctaaatttttttttaagcttaaaaattaaaaaataaaaacaaaccaaaagttagcaaactacggtcatgtggctggctgcctgtttttgtaaataaagttttactggcatatggccatgcctgttcatttacatattgtccacgcctgctttctcactatgacagcagagttgagtagttgtgacagagtctgtgtggcctacaaagccaaaatatttacgatctggccctttccaggaagttttccagcccctggtttaaaagagtacaaattacctctggttttctctctggaaaggtttggcgatggttcttgctggttacccgtctgggtgttttgtgctgtttcccggagcacaggtggatctggagcagaggcaagcacacccccctccccattcacagagtgggccggttcacttgcttgccatttggttaccctttgctttttagtcctaggggcctggctgccagacggaggtttcttctctgcagggccttgaagggttttggtcttggtagcagtttgtttggtccttttcaatttgcttcttatctgagtgccgtttgaggcagccttttgtgtcttcctttctcctgacacttccttgattccatgttttttcaccctttggaaaaagctagcgcagagttctttaaagtcctcatcagactcatccatcatctgaccagttttaaggctttcaggctggtcttcagaggagcgagggtcaatcccaggacaggcagacagatgagaaagtgaacccaagtagaagcctagctgagcctcattcacactcagtttcattagggttcttctctacttctccattagatacttggagagtttgcacaattgaacaaaaagtactgttttcctctctataatgattgaagtatctttgttcaaattgggcctgtggttaaacatgtttaaagcttccctctgttaaagtccacaactgggccgggcgcggtggctcacacttgtaatcccagctcttttggaggacgaggcggggggtggatcacctgaggtcagaagttcgagaccagcctggccaatatggtgaaacctcgtttcaactgaaaatacaaaaaattggccaggcgtggtagcagatgcctgtaatcccagctactcgggaggcagaggcaagagaatcgcttgaacctgggaggcggagattgcagtgagccgagatcgtgccactgcactctaacctgggcaacaagagcaaaactctgtctcaaaaaataataataataaataaataaagttcacaactgaaagagtgttttgttgtccaatagatgcctctgagatcgaatacatatgaacctggtgctcagataattctccaagatctccatgatgatgaaacatatatggttcacttaattacacatctgtggaaaaccaaaagcatgtaagtgtaatcagacattgtcattttatgccagttcttccagggagggacaagggcatgtggggtgagggaaaagtcttcggagtaacaatactgtcaaatactcagtccagcctggttaacatggtctaaccgtcctatcagacatcacaacaaaaggacctagaaacctgtcaaagcatgttgttcttccacaggtattaaaatatgtgcatcttgggagagtgttttcttaactgaaatttagggagcaaaccccataaaaggcagtcaccacagaaacaggatgatccccaaatctaggaaaactatctcctacactgatctaagacccctggctgttaaagaggctctttctgtaaatactgcaacataagagacagaaagagacattatattctcatgaacactcaggagagaaaaggtcacttttacttatcttctcaacccagcaaggctctccaaacctggatgactggaatgtcgcctgtgtgcaaaggctgggcctcgtgagcatggttgtttactttggcacacagctaagtggggttcaaaaatcaaaactgaatgacccaatggcagaaagttattcctttcaaatacaataatgcaatctccactgtccaaggaatctaattaatcattttgttttccagagctgaaaatactcctacctagaatctactttgtatggctggcgcattctcttctgtgtcttccccttagagaagtgtcctctaatcctttatggaccgtctccatccccgttaatccctatcatcgcccactgttttcacaatggcatctgtcataggttatcatcatatgaaacaggtaatatctatcgaatgcttactgtgtgccaagcactgttccaattgctttccaagtcaaactcgtttaatccttacaagaagcctatatggtggaatctcttgtcatcctgtctttacggcaaggaaacacgcgcaagcagaatgaggaactggcctaaagccagttcaggaacagctttcacagtggcagggctgggatcaaacccaggaagtgtggttcgaaactatccgctcttgtgtttttattcatcggcttattatctgtcccccattaagctcaacacttcaggagggtagagatccatctattactttgcaacctctttggctgatctggtgcctgacttgaaataagtgctccacaactacttgttgaattcatgaattgcaaagagttcggtataatgggagtagagagaaaggtgtaggagaaaacgctgcggggagaggaaaggattggctcacaagggcctggaaggtcaggctaggcaaagtgaattttatcctgttggatgcggggagcggctggaacaaattccacctccacaactgtgttgatctccgcatctctgttgatatgaacctcacaacagtctatctcctcctataggtgcccagtcaagatttactgaatgacataacggatcctgcaagcctgcaggtttccagagggaaggggacttgtgcctccttgcttcgtacctaccgcagcccacggctcacagcaggcgagggatgaatgaatggatcggtaaggggcggaccctcccgcttcccccaacccggcgacctacggaaaggggctgaggggttccccgtctgggaaaagggctgccaaagactctaacggctctaaagtcagacggagaaccccgatccccggactggcccggacggagaccaccgtggggatccggatccgccaccctcctccctccaggcgggccccggcccctctccacccgagtgcggctcctgcctctccgtcggggctgcgggcctgccgaggccacggagccagcgagggagacgggcgagaaaggctcttctcccttaggaaagagagaacggcccgaaatgacaggacctccgcctcccgggtgccgactcccagccccacagcccggctcctcctacctccggcgccgccgcggcaccttcttaacggagactcgcgcgcctgcgcatgcgccgcccgcgcccccgcggagcattgcctgcgcgcaggcgcagagcgggcgcgcgcggtggtgcggcagcctcgcttccggtcttcctctgcggcgccgggcgcgggcccgcggcggccagcgcttccggtcggcaggaggcggggcgaggcggaagcggcgcttgcttcaggtggagtctgttagtttttgagaaagagttagggcgagtttaaggcactgtggcagctgtgagataaagtctggttcctccccagctggctcaggaaatgttcgcggatacaacggcggccccctctgggcatacctgcctgtggagcggagagtggacggtgtgagggggaccgggagaggcaccaaatctggcctgggggcccgagaagcttcctctcaggtggggtggcgtgagagtcgaggcctggaggtcggggagggttagctacgtgaagaggggattctgccgcgcttcaggtgcctggaggggatgcccgagctcttccgcagggctagggtgaagccagccagggcctgggggaaaggtagcagaggtttgccatggcttggtatttgagggactttacacatcgtattaagggtttgagcttcaacttggggtcgtcgggagccattgaaggttttttgttgtttgttttttgagacggggttttgctcttgttgcccaggctggggtgcagtggcgcgatctcggctcactgcaacctctgtctcccgggttcgagcggttcttgtgcctcaccttcccaagtagctgggattacaggcgccagtcaccacgcccagctaatttttgtgtttttagtagagactaggtttcactctgttgcccaggctggtctccaactcctgacctcaggtgatccgcccgcctcggcctcccaaagtggtgggattacaggcgtgagccaccgctcacggctttttttttttttttttttaagtagagacgggcggtgggggcgggggggggagtctcactatgttgcccaggctggtctcgagccctggccgcaagagatcctcccgcctcggcctcccaaagcgctgagattacaggcgtgagccaccacgcccggcgtaagattttgtttttaaaggcctaattacagtgagaacagatgaggcaaggacacccattaggaggctattacataatctagatgaaaagtgagagcggcccgaattaggaggtggagcgaaaagaatggagaaatatggagcatagtcaagacgcagttgttaacgatttgccggtttctggccttaacatctgagagtagtgtgcctccagtcactgaaataatgaacacaggagaggtgtaaaggaatcagtttgcagggcagacaatatgttttttaaaagatacagtatcataaaatgcacactagaagtgtacattcagtggtttccagtacgttcacaggatttgcagccatcgtcgctaattccagaacgttttaaaaccccaaatcgaacctgccgtacccattcgtagtcactccgcaattcccccgaccccatcccctggcaatcacttatcggctttctgtctctgtggttttgcgtattcagtacattttatgtaaatgggatcatgtgatacttggctttttctgctgggcttttattaagcatgttttcaagatttcatccatgtagatgaatcagtactgcatgccttttcatggctgcataatcacgtgtttggatggaccatgttttgtttatccatgtatcaggtgatgggcatatggatgtttttactttttggctgttagaaataatgctgctatgaacattcgtgttcataacacaagtttttgtgttctaggagtggaattactgggtaagactacatttgattctgaatgttgagcttcaaaaccttccaagaggttttccttgatgaaggatttaggaggtgtttacttgctctctggcttggaaatctaagttagtttgtaatatggtttccaactggataaagaagacagaacaagaatgataagcagcccagaggcaagggtagggcagggtgtcttgggacttgaatttatagaggagactgagtgacgacatggagaggccagtgctgttgaaataatttctctttccttccttcccttccttgcttcgttttcgacggagtttggctcttgttgcccaggctggagcgcagtggtgtgtgcaacctccacttccctggttcaagcgattctcctgcctcagcctccggagtagctgggattacaggcgcccgcaaccgcgcctggctaatttttttttttttttttttttttggacaaaatctcgctctgttgcccaggctggaatgcagtggtgtgatctcggctcactgcaagctctgcttcccgggttcacgccattctcctgccgcagtctcccgaatacctgggactacaggcgcccgccaccacacctggctaattttttgtatttttagtagagacggggtttcaccatattagccaggatggtctcgatttcctgacctcgtgatctgcccgccttggcctcccagagtgctgggattacaggtgtgagccaccgcgcccggcgtaattttttgtatttctagtagagacggggtttcaccatgttggccaggctggtctcaaactcctgacatcaggcgggcgatcttcctgcctggacctcccaaagggctgggattactggtgtgagccaccgcgcctggcctgaaataatttacttacatttctcaagaaaaggaggcgtgccaccacgttcagagccacaagggagacatcagcttttggttaggaggaagaaataggaacaaggagaaagtctaggccagaacctttatggggttcctcagaaatagcaagtcagggcggagtaaacattttaggattggataatttaaataattccatcacgctttgcctttgggtggtctctagttgcttggtacctggccatggatgatttagggcaggagaaatactggcttggtgtgtgagagttagataaaggggggaggctgacttgcctgtgagaggcatgctcccaagtaagttgtttactgtcttgaggaattagacctgggagaggcagtctccctgccagcaagatttattaagatttcaaaatatcataggatacagaaaatttttttaaacatctaataaacatggacatggctgggttatgaaggataattgtaatggtagaaattactgttttccagtcagactgaaaatgaagtgcctgtttcctatttaggatttaaatctcttagagtcctggtgaagaaagtctttgctacctctctcccccaaccccaaatctggctatattatttatttacataaaataaattagttgaagtgtggtttagaaaagagagttttcttaaacctgagattctcaactgaatcacctgtggaattttttttttttaattggaaaggctgggacactactcttaggcctactgaataaatctttcaacctgtgtcttttgaaagtttcacagatgattctgatggtctcaagattgagaagcactgcatttaaccagcaccaactgaacaaacactgtaggctaagtataagagagatggcaagagctgggtcagggtggtgcatgggatttccaattatacataattcctcccttcaatgaacaaagccatccataactggggcacctgcttctttgggctaaaggtgaacaatggcagccaccttgtcctggaccctattgtgactgttactccagcagaagccctggggttcatgctgttagttagaagtcacccagtatgactaagttgaggggcagtgttcagaaacagtgttactagatggatgttatttcagtaggaacagtattgtgtgttccctgtcagcatttgaggcggaaacccactgcactgtcagaacaaccagggagatgaaagaagatgtcagatactaaaaggtgcagacagtccttgtgtttggtaaaccttacagggtttatctgaaagagaaaatggatgcagaagtacatgaaaaaactgtgttattccaaatagatgtgctgttttcccagttcataggagtcggtaatttttgggttcagggcaaaaaggcaaaggttgaagatgctgtgatgatcacgtccttaccctcctggaatatttcctttttgaaagcttctggcatcttccactgagttcatgttttaaacagttgggaggatgaattgaagggcccttatcccaggtctgtggtttgattataaatggtaaagccataacctgtccacctccctctcctttatcttgacaggggttggggagacagcagattgaacaaggaaagaattgtctcctgagttctttgatcatgttaacttttatttactgttgtatagtcacattttctagactgctaaaattggtgaaatcaggacaggaaataactgtttttacgtgtataagtatacaaaagttattcgagatgagttacactgcatttctttcagtgtgctgcctgccactgctgcctttgtgtgattttgctctatatgttctgctagacaaatttaagggaggtttcagacagcaaaactccccccaaagcatctaccagcataatccctatcaaaatcccaacaacgttttaatttttttgcagaagtggaaaaaccgatgttaaaattcatatggaattggccgggtgcggtggctcacgcctgtaatcccggcattttgggagtctgagtcaggcagatcacttgaggtcaggagttcgagaccagcctgaccaacatggtgaaaccccatgtctactaaaaatataaaaattagccggatgtggtggcaggtacctgtaatcccagctacttggaaggctgaggcgggagaatcccttgaacccaggagatggaggttgcagtgatccaagatcacaacactgcactccagcctgggtgatacagtgagactgtgtctcaaataaataaattaaataaataaataaataaattcatatgtaattgcaaggggctcttaatacccaaaacccaaatagccactttgttctttttcaagaacgtacttccttatatcaaaacttattacaagctatagtaatcaagactgtgtggtactgtaccagcataaggatagacatatgggtcagtggaagagaattgagagtctagaaataaacccttatatttatgagcaattgattttgtccgggatgccaagactagtcaatggtgaaagagtagtgtcttccacaaatggagctgggataacaggatatcacatgcaaaagaatgaagttagacccttacctcatatcatgtacaaatattaactcagaatggatcaaagacccaatggaagagtgaaaactataaaactcttagaagaatacaagggtaggctgggcgtggtggctcacccctgtaatcccagcacttttggcatcaccagaggtcaggagtttgagaccagcctgaccaacgtggagaaaccccgtctgtactaaaaatacaaaattagcagggcgtggtggtgtgcgcccgtaatcccagctactcgggaggctgaggcaggagaatcgcttgaacccgggagatggaggttgcggtgagccgagatcgcaccactacgctccagcctagtcaacaagagcgaaactccatctcaaaaaaaaaaaaaaaaaaaaaaaaaaagaatactacaagggtaaatctttatgaccttggagttggcagtagactctagatatgacactaaaagcagaaacaacaaaaaataatgaattggatttaatcaaaattaaaaacttttttgtgtaaaagtatactatcaagaaaatgagaagacaacccacagaatgggagatatttgttaatcatatacctgataagaatctatgctgctgtctaaatgtttatgtctccccccacccaattcatatgtgaaggcctcaaccgcaaggtgatgggattagtgcataaggataaggatggaggcccttgtggccatgtgtggtggctcatgccggtaatcccagcactttggaaggcggaggcgggaggattgcttgggcccaggagtttgagaccagcctgggcagcaaggtgagactccatttttacaaaaatttttttaaaaaaagaaaagaggcccaagagagaaaccccctaccctttctgccattagaggaagtgggccttcaccagacagagtctgccaacaccttgatcttggacttcccagcctccagaacagtgagaatttctgttgtttattagctacccagtctgtggtattttgtaagagcagcccaaatggactaagacattctagtagcacaatatagaaagaacttttacaactcaatgaaaagacaactcagaaaatgggcatggtagaacttgtcctgtgaagaagccaagaccaaaaaaaaaaaaaaaaaatggacataggacttgaatagacattccaaagagtggcaggtgccaacaagcacatgaaaagatgatcagcatcatgaatcgttagagaagtgcaaattgaaactgcagtgagataccacttcatggccagtaggacagccatttcctaaaaaaaaaaaaaaaaaagtattggtgaggatgtaaggaagttagaactctgatacattgctggagggaatgtaaaatggtacagctgctgtgggaaacagtttgaggttcctgaacaagttaaagataaaatcatcatatgattcagcaattccgcttctaaggatatgtcccaaaaaattgaaaaagtgtttaagggccaggcgcggtggctcacgcccgtaatcccagcactttgggaggccaaggcgggcggattacctctggtcaggagtttgagaccagcttggccaatatggtgaaaccccgtctctactaaaactataaaaattagccgggcttggtggtgggtgcctgaatcccaactactcgggaggctgaggcaggagaatcacttgaacctgggaggcagagtttatggtgagctgagatggtgccattgcactccagcctgggcaacaagaatgaaactccgtcaaaaagaagaaatgctcaaacaaaaacgtgtacacctcatattcagtctaaatgcccttcagtgcatgaatgaacaaaatgtagtatagaatggaatacatgttacactgaacatttgcttatttccgttttgtaatttttttttagtgacaaggtctcatttctgttgcccaggctcgagtacagtggcacaatcatgactcatggcagcctcagactgccagggatcaagtgatctttctgatcttcccaacttccttatcttcctgactcagcctacctgtagctagagctagaagggcccctgggtaatttttttttttttgagacggggttacactctatcatccagaatggagtgcagtggggcaatctcagctcactgcaacctccacatcccaggctcaagtgatcctcctgcctcagcctccctagtagctgggactgcaggcatgtaaaaccacacctggctaattttttgtatttttagtagagaaagggttttgccatgttgcccaggctgatctcaaactcctgcgctcaagtgatctgcccaccttggcctcccaaagtgctgggattacaggcatgagccacaatgcctggcctgtgggtaattttctttctttcttttattttttatttttttttggagacagagtctcgctctgtcgcccaggccgaagtgcagtggtgtgatctcagcttactgcaagctctgcctcccagttgcatgccattctcctgcctcagcctcccgagtagctggggctacaggctcccgccaccacgcctagctccatttttgtatttttagtagagacagggtttcaccgtgttagccaggatggtctctatctgcggaccttgtgatctgcccacctcggcctcccaaagtgctgggattacaggcatgagccactgtgcctggccgcctgtaggtaattaaaaaaaaaattttttttgtagacacaggtcttgctatgttgcccaggatgatctcaaattcctgggctcaagtggttctcctgccttggcctcccaaagtgctgggattataggtgtgagccaccacgcctggccctcagtatttttaaaaattctaatttccatttacagctctactaaatatttcatcgagtcagcagattggttataaatataacgaaaattcatatgtatggcttttcttttttttttttttttgagacagagtcttgctctgtcacctaggctggagtgcagtggcataatctcgcctcactgcaacccccgcctccggggttcaagtgattctcttgcctcagcctcctgagtagctgggactacgggcatgcgccatcacgcctggccaatttttgtatttttagtagagatgaggtttcaccatgttggccaggctggtgttgaactcctgacctcaagtgatccacccgcatcggcttcccaaagcgctgggattacaggcatgagccacctcgccaggcctgtgtatggcttttcttttaaaaagtttacatgtcatatttaccacattacattcattgagtcacatcattcatcacatcatttagtcacgtgactgggtaacaagcatttcagagatcaaaaggcttcgtataattagtaaagaaaccttttatttatttatttagagacagagtactcagtgtgtcacccaggctggagtgcagcgtggcctgatcatagctcactgtaacttcgaggctgcagtgagctgtgatcatgccactctactttagcctgggtgacagagtgagaccctgtctcaaaaaaaaaaaaaaagtaattatactatgcatattgcatcatgagcatttctctaagtcagtagataggaagccatattatattccatatttaatcaaacattcccctgttgataaagatatatttatagtttttatcattatagattatgcaataaatgtctttgtacttataacctgtatgtgtgtgtttttatttcttttggaaggagtcctaaatctaggatttctaggctaaagggtatgtgtgttttgtttggtttgcctgatttttttttttaaaaagtttattatttattttgagacagagtcttactctgtcacccaggctggagtgcagtggcgcaatgccggctcactgcaacctccgctccccaggttcaagcgattctcctgcctcagcctccggagtagctgggattacaggcgcctgcaccacacctggttaatttttgtatttttagtagagacggggtttcaccatattgaccaggctgatcttgaactcctgacctcgtgatccacccgcctcagcctcccaaagtgctgggattacaggtgtgagccactgtgcccggcctattttatattttttttagagacagggttttgctgtcatccatgctagaatgcagtggcacgagcatagactcgaactcttgggctcagacaatcctcctgcctcagtatcccgagtagccaagagtacaagcgtgtgccaccacacccaactgacttttaaaaatttttgtagatatggggtcttgctatcttgcccaggctgatcttaaactcttagcctctggtgatcctcctgcctccaaaagtgctgggtttacaggtatgagccattgctcttgcctggtttacctgttttagaaaagaatacctgtacattgttaattttttttgtccaggagcttcagaagggtacaaaaattccctcctacttctggccccctgacctccaaactccctcatcagaggcttcttgaaatattccagataattctgtgcacatacaaatataaatatatatccctgcttttccccaatgtaaataaacggtagcacattttacccattgttctgaacctcgtttttgcaacttaatgaactgtcttggagatttttccttattacatataaatctatcattttgtttagcagttgcattatatgtcatcatttggatacattcatacttcattgtatcacctatcaagggacattagatggctttcatttccttctacaatggctaatggtgcattgaacatacttgtatatacttttatgcagatttgcacatatatttgtaggatattcctgtaacataagtggaattgctgggtcaaaggatatgggtaaatcagagtgttttggggtgttacccagttaccttctaaagaagccaaattggccaggcgtggtggctcatgcctgtaatgccagtactttgggagaccgaggcaggtggatcacttgaggtcaggagtttaagaacagcgtggccaacatgttgaaaccccgtctttactaaaaatataacattagctgggcatggtggcgcacccctgtaattccagctactccagagactgaggcaggagaatcgcttgaacccggaaggtggaggttgcagtgagccaagatcacaccactgtactccagcctaggtgacagagcaagactgaaaaaaaaaaaaaaaaaaacggaggctgaatcagtttccattccgttaacaatgaatgtctttttactcatatccacacactcacagaatatatcatgaaacattttgtcttttactatttcagcggttaaaaattggtgtcttgtagctttactttacatttctttcattgaggaaacgagtattttcttcacgtgattaaaagctacttgtttacctatgaccttatgtttgtgggctttgcattcttttagattgtgtgattaatctttttcctattggtttgtaagattatgtgattaatctttttcctattgatttgtaagaactctatattgtggaaatggatatagtgttacaatgttacagatagtttttaccagtttttatcatttgacttaaaaaaattttttttcttttttgaggtggagtctcaccatgttgcccaggctagacttgaactcctgggctcaagtgatccccctacttcagcctcccacgtagctgggactacacctatgtgctactgtacctggcttggctttgacttttaataaaattttttccatgtagagctttacagttttttgtagtaaaataacttttcttgtatgcacataccttcttccagtgtttgactcacctttacgttctcttaatgatgccttgtaatgaacaaaggttcttcaaagctggaggcatcacattacctgacttgaaattatactacaaggcctcttttgggagagtgaggggaaaggatttcttgagagcttgagaccagcctcggcaacatagtaagactccatctctaatgtacctgccccccacgtccccccaaaaaaattagctgggcatggtggtgcacacctgtggtcctagctactcatgcagtaactaaaacagcatggtacttgtacatatttttgtaccatagatcagtgggacagaatagagaacccagaagtaatgccacttgcctgcaaccaactgatcttcaataaagttgacaaatatgcagtgggggaaggacacgctattcaataaatagcgctgggaaaattggctaaccatatatagaaaaatgaaaccgtacctctatctctcaccgcatacaaaaattaactcaaagacttaaacataagacctgaaactctaaagatcttagaagaaaccctaggaaaaactcttctggatattagcctaggcaaagaatatatgactaagacctcaaaagcaaatgcaacaagaagaaaaataggcaaatgggacttaattaaatgaaaacacttctacacagcaaaagaaataacagagtaaatagacaacctatagaatgggagaaaatatttgcaaattaagcctctggcaaaggactaatacgtagtatctccaaggatctcaacaagaaaaaaaaacccattagtaagtgagcaaaggctgggcgtggtggctaacacctgtaatcccaggactttgggatgctgaggcaggaggatcacttgaggccaggaattagagagaaagtaggcaaaggacaagaacacatacttctcaagtgaagacatacaagcggcaaagaaacatgaaaaagtgctcacatcagtaatcatcagagaaatgcaaatcaaaaccacagtgagatatcatcttacactggtcagaatggctattattaaaaagtcaaaaaacaacagatgttggcatggatgcacagaaaaggaaatgcttatatgctgttaatgggactgtaaattactataacctctatatagaaaacagtatggaggccaggtgcggtggctcactacctgtaatcccagcactttgggaggctaaggcaggcggatcacttgagtgcaagaccagcctggccaacatggtgaaaccccgtctctactaaaaatacaaaaatcagctgggcgcggtagtgcacgcctgtaatcccaggaagctgaggcaggagaatcgcttgaacccgggaggcagaggtttcagtgaccttagactgtgccactgcattccagcctgggcgacagagtgagactctgtctcaaaaaaaaaaaaaaaaggttagtggcttttgtgtccttggttagcaaggtcttctctactttgagattataaagtaattttctgcatgttttcttctagagtttttatttttacattaaaattgttattggccagctgcgtaaggcacctggtggtgctctaggcactgggttagcgtcccttatgccgagctctaaaccttcagaatgcccttgccgcccctggctgagttcacagtggctgaagctgttcccataagaccctgaatctagcagccactgtgtactatacctggagcagtccaactgggtggactgtgctcagcatccgaacatctagacaggcaaagccattcccagtggtggcccaaaccagcaaacattgtgtaacaatttttttgcaatcaatttttcttttcttgttttttgagatggagtcttactttgtcgtcacccaggctggagtgcagtagtgggaacttgggtcactgcatcctctgcctcccaggctcaaacagtcctcccacctcagcctgtattctatttctgtagctgagaatataggtttcttccagcacacctggctaattttttattttattttttatttttagtagagatagggttttgccatgttgcccaggctcgtctcgaactgggctcaagtgatttgcttgccccagcctctcacagtctgagattacaggtgtgagccatcatgcccagcctgcagtttttcttattaaaacttaatgggggccgggggcagtggctcactcctgtaatcccagcactttgggaggcctaggcgggcggatcacctgaggttgggagttcaagaccagcctggccaacatggtgaaaccccgtctctactaaaatacaaaagttagccaggtgtggtggtgcatgcctgtaatcccagctacttgggaggctgaggcaggagaattgcttgagccctggaggcaggggttacagtgagccgagatcgtaccactgcattccagcctgggcaacagagtgagactctgtctccaaaacaaaaaacaataaaacaaactaatggggctaggcatgatgttatattcttgtagtctctgaaacttgggagactgagaagggagaattgcctgagcccatggttcaaggccagcctgggctgtgtagtgagacccatcgctgcaaaaaaaaaattgtttaaataaaattagccagcatggtagcacatgcctctactcccagctattcagtaggctgaaatgggatcgcttgagcccaggaggtcgaggctgcagtgaatcataatcgcctttctgcactccagcctgggcaacagagcaagaccctgtgtcaaaaaataaataaataaatgaaacggccaatatagaataaaggtgctaaaaaaggcataggagggaatcttcatgactttggggtaggcaaaaaattcttaaacagggacacaaaccactaaccataaagaagtgacaaattatgtgacattaaaattaagaacctttataaggcaccattaagagggtgtaaagggctgtgcatggtggctcatgcctgtaatcccaacacttcaggaggccgaggcagaaggatcgctttagcccaggagtttgagatcagactgagcaaaatagtgggaccctgtctgaacaaacaatttaaaaattagccgggtgtcagggcatgcgcctgtagtcccagctactctggaagctgaggtgggaagatcacttgagcctgagaagccaaggctatagtgagccgtgattctgccactgtactccagcctgggcagcagagcaagactctatctcaaaaagggtgtaaagataccacagactagaagatgtgtgtgatgtgcacgggactagtatcatatgcacaatgacaaaggattaatatctaaagaaatcctaaaaaaaaaaaaatagaaaaacaggcaagagacttgagtggccaacaggtatatgaagaagtgttcaacttatttagtcaaagaaaatgcaaattaaaccacagtgagtgatcactaaactcagcagcatgaacaaaatgaagataactgctagacaatagctagtgtggtaaggacttcctgtttgagccatggttatttagaagtatgttgcttaatatcaagtgtttggagagttccctcatttttctgttactggtttctagtttaattccattatggtcagagatcatactttatatgatttcaatttttaaaaatttgttttgtgacttttatggcttagaatatagtccatcttgagtgctccaagcttgaacacttgaaaacactatatatttctctgttgttaggtggagtgtcctctagatgtcagttagatccagttggttgatgatggtgttcaggttgctgattttctgtctactggttctatgtattgagaagtgttgaagtctccagctctgatagtggatttgtctgttcttcatttgtcagtttttgtttcatttattttgaatctcttttgttagatgcgtatgcacttaggattatgctgtcttgatgaattgaccttttttatcattatgtaatagccctcttttatttattttattttatgttttttagagacagggtcttgctatgtcacccaggctggagcacggtgatgtgatcaaaactcactgcagctttgaactcctgagctccagtgattctcctgcctccgtcttctgaggagctgggaccacaggcacatgccaccatgcttatttaaattttttttttttttttggtagagacagggtctccctatgttgcccatgctggtctgaaactcctagcctcaagtgatcctcccatgttggccaagtgctgagactacaggcgtgagccactgcacccagccctctttatcactggtaattttctttgctatgaagtctactttgcttgtttgacattaatatagccagtccagctgtcttttgattagtgtttgcatgacatatccttttttttttttttttagacagggtggtcttgctctgtcaccctggctggagtgcagtggcatgatcacggctcactgcagcattgaactctagctcaagccatcctcccacctaagcctcccgagtatgggactatgggtgtgtgccaccatggctgggtaattttattttttatttttttatagagacaaggcctcactatgttgctcaggcccgtctggaactcctgggctcaagtgatccttccacctcagtctcccaaagtgttacatgagccagtgcacctggcttgtctgtgttttcttttgtttcctatgactttgatatgatatccatgttcttttgcatgtggatatccagttttctcagcaacatttattaaaaagactatcttttccccgttgaatggtcttggcatccttgtcaaaatcatttgaccatatatgccaggatttatttctgggctgtcaactctattccaatagtctgtatgtctgtcttcctgccagtaccacattgttgtgattactgcagtttgttagtaagttttgaaatcaggaagtgtgaatcctgaatctgtttttctttttcaacatggtgttggctatctggggtccgtggagattccatatgaatttcagcatgtattttctatttctgcaaaaaaaaaaaaaaaaaaaaaaaagtcattgggattttgcttcagtttacatatgaatcagtagctcacttttgggagtattgacatcttaacaatattaagatatcttgtcttaacaatatcgtccaacccatgaaagtgtgatgtttttccttacttatatcttcattaatttctttcagcgatgttttgtagttttcattgtatgaatcttttacctccttggttaaaagtcctaggtattttattctttttaatgctattgtaagtggaattgtttttataatttccttttcaaattgttcagtgttagtatatagaaatgcaaatgatttttgtgtgctgactttgtatcctgctgctttgctgattctgttattgtaattattttttgtgtgtaatgtttaggcctagttttttacatatcatattaaatctgtgaattaattttacttttttctttccaatttggatatatatttttttcttaattgctatggctagaacttccagtactaggttaaatagtagtggtaaaggtgaatgttctcatcttagaagaaaattttttagtcattcactattgagtatgatgttcattcaatgtgcatttctgtttttttctttcttttttttttgagatggaatctcgctgtgtcgcccaggctggagtgcagtggcgcaatctcggctcattgcaaacctccgcctcccgggttcacgccattcttctgcctcaggctcccgaatagctgggactataggcgcccgccaccacgcccggctaatttttttgtatttttagtagagacggggtttcaccgtgttagccaggatggtctcgatctcctgacctcgtgatccgcccgcctcagcttcccaaagtgctgggattacaggcgtgagccaccgtgcctggctctgtttttttttttttctttaaaaacttttaggctgggcgcagtggctcacgccggtaatcccagcactttgggaagccgaggcgggcggatcacttgaggtcaggagtttgagactagcctggccaacatagtgaaaccctgtctctactaaaaatacaaacatttgccgggtgtgatggtgggcgcctgtaatcccagctacttgggaagctgaggcagaagaattgcttaaaccctggaggcggaggttgcagtgagccgagattgcgccactgcactccagcctgggcgacagagcaagactaagtctcaaaaaaaaaaaaaaaaaaaaaaattgtaataagctttctcgggtttaacaatgtaggtttttcaaatatggctttatgttgagatatttcccttgtacgtttagtttgttgaatgttttcattttgagagggtgttacattttgtcacatgcctttgctgcagcaattgagatgatgtgatatgtttcccattattccattaatgtggtatgttacattgaattttgtaggttggaccatccatgcatttcaggagtaaatcccacttgtttgtggtgtataatccttctaaaatgctactgaattcagtttgctagtatttgtagaggatttttgcatcattgtgcataagggatattagtctgtggttttattttattgaatgcctggttctgatatgagggtaatactggcctgttagaatgatttaggaagtatttcttactctccacttttttggaaaagttttgagaagggttggtactactagttgttgtttaaatgtttggtagaattaatcagtgaagccttcaggtccaggacttttcttaggagatttttgattactgattaaatctgcttactagttacaggtctcttcagcttttctgtttgtgatttagtcttggtaggggttttttaatttgtttttttgtttttaaaacagagtcttgctctgttatccaggctggagtgtagtggcacaatcttggctcactgcaacctctgcttcctgggttcaagcgattctcctgcttcagcctcccaagtagctggggctacaggcacccgccaccatgcgcggctaatttttgtatttttattttagtggagatgagattttaccatgttggccagactggtctcaaaatcctaaccgcaggtgatctgcccacctcggcctcccaaagtgctggcttgcaggcgtgagccaccacgcccagcccttgtttgttttttgttgtgtgtgtgtgtgtgtgtgtttgttgttgttttgttttttgttgtttttgttgttgttgtttttgagacggggtctcactttgttacccagactggagtgcagttgcgtgatcacagctcgctgcagcctcgacctcccaggctcaaaacgatcttcccaccttggcgccccaagtagctgggaccacaggcacacgccaccacacctggctaatttttgtacttttttgtagagacaggttttctccatgttgcccaggttggccttgaactccaaagctcagacatctgcccacctcagtctcccaaagtctgggattacgggcatgagccactgtttctggctatttctcccttcaattctgtcagttttgctttatatattttgatggtctgttattagttgtaatctgtttataattttatcttcttgctgtattgaacctttatataatgtccttttttaatcttttttttaaatttaaagtctcttttgtcttatagtaatagagccctgctctcttttggttagtgtttgcatggaatatgtttttccatcctttgactttcaatctagttgtgtctttggatctaaagtgattcttttttgtagtcccagttacttgggaggatgaggcaggaggattgcttaagcccaggagttcaaatctagcctgagcaacatagagagaccctgtctctctaaaaataaaagtaaaaataaaaaagtaagtttcttatagatggcatataattgggtaatgtagtttttttccacgttgccaatctctgtcttctgattggagagtttaatcaatttacacttagttactgatcaggaaagacttatgtcattttgctgtttcttttctatataccttataggattttatttatttatttttttagagatggagttttgctgtcacccaggctggagtgcagtggtgcaatcttggctcactgcaacctccgcctcctgagttcaagcgattctcctgcctcagcttcccaagtagctgggactacaggcgcatgccatcacacccagctaattttttgggtttttttgttggttttgtttttgagacagagtcttggtctgttgcccagactggagtgcagtggcaatcttgactcactgcaaccaacctctgcctcccagattcaaggaattttcctgcctcagcctccctagtagctgggactacaagtgccccccaccacacccagctaatttttgtatttttagtagagaaagggtttcaccatattggtcaggctggtctcgaactactaacctcaggtgatccacctgcctcggcctcccaaagtgctgagattacaggtgtgagccactgtgcccagccaccttataggtttttttgttttgttttgtttttaaattgagacggagtctcgctctgttgcccaggctggagtgcagtggcatgatctcaggtcactgcaacctctacctcccaggttcaagggatcgtcctgcctcagccccctagtagtgggattataagcacgcactaccatgcccggctaatttttgtgtttttagtagagatggggttttgccgtgttgggcaggctggtcttgaactcctgacctcaggtgatccacccacctcggcctcccaaagtgctgagattacaggcatgagccactgtacccggccatggattttaaaatctctaattacctgcattattgtcttcttttgtgtttagctggagttttgtaggttttcttttttctttttgtagtaacatgtttaactattttctcattttattttgtgtaacattgtaatttgaatttatagcagcgtaatttcagtaacatgcaaaaattctgcttctttatagcttcatctccacccctttcagttgtcacaaaattacattattatatactgtgtgtcccaaaacataaactcataattgtttaaatgcattagtctgctaaggcgtgttttatggacccgaatgtgatctatcttggtgaatgttccatgtgagctttagaggaatgtgtatcctgctgctgttggatgaagtgctctatagatgtcaattctgtctggttgcttgatggtgctgttgagttcattatgtccttactgattttctgcctgctggatctgtccactttgatagattgatgttgaagtttccaactataatagtgaattcatctgcttttccttgcagttcttagtttttgctttgaggattttgatgctctgttgttaggcgtatacacataaggtttgttacctcatcttagagaaatactcctttataattttgtaatgtcctttttctatccctgataattttccttgctctgaagtctgctctgcctgaaattagtatagccactgggactttctttttgattcctgctatgtctttttccatctctttaattttttctctcttttttttttttttaaagacgagagtttcactcttgttgcccaggctggagtgcagtagcttgatctcagctccctgcaacctccaactcctgggttcaagcaattctcctgcctcagcctcctaagtagctgagattacaggcatctgccaccatgcctgggtaatttttgtatttttagtaaagacggggttttaccatgttgtccaggctggtcttgaaatcctgacctcaggtgatccgcccgcctcagactcccaaagtgctggtattacaggagtgagcaactgtgcccagcctcatctctttaattgtaatctacctatgtttttatatttaaagtgagtttcctgggtcttcttttaacattttttgcaaggtggatttactgatgacaaattcccttaatttttgttcttctgagaaagtctttatttctgttcatttttgacccaacacatgcttgggtcttatttttgaatatattctgacattctctattacttatttgatgtatttagaacattgacatttaaagtgattattggtacagttagattaatatctgccatatttattactgttttctgttgcttttattcttcccttttctttttattttggtcttccactctttttctgctttctctggctttaattgaacattttatatgattacattttttcctctcttagcatgccaattatgcttcttattatatacttttaaaaagtcttggctgggcgcagtggcccatgcctgtaatcccagcactttgggaggccaaggtgggtggatcacctgaggtcaggagtttgagaccagccttgctaacatggtgaaaccccatctctactaaaaatacaaaaaattagccgggcgtggtggtggacgcctgtaatcccagctactcgggaggctgaggcaggagaatggcttgaacccgagaggtggaggttgcagtgagccgagatggcgccattgcactctagcctggttgacaagagcgagactccatctcaagagaaaaaaaaaaaaaaaagtctttgcccttgagtttggtatttacagttacaactaatccaattccactttcacctgatgctataccacttcatgggttgtacaagttccctctaacagagtattctcagttcatccttactgtcccttatgatattgctgtcattaatttcacttattcaaaagcgaaattattatttttattattatttttttaagaccgagtctcgctctgtcgcccaggctgaagtgcggtggctcgatctcggctcactgcaagctctggattccggattcacaccattctcctacctcagcctcccaagtagctggggctacaggtgcccaccaccacgcctggctaagtttttttgtatttttagtagaggcggggtttcaccatgttggccaggatggtctcgatctcctgacctcgtgatccgcccgtctcggcctcccaaagtgctgggattacaggcgtgaaccaccgcacctggccataagtgaaattattgacagcaatatcataagggacagtaaggatgattattgacccaatcattgaatacattgttgcgggtttgtttttgtttttgttgtcgagacagggtttttttgtttgtttgtttgttttttgagacagagtttcgctctgtcacccaggctggagtgcagtggcgcaatctgggctcactggaagctccacctcccaggtttgcaccattctcctgcctcagcctcctgagtagctgggactacaggtgcccgccaccatgcccggctcattttttgtagttttagtagagatggggtttcactgtattagccaggctggtctcgaactcctgacctcgtgatctgcccacctcggcctcccaaagtgctgggattacaggcatgagccactgtgcctggccgagacagggtcttggtctgtcgtccaggctggaatatagtggtgcgatcatagcacaccacacccttgaactccagggctcaaatgatcctcctgcttcagcccctcaagtagctgagacgacaggtgtgcaccaccatgcctagataatttttttttttaatttctagtagagacagggtctcgctatgttgcccaggctgatcttgaactcctggtcttaagaagtcctcccgcctcagcctcccaaagtgttgggattaacaggtgtgagccattgtacccagcttttaaaaatattaataatagagtcagagtgttactatgtggcccaggctagagtgcagtggctattcacaagtgcaatcccatgactgatcagtacaggagttttgacctgcttcatttctgacctgggcttattcacccctccttaggcaacctggtggtccttaaggaggggaggtcaccattttgatgccaaacttagtgcagacactcagtccaaatagcccagaactcctggactaaagctatcctgcctcagcctcttgagtaactgggtctagaggcatgcaccaccatgcctagctgttgctgttattaccttgaacaaactgttaaaaataagttaaaaataagaaaagtagaccgggcgtggtggcttttgcctgtaatcccagcactttgggaggctgaggcagatggatcgcttgaggtcaggagttcaagaccagcctggccaacatggtgaaaccccatctctactaaaaataaaaaaattagctgtgcgtggtggcgtgtgcctataatcccagctactcaggaggctgaggcaggagaattgcttgaacctgggaggcagaggttgcagtgagccaagatcgcaccattgcaccccagcctgggtgacagagccagactctgtctcaaaaaaaaaaaaaaaaaaaaaaagtaagaaaagtaaaatattttgccttcacttatttattctctaatgctcttcctttataggtctttatttctgacctgtattattttccttctttctcaaacacttcttaatattttttgcaaggcaggtctactgatgacagattctgttaatttttattcttctgagaaagtctcttctcttttgaagggtaattttactggatacagatttttaggttaatagggttttttttttttccttacaacactataaatattccctctactgttttcccttgaataatttctcaaagaagtgtgatgtaattcttatccttactcctttataggaaaggaatttatttccctgtggcttctctcaagattttctctttgtctttgattttctgtagtttattgtatgcttacatgtagttttgttctgtttttgttttttgctatttatcctacctggtattctgtgagctccccagaactgtgtttggcatctgtcatcagttttggaaaattctcagttcattattgtttcagatactttttctgctcatttctgcctgtcatcatcttctggattcccattatgcatatttatgcctttctaattgtcccacagttcttggatattctgttccatcttgttcattcttttctctctgagtttcagtttgggaagttgctactgacattttttttcaagctcattgattctttcctttgactgtatctaatcgatgaatccatcaaaggcattcttcacttttcttagttttttttgtttctagcatttccttttgattctttgagtctttatctctgctgaaattacccatctgttttagcatatcatctactttttccattagagcccttagcatattaatcatagttgttttaaatcagagttgttagctgtgataattctaacatctctgctatttctgagtctgggtttgatgcttgctatatctcttcaaagtctgctttttaatcgtagtatgccttgtaatttttttgttgaaaaccggacttgatgtacttgttaaaaggaactgaggaggccgggcatggtggctcacgcctgtaatcccaacactttgggaggctgagcggggaggatcgcttgagcccaggagttcaagaccagcctgggcaacgtagagaccccgtctctactaaaaatagaaaaactaactgggcatggtggcacacgcccgtaatcccagctactcaggaggctgaggcacgagaattgcttgaacccgggaggtgcaggttgcagtgagccaagatcatgccacagtactccagcctgggcaacagagtgagactctgtctggggaaaaaaagaaaaaaaaacaggccaggcacagtggctcatgcctgtaatcccagcacttcgggaggccaacgcaggctgatcacttgaggtcaggagttcgagaccagcctgatcaacatggcgaaagcctgtctctactaaaaatacaaaagttagctgggcatggtggcaggcgcctgtaatcccagctacttgggaggctgaggcaggagaatcgcttgaacccaggaggcagaggttgcagtcagtagagattgagccagtgcactcctgcctgggtgacagaatgagactccatctcaaaaaaaaaagaaaagaaaaggaagtaactgaggaaaatcagcctttggtgtgagttttttagtttatctggctaggcgttaggctctgtctgctgtttgctgtaactataggtgtcagaactaaaatttcctcctgggtctgtttttccttccttgggtttccgtagagacttcttaaataaagtctgagatatgcaggtttttccgttctattctcttgttattatataggagccctatttatgtggtgggaaggaggggaagtgtcctaagtcctgtgactaggtctcagtctttttgtgagcctgtgcccctggcctgtgacttttaccagcacttctcagtttggggtttttgcctccttaggtgaaacaggaagggagagggggctggagttaggccctttctttcctgcctgtggaaggcttaggggtgcttaagttgggtcaacctttcccttaggctgatgaggatcttataaaacctaattaagttaggctcttgtaaaatagtttcctttgaggacaggccttgttaagaacaggaagctctagacatagtccacatggctgctttccccctcccccgccagaagtatgagaggatctttctctgatcttgactgtgagagtctggtagggctcatggaggtaaagtccacattgagtctccagcagttcatgaattgctgtgtaaattttcctaccctcgtttccactcctgggctcctgctcaggtaagctccagttcaccctgttgacatgtctcctgtgtcgggggcagtcatttgccctgtaacttcagttctctgatgcagctaaaaggggttgtttgccagttcagtgttgtttcttgtaaggatggtagtgacaacttctaagctcctgacatgcctcactgaagaatgaaagtcctttgccttcattttttaatgatatttttggtagataaaaataattccagttgaccagtttttgtgagtgtgtgtgtgtgtgtgtgtgtgtgtgtgtgtgtgtttttcccagtactttaaagatgttacttctttgtctttccgcttacagcagaagtatcatgtcattcttacctatatttatcagtacataatatgctttttagcttaactgcttttaagactttttaatttaacactggttttctacaacttgattatgatgtgtcttggtgcagtcttcttcaggtttattttgtttgggtttttcttttttttgaggcggagtctcgctccattgcccaggctggagtacagtggcgcaatcttggctcactgcaagctccgcctccagggttcacgccattctcctgcctcagcctcccgagtagctgggactacaggcgcccgccaccacactcagctaattttttgtattttttagtagagacggtgtttcaccgtgttagccaggatggtcttgttctcctgacctcgtgatccgcctgcctcggcctcccaaagtgctgggattacaggcgtgagccaccacgcccggcctctgtttgggttttattgactttcttggatgtgtgaattgacagttttcatcatatttgggaaattttgcttatttcttcaaatatttctgtctcctctttgtttttcttctaggacttccaattatgtgcacattagacagcttgatagtgtccaataattttttctctctgccttatttgagtagtttcaattgctatgtcttcaaattcatggatcttttctctttcagtgtttatttggtgttaatcccatccagtgcatcttttcatttcaggttttgtttttactgtctctggaagttccatttggatctttctatatcttccgtgttctcatcatgctcatgtttccctttaccttcttaaatatatgccgaactattgtccttgtctgctagttcctttatctctgtcgtttctaggtcagtttctattgactgtgtatggttataggtcatattttcctctctttcttgcatgtctgttatagcagttatcagtttattgcgtctcaactctaaatccacccttcattgccacttgtgatactggaacatttctcccttgccccatgctggtctttgtcagtggaaagcgttgagaggaaagggcatttcttggttctttgtgctttgcttacagctgtctgtgacatgagctggtatgtgggacatatagggtgctcaggcagctttcaggcaggtcccatagcaccccagctagccgcctggcagctttctggtgagttcaacagcacccccacaccaaccccccggctttccagcactcctcaagcagccttccagctcactgtgttagcgtcctcgcacgtggttcttggccctcagttctgtcctgggacagcccagtcgacgtcatcatctagtgcgtgcttttgatcacaccctctcctaggtctgaatccttcccttagttacctccctttactctaggatgttctgtggatttctcttttgttccctcttagtcaactccctgtaaatagttaataattcttatgctaaacttcccttgtttaagctaccatgtggtttctgtcccctggtgggaccctgactgataggcccggttattttttaaattggatgctgaatattgtgaatttcaaattgttggccaggcccggtgtggtggctcatgcctgtaatcccagcactttgggaggctgaggcaggtggatcatttgagctcaggagttcaagaccagcctgggcaacatagtgagaccctgtctctgcaaaaaatgaaataaattattggctggtgaattttgttgaattcctttgaataatgttgggtttgggtctggaatgcagttaagtcccttggaagcagcgatcctttagagacttctgaacttttcagtgggtccagtgctgctttagtctgcagttgacttagctctattactaagggtgatggccttctgcggagtctacccaataccccacgaattaggagatctctccacggtggcttgtgggaacacaaaatattccctgtgtgaactctggggattgttttgtttgctacttcctcaggagtctttcctgggccttctcatatagtttttctcacccaggcacagatctgttttcagctaaagactccaggagaccctctgcagatcctggctctgcctctgcagctgcctcctccccaggactctgccctgcaaatagcagcagccttggcctccctgagctctgaactctgtcttcccaactcagaaagactgcaggttccggctgagtttccctgcctgcgctgcagcctggaacccgcctcctggctgtaattggtgcagtcataggatgtgctctcttgtctcccttatcttggaatcactgtcctgcactgttttccaccaactgaaggcaaaagtatgttgtccagttttccaggtgttcagggttccctgttgctgcatcctacatgagtatataaacagagaacaaacaaaacagcctgtcaggagtttgctgaagtttcagaataggtggtgctgggtgagctgatgggcatgagtaacactccccttttccttcttttagtgaccacaatatgaatgggaacagcaagatggcaaaagcttgctgagtggtacagcgccagcctgggtagtggcctccccagcaagttgcatgtcactagcttcctgtggctgtcactcctgggcccaggcacctccgaagatcagcacctcctcatgggctcaagcgaggacaggagcccgtcacccatgagctctcaagggcagagccactgtcctgtctcgatggctccaccgtgactccagtggactttggacagtggggagcaggcccaacagggccactcggatgtggtcactctggatttgggtggatcagcaccaagctagactcatccccagcccccaggtgctgttgctgctcctgcgtgaggccccatccacagctgcagctgtggcagggtggctagtggtggccagcatggccctgctgcagctccacgctgtggggggcgtggccctgaccagcagccacccctccatgtgggccacaggggaggagcttaggaagccgccttggcaaggtgagtggacgcatttacgtagtgagaggtgagaaccagtgccgctccccagagccctgcgattcctggggaggctgaggcttgtagacgccttgcctgctctcctcctggggtgctttcctgttcacagggctgggaccttggagggagaatggaggcagagcctctgtctgcccccgctcaagggcccagcacaggcaggccctctggggagcccctcagtggctggtggggagtctggggcagggtgagggacagcatcttccaccgaccacaggcttgggcagcatctgtcctggaggccatccctgtgggaaggcctcttttgtatgactccttccctgtgaaatggcttctccatgtagttcagccccacaggtgccctcagaaaacacgaagtgctttctgcacgtgtcgcggcccccagagaagaatttggttacagagaaggtgacagctcatggcttcctgagggtggggcagtgggagaagtccccaggggagcttggggcccatggcctcccacaccctgggtggggctgcccactgggaggcccacattgcctcagtgtcctgcaccctacagttcagggtgcctgggggctggaaggagagcaggggccggggaccagtggctcacagggacctggggagaactgtggaaccagccttcccagccgtcccacccaggaaaggagtgggcagagttggaagaaatacagcactgccttggccttggcctcagacccgagggtctggctatagccatggtggtggctgtgtcgtgggggctgcatcatggcactggcagtggccccaggactgtggactagtgcagactagcacagagttcctgctgggctcggggtgggagcccctcctggccgtggagacaggcccacgtcagcccctcaggatctgttgcccaacagctctcagccttttgcttggggcctctttgcgtggaatggttctgagttctctgctatctggcagcatcatcttctgagcactgctctgacagatgccttagtccacagactgccatgccctcccattaggagccatccttgggcactcctgtgtcacccgtagttactccaccatcctgccaggccatgggatgtggaggctgaagagtccaaatgggacagaagcctgtcccctccctccttcctcagagaggccttggttgggctcacactgagtaggggcaaccagcagccggagagagtggagctcttaaactgtggctccagagcagaaggccccctctgacacacctttcatccagcatgttctccgtgagcacctgccacggcccaggccctgctctcggtgctgccggctgagcccagctctcgtggggctcgcatctaacaggagagggtaactacagtgtgagtgagatgtgattcgtggtgaggaatagaggaatagaggaatgaggatgcagaggtcttctgtcctagaggatgcttggctgggcagagggaaacggccttgtgtccctgggggactgtcattgtcgggcacatctctggatgggacatctgtggctggaagctgtccttgtggccgtgctagttggaccagcctggctggttatcagtccgtgtcctcagcccctccccttttcaatgactcattccaggttccgcaggctctgcgtctggtgtggaagagctcacggggaagcactcctgcccaggacccgaggagccggccaccgttcagaaggccccagcttgaaggcctggagagccgcccagcagcacaacacagggaagcttggggaggtgagccccacttcctgctcccgcacaggctcttctccctggggcactggctgggcgggatgctgagaagctgggcatgggcggctgctgagaggcagaggagccagagagctgcaggaaatatcctggggctgggagaccaagataggggctcagggctgccgaggcggctggacctgaggggccaagacccctgagcgaaggagccagagaagagagacggacattaggcactggtctctctagccatttgctgatgaagctgcttagggcagaggagcagaaagtggctgaaaagcagagtgggatttttggcagtttcgtggagttagggaataggttggggcctgtcaggtgcagggccctaagaaatatcccaggctctcatctgggaccaaccctgcctcgccgggacaagccacagctgggctgttctttccaaagactgcagaggagcttagtgtgggtggagttcctgattcactgtctcactgctgcccaccacggagcggagtgggtgagctgtccctgtcgggggacatgtccagaccctccgcccttctgtcacgcacagtccctgacactcagttgaaggcaaccaggtacactgggaaaggggaccaggggaagaaaggtgacagacccacaggagactgagatacggtttttggacatggactttagtatgttaatcacatctgttttatttttttattttattattttatttatttatttattttgagatggagtctcgctctgtggcccaggctggagtgcagtggcgcgatctcggctcactgcaagctctgccatccgggttcacgccattctcctgcctcagcctcccagtagctgggactacaggcgcccgccatcatgcccggctaatttttttgtatttttagtagagatggggtttcaccgtgttagccaggatgtgatttgcctgcctcggcctcccaaagtgctggcattataggcgtcagccaccgtgcccggccaagcacagctattttaaataatagagataagatgatggattgtttcatagaattggaattcataaaaaatataatggaagttctaaaacagaaaagcacaataactgaaatttaaaattcagccaggtgcagtagctcacacctgtaatcccagcactttgggaagctgaggtgaagagtttgagaccagcctgggcaacacagcaagaccttgtctctactaaaaattttttaaaattaggccgggtgcagtggctgacacctgtaatcgcagcaccttgggaggccaaggcaggcagaccacttgaggtcaggggtccaagaccagcctggccaacatggtaaaaccttctctctactaaaaatacaaaaattagccaggtgtggtggcgggtacctgtaatcccagctactcaggatgctgaggcaggataatcgcttgaatctgggaggcagaggttgcagtgagccaagattgcacccctgcactccagcctgggcaacagagtgacactgggtctcaaaaacataaagattttacaaaattagccggggatggtggcacatgcctgtggtcccagctacttgagagactgaggagggagtattgctagcacctaggaggtggaggctgcagtgagctatgaatgtgccactgcactccagcctgggcgacagagcgagactccatctcaaaaaaaaaaaaagaaataaaaaatccagtaggtgtatttaccagcagattggaatcagctgaaaaaaggattagtgctctagaagaaaggtcaatagaaaatacatagtggggcttggcatggtggctcacgcctgtaatcccagcactttgggaggccaaggcaggcggatcacttgggcttaggagttcgagaccagcctgggcaacatggcaaaactccatctctacaaaaaatacaaaaaattagccaggcctggtggcgcatgcctgtggtcggtcccagcttcttgggaggttgaggcaggaagatcacttgagcctgggaggctccagtgagccaagattgtgccactgcactccagcctgggtgacagagtgagagaccctgtctcatttctttaaaagaaaaaaaaaagtaaaaagaaaatcccttgcaactaccaccacaaccagcccactttacactgtgtgtccttttcctggaccctgagggcgccctcccttttcctttctgtggccccctagccttggacagggagggggccctgctgagaaggcctttgtacttgggagagaccgaggtggcttcggaattgggggattacttttcattgcgacccttgttggaaacatcagcacactggagtccagttgcagttcgccttgtggctttgtttaaatcctcattgggaatatgagttctcattgtcctcagggactcaggctgcgggtgtgctaacctccctggtgagaaagtggctttttagacaaacttcttttcatttgcatctctcctcaaagcagaatgcagaaagcggcagcactgggagcgtgtggggagggacggggcagccggcggaggctgagccaacatgccgtggttcaggcccacacctcgtggaaggcagaaggcgagtgctgacattccatagcaggccgggttggggaaggggcggtctgctgcctgctgcctgctgagcgtgactgtgcagctgttgtaagtctttgtgattctgatgtgtggtgatctgagaaatttcccatcctgggttaacactttctttattataaacagaaattaattcatgagggatggcgcaaccaggctggggcgcagaccaagggcagtgcactgggctgtgatgactgcatcctgctcaggttgtgggacatggggttaaaacactgtcacggcaaagacactggccttttacctgagtacaggatagtagccctttgtcctctaagatgctctgtccctggggccagcaaacacctcccaagggagaggagagaaagaaccccgagtagagccagccgagtagagccagccgagggcagataggtcttgtagggctgtgggagccactgcaaccctgggagcttcctgtcagctcaagcccagtgcccagagtgtccaagtgccacctggatgccctgcagtgtccactgtgctgggttctcaaggtttttctctggggggggtctgcggggaacctggagctgctgggtaggaggtgggcttgtggctcagctgtgtccagtggctggctgtggagcgcctcctctgctccagtaatattttcatgggcaagaaagaccactactttcttggccaccgcttcctggagcttgtgttcctggaagccagccataaataagccggccataaacgagggtaaacaggtgcctgagtaaacacaccagagcaaatgagtcatatgggccggcagagatgaacctggggccatggcgggtgtaggggttgggtggggagaggatgtcctctgaaaaggtgacatttaagctgaaactggaatgacaagaaggccccagctctgcaggcagagcggaaggctcagagcttagaatcacgtaggtcatggaaagcattggatttcgtgttagggacaatgagaaactggtgacagattttaagtaggggaataaagagatctaattacacatttgcgagatgttctgagagctgtggggacggctgggacatgtacctggaagcagggcagccaaagggagaggcagtgatgacgggtggtatggaggctgcagaatctggaggacgtgcaggctcagggtgcatggtgcgggcggggctgagggggagcggggcctaggatgatctcaggtattctagcacctggatggtggtggcactatagacatgagcagggaaggccaaggaaataatctggggccattgtggctgcagcaagtttatgatgcctgatgcccgatgcccatcagacctgtctgaggggagatgtcccagccacagctgaagtgtgagacaaagcccctgcttcagaggacagcaggggagtgtttcctaagcaggcgtgaccagacggtgtttctaagatggaaacctgggcatttaattttttgtgtgtggtttcatttttaacattaactaatggttaccttatttttggatgttggatcacatctggcagtattgctttaaaagcttttgatttgtagaattgtaagaactaatcatgggattttttttttttttttttttctttttgagacaaggtctagtagctctgtcacccaggctggagtgcagtggtgcagtcatggcccattacagcttttaccttccaggctcacacaatcctcctacctcagcctcctgagtagctgggactacagatgtgtgcctccatgcctggctaactttttaattttttgtagagacaggttcttgccatgttacctagactggttttgaacttctaagctctagcagtcctcccactgtggcctgccaaagtgctgggattacaggcatgaggcaccacacgcagccagaaaatttcagcatattcaaaactagtattacacatcttcgtgtactcattacccagcctcagggctggcattttgaagcaaatcccaggtactgtaccacttcatctttcaatattttattaatagtatgtgactgtaaaatataaggccaggtgttgtagctcacacctgtaatcccagcactttgggaagccaaggcaggagaatcacttgaacccaggagttggaaagcagcctgggcagcacagtgagatccccaccccatctctaccaaaaaagaacaatttttttttttaaattagccaggtgtggctgggtgcagtggctcacacctgtaatcctagcactttggaaggctgaggcgggcggatcacttgaggccaggagtttgggaccagcctggccaacatggcaaaaccccgtctttactgaaaatacaaaacttagccaggcatggtggcgcacatccgtaatcccatctactagggaggctgagggaggagaattgctcaaacttgggaggccggaggttgcagtgagccatgatggcaccactgtcctccagcatgggcaacagagcaagaacctgtctcaaaagaaaacaaaaccaggtgtgatggcacatggcaggaggctgaggcaggaggatcccttcagctcaggctgcagtgcactacaattgtgcctgtgaaaagccactgcagtggccggatgcggtggctcacgcctgtaatcccagcactttgggaggctgagatgggcggaacacaaggtcaggagatcgagaccatcctggctaacatggtgaaatcccgtctctactaaaaatacaaaaaattagctgggcgtggtggcgggcgcctgtagtcccagctactcaggaggctgaggcaggagaatggcatgaaccccagaggtgaagcttgcagagaatggtgtgaaccccagaggcgaagctcgcgtgaaccccagaggcaggctgcagtgcagagccaagatcgcgccactgcactccagcctagaaagaaaagccactgcactccagcctagacaacgtagtgagaccctgttcctaaaataatttctttaaaaacaaaacataaggaccaataagagccattacaaacttaagagtttactattaatacttcccagttatgggtcagtgttctgctttccctgattgcctcttacataatttgttacacaaatgtctgtttgcatgaataaaagattggatgttttataggatctaaggtccatacattttgtttatggatatatctcaagttttattatcatttaacatccatctcaaaatgtgaactttttttaacctatgagttctgcctctcttcttcttttcattttgaaatctattgatgagcctgtcctttgccatctacgatttcccagtctgggtcgtaccgtgtccccatggtgctgttgaacgtgagcctctgtccttgtatttgctttaagttgtcatttagatctagaggtttgatcagattcaagattgttttggcaagaactctcctaagtgctgctgtgtgtggtcttggattagaagggacagaggctgtcttttgtgatgttagcagccactacatcagggctgagattagggacggcaaaatggtgactttcaggtctagcattccttcctcgtgtattagctggagtccacctatctaaagagagccttctcgagctatgggttactgggcagtcctttttgcataggaaaggcagaataccgccttgatcctttgactttatttgcctttttgcagaagaacaagttgagttcctagcatccccctaaggtggctgataattattttatgtcaacatgaacttatgtattgaaacacagtgatatgtttaatctgttgcaattattcttttcagtagcaatttgtagaactgagaatttctttgtgacagaacgttgaagcagtggtgaatgatgaaggatagaaaagaagttatattcagtaaagtaggaaatctaactcaggcatatgcattatgtcagatcagaagcttcacactttctcagttgagagcactcttgattaaggttcaataattattttaatagtaagccaaaagaaatccctgatagtggtgccggaggagacaggttgtgtttttatcttgtggcctgggtagtgtcctgggaccctctgccccatctgagtcaagtgttgtgggataaaggaatctctcagggcgaggagcttcttaagttaaatcggtagaaatttaggcatgacatgggccttcaaatgtgtgaggagctgtatcattttatttctcggtgtgttttccccaacttctagttgataaaaaaaaaattcttaaagagttttcgtatgtgggagctaaggtggtcttgtaaaatttcaagtcatccttaaataaaatgacccgcctgagaacttgctcccgctaagtggcgaaatcaactggagttggttcctacaagttttgtttattctagttttgtttgtaagtaggttgtgtgagttaattcatggatatttactatatgtcttttaaattagaaaacatttgttattatgtatgtccttttagattttacctgcagctcatactttgaaatcatcacccagtagtgtcttactctagcatcgtctaaatctgagcatcatctggtggaatcttaaatttcagtagaaaccacgagttattaatacatcttccactcaagtatcaatttcagaaggaaacgtaaatgaatattctaaataaggctaatttgtattaatctgcctttatgtttgagggaaaaaaagctgagacattgcatgaaagatgatgcaggatatacgctgatcttttggccccaatgagctatttgaacattgtcctgtttattgttagttttcttcatcatttattatatggtcaatttttgaattcctgtaatatgaaaccttattctatcttttaacttactgttacctaaagttagtaagtccagattatatggtcattcaaaaaaaaaaaaaaaaagaaaagaaaaagaaatcccccacagttccatttattaaataagtaaaccccaataataagcatttgtgtcctggcaacttatagtggatgtctagaaaagtaatacataaagagaaatgttcatgttatttgtttagtcatgggatgtgtgtgcctgtcgagcacctcttcaacttggaatctggtagaacaccgccaccctcattgcctcatttttccacgtcgaccttcacagtaattgcttgttcagtgactgccacaacccagcctggcagagagagggaagataccctataaagcaaggtaacgttaatgttgagaccatgaatggccttgagcagagcagagtatcattgcttccttcaaaattcagaaggatctgatggtgctctgtgagttcatgggggtgcctccgtgcaggttggaaaccacagctgtgcgtccttcccgctttccctcttgatcagtagaagggtaccctccctggcctgcacgtcgctgggtcacacaacactggctgtcgttgcacaaagccacggccaccagcgttcctttgaggccatttgtttccagccatggtgcctataggatttttcctttatcctgtaatttcagccaaatcagagcatgtgacctggcttagatgtcaatataattgttgttatgtgctcttttcccttcctgtgtctgtgacaggtttaatttaacctgagaaggctgcagatcctcggggttggtgtaaaaacacctcatcctgatctgagaaggcggtcagcttttctcctcgttgccgttggctgccagcacccattctctgtggatgtgaaaatcccagaagggctgggcttccttcttgggcattccccaggcctatctccagagtggggcccagcatgggaggattgtaccccactcactcccctgatgtggggcttggacctacagctcgacagcacccatggaatgtgggcagaagcgacagcagccagctccgccttggccttagggcggcacgtgttctgcttgtgccctgggagcctccaccttccacactgtgggaagagggtgcccagggagctgcagtctctccagcccagccccaggacgaggcccaggcagcagagccaccccagcagacctggcagtgtgagagaaatgcatgtgtatacactgagtttgcaggtggctgttacatggcagcattgactgacacagacagaaaagagatccacgagggagaagtgagagtgctggagactccacaagccacaggctgcaggggcaggatggcttcttagaaggtgaaatgattgttctgggaatctatcagaggaagacatagaggctccagacggttgaaggcccaacagtgatcccagacgggccccatgtcagaccaggctcctccagggctgtgctgccctcaccaaagcccgtcctgagggcagccacacagcaggcagcactcgccatttgtacaagcgaggcccaagttccagccttccttctggcaggtagaggaagcaggggcactatgcctgggagttcctgaaagcagatggggcagcatttggtcaagagccaggaggggatgacagaccagaggggaaccctcgtcccacgtgctgagcacacgtagggggttgggcacttgctctgtgagctataattggtgtccctgtgccccgccggaagctgcaccaggcagtttcttggtggaggacagtggccgccctctagctttactcccttccccgtgatgggtcgctgtcagatgtgtgtccaggaaaggcaaacaccaaaggcagaggactagtccctacaccgaatactccggtggccttgcttgggggctgggttttgacgtgctggaggctgtcctagacttagagattaaaaacagggaagaaccattgctgaaacctttggaaaagcctgcaatggggcctctggcagcctgaggagtggtggtgtttccatctggtagacgccgtctcaataggagggacagatgagtgcaccagtgctgccagccagaggcgtctgttggcgtgtctttatggaatggggtgccagtcttgtggagggtggtttaccttcctgtttctagtccccactgggcctgccttctgcttcatggccagctggccagaccgagcactttcctgactttcgaccttggcccctgctgactcttgccgttgaggcctcctgcagaccccatttgtattcatttcctgcagttctcatacctgaatcccgcctggacttctgccaagccttccaggccctcctcccccagggggaccacagatgctacgtgcagggctgtccttggagggccagcacagccccttccaagtgggcaagacccaggggtggctcaaaagatagctgtgccctagccctggaacctctgaatgttgatttttgtagcaaaaaaggacttgcagatgtgagtaaaggctgttgagataaggacatcctccctgctctctgggaggaccccaaatgcaggtgcacagatcttaagaagaagaggcagagactggggtgatgcagccacaactaaggaaagccaaggattgctggcagcctgcagaaactggagggcaaggagcatcccccaaccgcccggagcctccaggaggcgcaaggtcctactgactccctgacttcagacgtccagtctccggaattttgagaggatccatttctgttattttaagcaaccaaacttgtggtagtttcaccagtctcaggaaatgaatacgaatggaaagtcaaagattccaagaaatgagtggcggggtgcggtggctcacacttgtaatcccagcatttgcgggaagattgcttgggctcaggacttggagaccttgtgtctgtgagaaacttaaaaaataggctgggtgcgatggctcacgcctgtaatcccagcactttgggaggccgaggcaggcggatcacaaggtcacgagtttgagaccagtgtgaccaacatggtgaaaccctgtctctactaaaaatacaaaaattagccgggtgtggtggtgcgtgcctgtaatcccagctactcgggaggctgaggcagaagaattgcttgaacccaggaagcagaggttgcagtgagccgagatagtattactgcactccaggctgggcagcagagcaagattccgcctcaaaaaaaaaaaaaaaaaaaaaaaaaaaaaaaaaaactgagcatggtagcatgcacctgtggtcctggctacgccggaggattgcctgaagccaggagttcaagaccagtctggacaaaagagcaagaccccatctctaccaaaaaaatttaaaaattagccaggcatggtgccgtacccatagtcttagctactcaggaggctgaggagggaggattatctgagccctggcggttgaggctataatgagccatgattgtgccactgcactccagccttggcaacacagtgtgagaccctgtctcaaaaacaataaaaacccaaaacaaaagaaccaagaaattactggacctgaggcctggcctttagctgctgccctgcccttgtgacctggtcactcgggatcccctgggcctaaacacacagcctattgtctacctcaagaaggctccccactgcttggctggcaattggggtgggctttgcaggccccacctgtcctggccccacggcgctggtgctgcaggcccccaccactgcttgttccgagctccccagcctcctgcagagttgcctgcacctgatggcgatgaatcaggaaggcaggcgtgtcctgggccacagagcagtcatggctgtcagccaccagggggctccatttgcaactttggatgtggctttggcctctttgtccaaagtgaccttggggcccccagacaagagacagggagactggagcccagccccaccctcccgcacatacctggcccatccctgccctatcctggaagatgggggccaccacacgtgcaagggacacgggataggaacctttggccttgttatcagacattttaaaactaagtgcaaacgtgattatcaggtgcagtttttacagcagcaagaaacctgtgcttacagaaagaaacacgtgctagcaacccacctatgcggaaagccacacagagccattgttttctgcactctcaggtgacggctcacatttgccccagggaaggtcacagctgcctgaacttttaaaactcccagacacgcactgcctgtgcaggatccggagcccagcagcactgccagggccttgaagtgcttcttcagagacctttcttcatagactacttttttttctttaagcagcaaaaggagaaaattgtcatcaaaggatattccagattcttgacagcattctcgtcatctctgaggacatcaccatcatctcaggtgagcaccaggtggagtgcctctgggtgactggccggtttggagcagggagggaggcttagagtctcatcctccagcagcgagtgaggcggaggctccagcgtccctcccgggcgggttttctggtggatggaggagtgactcggggtcctctacgtggtgccagctgtttggctttctggacgttgtaggaaagggtttcccccgcctgcgtccccctgaccttgagctccaccagcccctgccagctgggctccagaaggctggagtgctgtggcagggatgacgtctcacttctgttatgtctctgtgccctgtgctctcccaggatgaggggcatgaagctgctgggggcgctgctggcactggcggccctactgcagggggccgtgtccctgaagatcgcagccttcaacatccagacatttggggagaccaagatgtccaatgccaccctcgtcagctacattgtgcaggtgaggccagggcagcctccccccaaaagcagaggagctctggagtctagggctggtgggcagggccagccctatggagccacagggtgtcgggtgtggggtactgagcaccactgctcccagcacggtggaacaggctcttggctgtggaccaaggtcctcatccctgctgtgctgtccctggctggcagcaggagcccaggcagaaacatgaggctgcggttaaaccgagcaatgccacgagcatcagctgtggctccctttgtggcgctgtagggtccctgggtggcaccagccctgctcagcaccactgtggccctgcccccagatcctgagccgctatgacatcgccctggtccaggaggtcagagacagccacctgactgccgtggggaagctgctggacaacctcaatcagtgggtgacagtggcagggtcataggaaggtgacatctcgtccacggcacagcctcacttcacttgggccccaagggtggggacctgggcacagcctcgctatcggcagccagaggggtcccctatggcccccgccactgggaccttttgtttcttcaatccagggatgcaccagacacctatcactacgtggtcagtgagccactgggacggaacagctataaggagcgctacctgttcgtgtacaggtgggtggtctagaaagccaggaagcccctccctcacctgggagggccccaacagagcagggaagtagtttgtcctattagtttgtcctatggcaagaacctgaggcttcagagcagggtccagggtggagtgaaaacaccccaaggtcccggaccaatgggttgagcaggtgcctggctcccccgccctcctgtcgcctgggtcccggaccaatgggttgagcaggtgcctggctcccccgccctcctgtcgcctgggtcccggaccaatgggttgagcaggtgcctggctcccccgccctcctgtcgcctgggtcccggaccaatgggttgagcaggtgcctggctcccccgccctcctgtcgcctgggacgcgacgcctgcctcctgggaagcaggagtggggcagcttccagcctggggtcacctcctcctgcccggccttcccgcaggcctgaccaggtgtctgcggtggacagctactactacgatgatggctgcgagccctgcgggaacgacaccttcaaccgagagccagccattgtcaggttcttctcccggttcacaggtgggtgctgcctgggccagggtggggctcggcttggcgcttatggcctccaccccctcctagggaacctggaatgcctgtgtcacacactgccctcccagtccctggggcttgggttttccattcaagtcatttggaaaatatccaccccccggggggactgtcatgatacatagttccagctgacatggtgactgaacctgcccccagggagtgtgcctcacacgacgtggctgtctccacagaggtcagggagtttgccattgttcccctgcatgcggccccgggggacgcagtagccgagatcgacgctctctatgacgtctacctggatgtccaagagaaatggggcttggaggtgaggccctcccaggggcagtgggcaccagcggcctccgcatgtcccagggccacaggcagcgtttcctggtaggacgtcatgttgatgggcgacttcaatgcgggctgcagctatgtgagaccctcccagtggtcatccatccgcctgtggacaagccccaccttccagtggctgatccccgacagcgctgacaccacagctacacccacgcactgtgcctatgacaggtgagcagggcctcgcgcttagggcagactgagggcacctccaagggcagccgtgactcataggtcgggcttcagaagcctcaaagcctttgaacactcacccaactgagcttcagttgatccactacagggaacagaataacaagagccacgatttttaggttttttcggaaaagcacatctggggataagaggagaggcagacacctaggctgtcatgtggtttccacattgaggggcacagaccagggtgtgcagttttgggcacccacagacctgcactggcaggtcccagggctcttagtttagttcctgcgggtgctgagccaggcccatgtgtgaaaggggaacctactttctcttcccaacacccatcaggatcgtggttgcagggatgctgctccgaggcgccgttgttcccgactcggctcttccctttaacttccaggctgcctatggcctgagtgaccaactggtatgtgtcctcccttgcacagccacatgaggatgggacacaggagctcaggtaggctcagcccagaccctgtgcccacttgcctgcaggcccaagccatcagtgaccactatccagtggaggtgatgctgaagtgagcagcccctccccacaccagttgaactgcaggaagagaggacccatcctgccacaggacccagaaaaaaagcccaacacacactcgggttaagaaatacctttaaatttaggtaaataaagctcaaggaggtggggctgtcatctgtggtgtcagtccttctggccccctggctgtcagtgtcgctccagggccttgacaagcagctcattcaagcggcccaccatggccctagggtcgtcaacaagtccagcagcaatcatggcgttctcgtatatctgaaaggcaagaggagaaacccattatgaggggcatggggcaccttttcatttttttttttttgagacagagtctcactgttgccgaggctggagtgcagaggcacgatctcggctcactgcaacctcaggtgatccccccgcctcccaaagtgctgggattacaggcgtgagccaccacgcctggccatttttccgtttttaaaacagaatttggctgggcacggtggctcacgaggtcaggagattgagaccatcctggccaagatggtgaaaaccccatctctactaaaatacaaaattagccaggcgcatgcctgtagtcccagctactcgggaggctgaggcaggggaattgcttgaacccgggaggcagaggttgtagtgagccaagatcgcgccactgcactccagcctggcaacagagcaacactccatctcaaaaaacaaacaaacaaacaaaaagacaggattttagaggaaaccgctgttccaccctgaaggcaggctggcagggctggtagcctgggtccctgcagtcatcctaagctgctgcactcacctgatccaccagcagctgagccaggccaggctcgcttgcgcgcagctgattcagcttcttgatgagcgcgtgcctgcaacacagaacccaccagaaaaagcagctcagtaccacgtgctgtgaccctcccttcatgttttgggattatcaggatatttaaagaagcacagtaagactgtctgtagttttttaaataaggtatgttaatgatcatttatagataatatcattatatacccagaaaacccaagagaatcaggagtgtcagtattagaaaatgctgtaaggtagccaaactccaagattaatatacactaaagggacaaaaggagcttagtacgtgaagacatgccttggttcctagataaataataaaagagaagggagtaagacccacatgttgaaacatattatagggctctagtaaataaaacagtttaggtctggaaagggggaaggcaaacaactccatgtaacgagggtggacactgagtgtctgatgaggacagtatttcacagaagagggaggagacagatcactccatccagcagcactgggatgactgggagccatgcagaaaaccatttagaccagagtaaattccagagggatcaaagatgacaagcacaattctagggaagaaatgtttcatcatctcagaaggggaaagcctttccaagcaaaaccacaaaccaaaaagtaaagaatgattgacatatttgacgtcagaacaatatttttttctgcataggaaaaagcatcatgtagtatttaaccttaacatgaatattataatttttcacttagaagtctgataaaaccgagggctctggggaactgtaaatttgtacaacctctccagaggacaactggagtcgggaaaaccacatgtggatgatatgctgagactcagccattccatttcctaactgcatccctttaaacacttttttttttagatagatagatagatagatagatagatagactctcactccttcacccaagctagagtgaaatggcatgatcttggctcaccgcagcctcctggtttcaagaggttctcttgcctcagcctcccaagtaactgggattacaggcacccaccaccacccccagctagtttttgtatttttagtagagatgaggtctcgaactcctgacctcaagtgatccacccgcctaggcctcccaaaatgttgggattacaggcgtgaggcaccgcacccaacctaacagaggaaacacttcaaatgcacatcctcacatttctagtctacgtagctggaaaaaaaggacattcttaatatgctaatgtggaggtcacctagttaccctaagggagaaaagcaaggcaaggacccactgcacagcaagttcccccttggaagcccacgggcgcagctgcccacaaatgcacataatctctgcagaaatacaaaagccctaatgctggctgcactggggacacaggtaggaggaaattttcccctgtaagcagttttgaattctgaactatgtggacagaacaccaaattttaaaacaaatgaaagtgaagctggctgggcacagtggctctcgcctgtaatcccaccactttgggaggccaaggctgcagtgagctctgatggcgccactggtacactccagcctaggtgacagagcaagaccctgtctccaaaagtgaagtggcaacagacagaaacgagcacttctgcagctatctcacaaaactagtttgccaccaaaactagttaaagtgacctggtgtccgcctcactgagctgctccagcagaggcacaggcattctgcatactggcgctgctgtgcactgacagccataagccaagtcagcctttccccaggagtgccatggctaggaagatgcatctccctcgcctccagtataattttaaaagttatggttgtaaaatgacaaaagaaaaaaactagacatgtactaaagaacaaaacaaaaactggctgggggtggtagcccacacttgtaatcccagcacttcgggaggctaaggcaggtggattgtttgaggccaggaggtagaagttgcagtgagctgagattgccccactgcactccaacctgggggacagagtgagaccctgtctcaaaaattaaaatactacttaggctacattgtggggggggtggtaagtctatggattttgatttcctttttgctgttttctatttttggtaacatgtttatgtaacttcattttttaaaaaattgctacattcaaaatttcccccaaaaaagaaacttcatatacaagttagttcatatacaagttagaaaatgaaattttaaaataccccataagacacatcaaagaataattctttaaaaatggtaccagaaccctacagagaatgtaaggtaccaaaggatgttaaagacctaaatagatcacattcatgggtgcaaagaagtgatactgtaaaaagaaagaaactcaaaagatacctaaaggcaggtgaaaagacatttacaacagataaagggcatataaagaacaacaggaagaaacgagggaaatcttacggctcagccactgtcagggctggggggttctcggtgcaccctggaagcagctcccaccaccggggccacagagaaacccacacaagccccagacacgtggacaagaatactcagagcagcctggctctccacaacttctgaccaagaaccaccggaggcccagcagagcagaacggagcagtctgctgtgccgaggtgggtttctgcagcggacattattcggctatgaaaatgaacttgtggcagcccctctgcatgggcaaccctcatgccaagtgagcaacgtgagacttcagcaaacaccaagatccacgtacaaagctcaaaacaggcaaaactgagcatgtccaggacacgcacaggtggcaaagccataaagcaaaacgaggacatggtcacaggctgggatgtggctaacctcccaggtgacacctggggatggtaaggggctggccaggttccatttcacatgggtgcagcctaaactgcatacagctccttatagttacccacatgtccacaggcctcacgcacttttcttctgtgtcacattccacaacaaaagaacaccacacacaggattctggggaatcccacaggctggaagagccaggagcgtggcctcacctggggttgatctccagcgtgggctgcaggagctgtgcgcgctcctcctgggtcttggccagctgctgcatgcgcaggaagtggcgggcagcccccatctccagcacggtgaccatggcagggtgggtgtccagtcggagggtcacctgtgagcaaagcccggggttgagggtgatagaggttcccaatgtgagagggctggcaggatcttaccaggggtgaaggtcacccagaccacgaggtagcaggcggggtctcaaggactcccctggaccagcgctgctccctccccattacccactaacttgtgggccctgagctgatgccccacgcaaagatactgtgcccgaggggctccaccaccctggtgccccgctgctgcctccaggagctgcccgaatccatcgtcctctgctccatgccagcccaccctgcatgaggccccttcctccaagtgaccatgcatgggacgctcatttctcactctgagctagacaggttggtggggggagtcttagctctctgaagcccacccaaaacccccgactaagcacccaagtgagcatgtgagctcctgagggctggggtagcatgtcccttgtttggaacccccacgtcctcagccattgcagctcccactcaggatgctggtttttcagttctcagttcacacctgctctggagcagggctgggagaaagacacggccttcctgcctcagcggcactcccgagcaacacgtgccgagcagggacccacagggtctccacctgacaccaagggcttctgctgctgctggaaggacacccaacgggccaggtactgggagccaccagctggccagcctgttagggacactgcggccaagtggtggtccatccccgggaaagcctcaccttcacgttggtgacacgcgaccccagcacatttctcatccaggccatgagctcctccgtctccttctctgataggcactcggcggctgcggaagagcaggcgacagggagctcaggcctgcatcccaactccccggcttccatgggggccacgcagcatgcttccagctcccacctcctctcccaccaggatggagacacaagctagcaagatgcttttcatctaaaagtaaaacctcaaaggatgcttcaggttgcctgaggcccatacaacttggttagggctttaaaaaaatacacagcctctcaagaagctgggccagctccagaagccaccgtggcaggagcactggacagacccctgatatctaaaccaggaggcaccttcctccagtcaccagggtgctcccacaaggctcttctcgggggtggctgagcccaggtcaactgacgaaaacccaaaggaagccctcgctgcggggcaggagaggcgtgcggggagtggaaaccagccccacgcctagagagcaggggatgccgacctggggacctgtcctcaaacttctcctccttgtagtgatccacgactatgtccgtctccacagagatcagcttcttcttgtcaaactcacgaaggtgcagcagggtgagctcatcaaactgctcaaagcagaagagaacctgcaggtggccaagagcagctccatcagaccccgggggcctccagccaccacagaagaaaggatgagggcggcaggagggctgggggagccaagcgggccacactggggaacaccggggcagttggggttcctaggcctgcatgacagttactacgacacctgggtctaaggaaggctctgactgccttcaaggcagaagcactccacgcataaagaaatccacatgtggctgagtgcagtggctcacgcctgtaatcccagcactttgggaggccaaagcaggcagatcatgaggtcaggagttcgagaccaacatggtgaaatgccgtctctattaaaaatacaaaaatttgctgggtgtggtggtgtgcacctgtagtcccagctactcaggaggctgaggcaggagaatgacctgaacccaggaggcggaagttgcagtgagccgagatcgcaccactgcactctagcctgggcgagagagcaagactccatctcaaaaaaacaaaaaacaaacaaaaaaaaccacatgtgacctccaagtgggaaacagccgtcacagtcggtccggcctctgtgcccgtgaccctgacccactgtgcagccctgcccggagtcttgggcaggttcacccagcacagagctgagaaggtcaagaccctccccaggttgcagcccccggagcccgccccacccaccgctcacccacctctgtgtctttcttcttcatggcctcatagtagggtgagtgctctgccaggtgacggttgggggcgcacaggtagtagatgttgcgggtgccggcccgcatgcggctggcgtattctgagaggctggttagctgcccggagggcagcgccgaggactcgtagcgcagcagctttgctatgtcctcctagaagggacggggcaggtcaccacttattccaggcccatgggctcaatgttgcccaactaactgggcgcaaaccctccgatgcccatggcctcctggcactccaggctggccctgacccgagggacggtagtggactcgggggttgtccgagagcaggccttgctctgcccatcaggccccttttgggagctctgggggcttaggaagcacctcctgccccaggtggcccaggggctctccagggagctacgcgcaccacgccctgggaggggaccccacccaacagcagagcccggcctggacccagcgtcttccctctgccctcagtgacagagtcagtctctggtgggcacacggacacgggtgaagtccacggttcccggccctcctcacagctggctatggcagagactggctttgcccagtgggtttcagtgggatttggagaagggcccttaggggaggggtttgccctcctccccatcagctgaacgcagctgtgacctctagagctcatgggagctgcagctggaaggacgcagggggaaaacagaaagagggaaaagcaaggagctggacacccaaccagcagggcccaggccacccctgcacacatggtgggtctgcattgataagacatgtcacacgtgcacacctacaaagacctagaaatgtctctgactcttacctgtgtgctgttaactcaaatgaagataaaggagaatgaagaggcctgtgtcagaagctgccgaagtcggcaaacaaccagaacacggcctccttgggaccccacacacgtggtcaccctcctcctgctgctggggagaagggacaccagcacgggatgggctcctgggatgaaatgttctggggttacagtggaggcagccacaccacactgtgaatgcactaaatgccactgaattttacgtgttaaaaggtgaattctgtgaatctgatgctatgtaagttgtatctcaataaaaaatggacaaaaaatgtttatggaacaaatgtttcgtttttcagccatccactattggattaactgaacgactggcccctgtagcatagtatttggagactgatatccagtacatgatgaatagtccctcaacagacactgagaccacccacttccccacccacgggatcggagtccttggcttgtcccacctgtctgtggctccccagcccccaacatcctctgaggggagacagtgtgtgcacgccctcttcctgccactccctgggctgcaccttcacacagcagtgaggctgagcccttcagagcacagcacagcactggtgggagggtaaggatgtgcctggaaggtgccagaggcccagaagcctggccttccatttcctgaccctggtggcagcagcagcagcagccagggtacccagctgcaccgtcgccacatcaggggacacctccaccagcttcctcagcagccccagggacaaggtggcccagaaaaaggcctggaacacagctcctataccttgacctcctgctcggtggcggtcacaatgccctcccgcatgaacaggccgtaatcttcaaaaaactttgcatacttctcagcatcttttttactctggtcaatgaagaatttgatcagcctctgctgtaaaacgtcccggagtttcctacagaaaagaaatgcatttaatacatacaagcagcctctatgaaatacaaatggccagagggtacgaaaaaatgttcagccccgctaagaatcaaagaagtgaaaacaacaaggtaccgttattggccaaactgaaaaagactgagcagaaagacagaaaccctgggcagtggccggacaggaggcagcagggtggagggcagacaccccctggaggcagtaggagaaccgatgcccccagagacaagatacccacgcccggaaaacccttccaacctttgagccagttgttccaattataggaactgcaccttaggaaacatgtgagcacaccaagatttatgtaccaggattttcactgtggcacataaaatataacaattatgaacaacctcatgttcaagaatataggctaaaattatgtaatgctaaatggccataaaaaaaaaaaactgcatcttttaataatcctcaatgacatgagaaagttagctgtgttgaaagaaaacccagaaaaatcccaatgtgggtaaattacagtacgtctatagatacaggcaaagaatgcacattctacatgtacataacaattttccatcattaggagcagcactgtatatactatatatgtacactgtaatttgggatttatactgaatatatgtatactctaatttttcaaaattgggattttagggatcaggatatttactgcagcattacataatggcctaaaattaggaacaactttatcactgggactagggatatttttattttcttcttaatatttagtctttcctttaagcaggtaaattacaatgtatttcaataatccagagcatgggaacaacactctctcgagttcatttagagcctttcctcccacactccatccccagtgactcagtccttcagccacagggcagaatgggacaggacatgccttcgtgcctgggagcggggggacagtagcccaggatgcggtgcagagcccagggaaggtgtctatgcagggccatggttgggaagagcctggtatgggtgtcagagcccaagaaccccagagaagggtgtccaggctgggggcgtgaccagcccaccgtgaagagtcagagcccaagtaggtgacagggacacccgcagaagagggcagtggcaatggtagattggttacatggagggggattggtcaaatgggtaaccgtgctaagaataatcaacggggcatggtggctcctgcctgtaatcgcaccactttgggaggctgaggcgggcggatcaccagaggtcaggagtttgagaccagcctggtcaacatggtaagcccccgtctctactaaaaatacaaaaaattaccagggcatggtggtgggtgactgtagtcccagctacttgaaaggctgaggcaggagaatcgcttgaatccgggaggcagaggtttcggtgagccaatacctcgccactgcactccagcctgagcaacagagtaagactccatctcaaaaataaataaataaataaataaataaaaataaaaaaattttattaatgatagcaagattataaactcttgaataaaacaggaaatcagcccatataaataaattataaatagtataaatataacacatcaatttttttttttttttccatccgacgaatcttgctcttgtcccccaggctggagtgcagtggcgtgatctcggctcactgcaacctctgcctcccgggttcaagcaattctcctgcctcagcctcccaagtagctgggattacaggcacctgccaccatacccggctgattttttttttttttttttttttgagatgagtctcgctctgtcgcccaggctggagtgcagtggcgtgattttggcgcactgcaatctccacctcccaggttcaagcaattctctgcctcagcctcccgagtggctgggattacacctgcctgccaccacgactggctaaaattttgtgtttttagtagagatggggtttcaccatcttggcaggctggtaactcctgacctcgtgatccacccgcctcggcctcccaaagtgctgggattacaggagtgagccattgcgcccagcctaatttttctattttttaagtagagacggggttttaccatgttggctaggctggtctcgaactcctgacctcaggtgatctgcctgcctcggcctcccaaagtgctgggattacaggcgtgagccaccgcgcccggccaacacataaatattttaagtaaataaatgaatgtattgagagtttcatgaagaatgtgacatttacatagcttcaaaatacctataacatctgttaattacaaagggaaggacatccttgtttgttggaaatgcaccccaaaggcatcgagaaggcaacttcctctcacaggattcgaggaaaaacatgttcttggtaccatgcttccaacttttaagcctgtgattctttcaaaagctctaatttcggctgactcttttctgatcgagatgagttctcagactgacaacgcaacctttgacaaccacaagctgggatgaggacccctgctctgcagcttcgggcactaccagtgggccagcatgcctgccacagccaggaatgcagctcccttactgagcaggaccacccctctgtgactcagtttccacaactatgagtgaggactcacggctcccctcacaggatgaaacacgtgtttatgcaggctcagcacagttctcagtggagaagaaatactcaggaaacacattcaggatggggagaggaacgcagccgcctcggcccgcagggacgccaggagctccctctccacagggcctggcccctgcctccacttcatccgtgagcttcccagatgaggccagacgtgtcctcagttcagtgggtgtcctttgccttatccagcccagggacattgtacctggaacctcccctcctgtggccactcctgggcagggtgatggggatggacaaggtggggacaactccagcaccagcaataataatccgggagtcagccccaagccctctcttcactgaagtgaactgaaacattgggcagatcaccagtaacccacaggcgcactcgaagtgcacagggtcagtacaccaaagagcacgactctaacgaccacagaacagtcgctgctgtggggcggggatgcatcctgttgaggtcagcacaactgctgccctgtggtcatgtcggcagcaagtcggggtcctgctgtcagaagccagcacggctgtgtggggaaacaagcactgaggcccccttttcattgattatataacatctctttagtcagcaaggaaaataccttttatatagttatatcttccgaccaagtaaccccacccctagtattctatcctaaggaaatacagctgcaggtaaagatttcagaacaggccaggcgcggtggctcacacctgtaatcccagaactttgggaggccgaggcaggcagatcacaaggtcaggagatcaagaccatcccggctaacacagtgaaaccctgtctctactaaatatacaaaaaattagctgggcgtggtggtgggtgcctgtatcccagctactcgggaggctgagacaggagaatggcatgaacccgggaggcggagcttgcagtgagccgagatcgtgccactgcactccagcctgggcaacagaccaagactccgtctcaaaaaaaaaaaaaaaaaaaaaaaaaaaagatttcagaacaaagataaacatgcactgcagtgtcataactgcagaaacactgagacagcccagctgtgcagccccgagggacgggatcagtaaactatggtacatccctgtgatgtcccatgatgtagcaattaaaagtgcttccaaaaaacaacatgggaagtggtgcaaataaactaggtagaaaaaaggaaacagtataagcaatatgaattcaattgcatgaaaaacaaaaacaggccgggcgcagtggctcaaacccgtaatcccagcactttgggaggccaaggcaggcggatcacgaagtcaggagatcgagaccatcctggctaacacggtgaaaccctgtctctactaaagatataaaaaatcagccgggcatggtggcaggcacctgtagtcccagctgagacgggaggctgagacaggagaatggcgtgaacctaggaggcgaaggttgcagtgagccgagactgcgccactgcactccagcctgggcgacagagcaagactccgtctcaaaaaaaaaaaaaaaaaaaaaaaaaaaaatctaagtggccaggtgcagtggctcatgcctggaatcccagcactttgggaggctgaggccaaaggatcgcttgagcccaggagttcaagatcagcctgggcaacatagtgagatcccaactctacaaaaaaatacaaaaaaattagccaggcatggtagctcacacttgtagtcccagctacttgggaggctgaggtggaaggattgcttgagcccaagaggttgaggctgcagtgagctgtgatcacaccactgcattccaacctggacaacaagaaagaccctatcagtcaaccaataaaacatcactgcggcttgcttggttgaaaaaagaaaaaaatctccatggctttctgcctctgaaggtgaggcaggaggatatcaccggcaggccatgtgacctcgcagggctgggcatggacccaccaggcaggaaaccacactgcccaccatctccccagacctgctcctgcccgcggcacaggacagaatctctgaggaccagtgcctctcggtgtgggcctctcgccatgcccacagcgcagccccaacacacaccaattacccagactcatcctttttccgaggatctgcttccatttcaacactggagagaaaccggtgggcagagaaacactgcaggcacgttgggggctccaacaaggcccgttccatggcatgctgcacgtggtgggctcttgagagacctccagggctccaaattccagctgaatcctcaccccacaggctccctctgaaacctgccctatgtggctgccaatctaccccaccctaaaccatcaacagcagtcatctctaggtgagagcacaggtcacttgaatgtgctctagtaaggaaatactacttgcattaggggaaaaaaagccagtaagcgaggttttgaataaagactatttggtgagcctggggccagagtggggaagtgatagctactgatggagaacctggagccagcacactggagtcccctccacacagggctggcctgctgcagggctgcagtcacaaccctggggcacaggtgggcaggtctggctctgcggcccctccccctatccagactccagcctcagccatgaccagccacccccaccttcttctggaccacaagcttcagaggccaggccagcacctggaaggctcctgagggcccccatgtgcaggccgggcttccccgaccacctctgctctcagctccatgggccacggctagggccctctgggggcaaaggagcaggtaggggccttgtccccagcagggtcctctccccgcggcccgaggctcacctgatgagtgcgctctcctgcagcagctcccggctgaggttcaggggaatgtcctcactgtccaccacacctgggagacacggcagtcagcttctcccggggctgcggccctccacaccacccaacattccccattaacctgccctttgtcttcaggcctggccttcaacccagcacgtgtgctaagagggaagcagggaggcggcactgccggagcttcctctacgtcctgccacctcccagaacagtgacctgggctgtgggtggccgggacagcctcggggtaacactcggaaaatgacagcctgggctttatgttaaaaatcacaactctggctgggcacagtgtctgacgcctgtaatcccagcgctttgggaggccgaggtgggcggatcatgaggtcaggagttcgagaccagcccggcaattatggtgaaaccccatctctactaaaaatacaaaaattagccgggtgtggtggcgggcgcctgtaatcccagctactcgggaggctaaggcaggagaatcacttaaggaggttgcagtgagccacgattgcaccaccgcactccagcctgggtgacagagcaagactcgtctcaaaaaacaaacaaacaaaactctatcagggatggttcgcacctctgtgtaccaaggcttaaatactgaagtctttcttaaactataatctcactcaaacgtaacacaactcacatatcaatctgaaactcagtatccctacatatggaaagacctcaatctgaacaccccagtgctccccccagatcagtcatgtgcgtagggaggtggggcagctcccggggtctgtaaacgcgactgacacacaggcagcgcaggccgacggcggtgctctcgctgcagagggctgctgagaatggaatcagcacggtccctcacagatgcagcgggcgacactgggccacgggggcactgctcacggactctgagcagcgtacctcggatgaagcgcagccacttgggcaggatgtccgtggccttggtctggatgaggactttgcggctgtacagtgcaacgctggagcccagctcccggctcacatcaaacatggacggtttctgggggtgaggagaacacgccatcatgcagcactgaccctccccaggcaggccctggctgggaggtgggggcggacacgatgaatccagagcccactcccgcctcgccctcccccagcgtctgctctgagttgaagcccagtgcaggggccccacgatgccccacactgtggctctgcaggggctgaaggccttctctggcagctgccgccctccccagcccaccccctaaggaggacacaagagagtgaaccttgcacgtacccctgaacacactgaacacagccaaaccttgctacaggtcagggatcagcaaagagccctccgaccagatccagctcactgcctacctctgtgtagcctaagagtggtttttacactttcaaacagttgaggaaagatttcaaaaaggatgatctcatgagacgtgaagatgaaactcaaatttcagtgtctacgcagctcatgggacccggccctgtgtgctcagagggcagcagggcagtgctgcttcctcacccggcagggttagtggctacgaaagacaccgggcccgaaacgctgggaccagctcctgtctggccctcgtggaacgtgcctgccaacacctgctccacactggtacttcccgaaccgggacccacacctcatcacgggatctggttaaaatgcggcgggtatctagttcaaatgttgggagacctggttaaaatgtggggcgacctggttaaaatgggggggatccggttaaaatgcggggagatcttattaaaatgtgggctcccacgcaggagccctgggtggggcctgagactctaacaagcccctggaggccacacctggctggctctttccaagatggatgccagctgtgcaggacattaggagagtttccaggcagccaaggacagaagagcctgggggcaggacgggctggctctcagccccgaataggtctccttacggcaggatttgcgggaacttcaatgtggtaaaggaaaccaggggaggtggagggtgtggaggaagcacacagagaggccaacggagaggcaagaccacaggcccttcccagagcgcctggcaggacagcatccactgatccacagcagatgatgtaggctctgagggccctccccaggcacaccccagtccacaagcctccaccccagcctgcactgagatgcccatcaatccttccctcgccatgtgtgacccctgagacagaggaaacctctgtggttacccacccagaggcatctgttctttttttcttttttttcagagatggggtctcactatgttggccagcctggtctgcaactcctgggctcaggtgatccaccctcctcagcctcccaaagtgctgggataacaggcgtgagccaccacacccagcactacctatgtttttcatgccctcacactgccatgttaatcatgtgacatctgcagagctgatgccacaggggacaacagagtcaccctgagggccgtgggactgccacagtgcctcaccatgtcgggcacgtagaagatgctgcggatgttgagcggtgcgtccgtcttatagtgcagggtgtagcggggcttgtcgtgagcctgcgcgacgtagcggtagaactcctcatgttgccactcacggacatccttggggtccatcatccagatggcctggaaacggagatcggcggggagggcgtcgtgttcaccacgcacgtcttctccaccaccgtgcaggcctgagccagtgcagcgcctggccctggacaggctcctgggacagacgggcggtggtctcaggcgtagacccctctccagccccaccgctgggctatgccgggtagtgcaggggagacacacaaggctctggggcaggagctcctcaggacaacatgtcaggaggaccagccgggacctgagggggcctgtgggagaggatgacgctgcccagcaggggcgagctgacgaatacagtgtgggccgtgagagcgatgacgacccacgctgcaccgcagctgagccgcgagggggaagtcagtcactgaggacagcatgccgtgtgactccatccaggagaaacgtctggaacaggcagcacaatggacagaaaggagaccgtggctgctgggactgggggaggggcagtggggaaagggctgctttttggggtgatgggatgttctggaattgatgcggggtggctgcacagctctgtggctgcactgaacaccatggctgcacactgatgtggtgagccagctgggatgggcgttacgcctcagtgaaccctgacccctgaccccggctgcccggtgcacaggggcagggctgtggtagagctgggcccctgtctcatccccacacccaggtctcatctccacagagcagctcgccctgtgactctgggccgcatcccctgggctcatctcttctccgctgccctgaaacgtacagatttgtctccatgtttgaccagtccctagaggaactcagggctcacctgcaaggtgttcatccgccttccattcaagtacaaggggaagctgacgaagttgctgtacttcgttaccacatctggaagggacaaaagaaaaaccacactgcatctacaatgcttgtggaaacgcaagctttgcagcagctccaggatgagcgccagcctgctgggaagggtcctccatgctgtgtacacttcacaggtacagaaacagggcacagtggggacacctgtcctccccccagtctcacgggggcagcagcggagcccacgtgagaaccagagctgtggaggccccggctgctgcgagactgcaatgtcagcttgtggctggaacatggctttctgggctgactcctgggggtactcagggcctccctgagtgtccagcaggacacaaagagggaaggccacgcccacatcctgggacaggactgcgccaaacccccaggtgcactaaaggccaagggccacgcagaggaaggaggaggaggtccgcctcagccaggccagcttcctcccagtcccagcaggagctcgatgctacgcagccctggcgggcagcccccctcccagtcccgcagcggctcggcccttcacggctctgcctgtgcaccctacgtgcaggtagaaccagggaaaatgcctgctgacctggtggcctccaggccacacatggatcccagagtgagcctgggcccgggctcccgctcacctcgcacccgggcctcgctggaaaactccttgcagtcggatttcaggtggatgatgatttttgtcccggttctaactcccgaagcttcggcgatttcaaacactccagaactaaggcaggcaaagaaaggaaaagccaggtggatgtgacactgggacataccctgcatgggactccagcggttcccgagggtttcataggcagagcccaaacaacacacaacacacctcaaatgccccatttctgaccccagcgcaccactcaggccatcacatgcccatcaggaacgatgagcctgtcgcaggcggcagagttctcctggttccctcgggcggggggcgggggggcgggggtcctccaccgaccctgggcttcgaagaagcttctgggcttaccccaaaagcaggcctggggcactgtgggggactggcccagctccaaatcgggtgccagatgcccaggggcaaaaacaaaggccagggggacaggcgccccctaagaagagcagaaaaccatctccgaagcacaggaggggggaatcccccggcagggccatgttgatgccttggcctaagtttactctgagccccgctcccatggaattaaacaggaatgttagttttgggagagtggggagtcaagctgagcacagtgcacacactgtggagcagaaatggcatcacggagggaggacgcctcggctggctggaagcggctcacctgctaaaaagccctcggagccaggcgtggtggctcacgtctataatcccagcactttgggaggccaagacgggcagatcacctgaggtcggggttcgagaccagtctgaccaacatggagaaaccctgtctctactaaaaatacaaaattagctgggcgtggtggcatgcgcctgtagtcccagctactcaggaggctgaggcaggccaattgcttgaacctgggaggcggaggtggcagtgagccaagattgtgccattgcactccagcctaggcaacaagagtaaaactccgtcccaaaggaaaaaaaaaaaaaaaaagcccccagcaggctcctcaccctatagaggcagaagtgggctggggagacaaagccaggaaatgccagggctgggaggaagcagaatgagctcttgcagaaggtcggtcacaggaggctgcatagtgtccaccaggcgacaggccagtcctgcagctcagccactgagaaaggagctcagcgcgggccggacctgccttcccgagcgcagtggtggtgaccaaccacatgggaccagacaggtgccataggccacctggagccacaaaagtcactaactccccaaaatgggagagtcagatttcatataaaaagcccagaaaatgcctgtgtacgttttctgagtccatccctttccaaactccatgctaagggctccagctcagctttgagctgcctgtcaggcgacattcgtcactcacccatctgaaagccactggtaacccaggctccccggggctgccgagcgggaatagacctccactctgtcagccaccatgaaagctgagtagaaacccactccaaactggccgatgatcttgctgctggcctcagcctggttctgcagagcatccaggaaggcctgtggggcagaggccagttagtgaggcagcctcccctccagagagcagacactcccaacaccgtggctcttctgcgagcaccgctaagaccccttcatcctgaaaacagccacaccgagtacttttccaccccattctacacgtgaagagctaagtcacagagaggtgacacattagccctaggacaaccagctggcagcagtgggacaagtgtgttttccatttgattcccaaagctcacagtcctgcctgtcccagacaggtggaggcctgtgggtcacacctgggggtggggaaagagcagcttgaataagctctttcccttgaataagctccttccataggaaggccaggagtgaggagaggctccaaactggcttccatattcaagtctcctggactctacactttgtgggaaaaagagtagaaatcacgcgcatgcgtctgtaagcaccgcacagcacttcatttttctactataatactgccaaaggtcctaaggccaaagtcaagtaaaatacacacgcccactgccctggcccacgttgtccgatggaactttctccaacaacaggaacgttctgccaggtgcaatgcgacagcctgccgagcacctgcaatgtggcctgtgcagctgaggagcacaatgtccccttttatttaatttgaatgcatttacatttaaactgccacatgcagctggtggccgctacacaggacagcagaccaacctcgagagaaatacaacaaaagacgtaacgtgggggtcaagtcacagttagggtgggttttttgtttgttgttgttgttgttgttgtttttgagatggagtgtcgctctgtcgcgcaggctggagcgcggtggcgtgatctcagctcactgcaacctctgcctcccgggttcaagtgattctcccgcctcagcctcccgagtagctgggatgacaggtaccaccaccacgcccagctaatttttgtatttttagtagagacggggtttcaccgtgttagccaggatggtctccatctcctgacctcgtgatccacctgcctcggcctcccaaagtactggggttacaggcgtgagccaccgcacccgacctagtgttttcatcttacagatgaggagactgaagtaagtgctttgcccagagctggaaaagggcgaccgctggaggttcccaggctgttggtctgagtccaaatgtgttgctctgcctcacagcacttttctgcaaagtcgattccctgagccttgtgggcttgacgcagagagggtcagagggatcagtcccctctcacacagcgccgtgatgagaacgggcttgggatgcggcgtctgtgggtttgatggttctggtcagaactgctctgtgggtctgggcatagtgacgtgcacctgtagtcacgcctcaggaggctgaggctggaggatagcccggccaacatggtgaaaccccgtctctactaaagatacaaaaaattggccaggcgtggtggctcgtgcctgtaatcccagctacttgggaggctgaggcaggagagttgcttgaaccgggaggcagaggttgcagtgagccaatacagttggtcctcctatctacgggttccacatttgcagattcaaccagccaaggatcgaaaatactcagaaaaaaaataaaaaacaacacaatgataaaaagtagtataaaaaacataactatgttatatctatatctagcatttacattctatcaggtattataactaacctagagaccatctaaagcatacaagaagatgtgtctacaatatacggcaccaatttaatccgggactggagcatctgcagactttgctatccaaggggggtcctgaaaccaacccctagatactgagggaccaacccccagatactgagggatggctgtcatgtcatgaggtgttcccacagtacccactgcgtggcatgcaactgacaacgttcttacttaatctggcacccagggccacccctactggagggatccttgcaccctgaggggaagggggaggctgtgtgggggccccacgcttacctttgaccccgatctggcaatcgtccccaggttggacaccagctcttcctgtgtcatcccgataccagtatcctgaggagagagacgcactaagtgccaagcccccagcacctggggagccgggtgagtgcaccagcagtcccagggactcaagtggtgtcaatgacattggccagacagggcccagccaggtagcaccagatgctcatcagaaaagactaattctaggggccgggagtgatggttcatgcctgtaatcccagcactatgggaggccaaggcaggcggatcacttgaggccaggagttcaagaccagcctggccaacatggtaaaaccccatctctactaaaaaagaaattagccaggcatgatggcgagcacctgtggttccagctactcggaggctgaggcaggaaaattgcttgagcccagtgaacccaggaggcagagactgcagtgaactgagattgcgccactgcactccagcctgggtgacagagtgagactccatctcaaaaaaaaaaaaagaaaaaacgaaaagactaattctagtcatagcagcttggcctcaccagagaaaacaggaagggacagcagaaagttgctttgtttgttaaaaaccattccgaaaagaaaatattacaccagcaattaggaaaagcacagctctcccaccatcaagatgtggcccccacgccttctccctggctgtggttctggggaacagtgatcccctctggtggctctctcaatccagcagaatgatctgactgaggacaccaggaagcaggtgttgggaacgcagctctgcacgcggcacctactcccaccctaccaccatgggaacagcgggcacagacgcctctcctgcgggaaggcagagcccttgcgttggagcctctatctggcctatcctgttgcagctgctctgctctgagtgccagtgtcacccaaatccatatattaagacctaagtcccaaggggatggcactgggaggggggccttggggaggtgatcaagtcacgacggctccactctcatgaatgggagtagggcccttagaaaacaggcttgagggagcttgcctgccccttccaccttctgtatgaagatgcaagaggcactgcctgagtcaaagggccctcgccagatgcccaatctgctggccccttgctcttggacctcccagcctctagaactgtaagcaatagggttctgttgtttataaattgcccagtctaaggtattcggctatagcagcctgaatcacaatacagaccaacgcgctggtgaacacacaaggccttactgaccatgggctcctccttcctcaaagcccagtcagactcccatctgcagatcctcgctcaacatgcccataatgtagccacagccccagcttgctctgctatgatgtgcagaccaccttaaataaaagagctcactccaagcctccacatctatgaattgggacaaaggccctcagaaacagttttctgaacttccttctaggaagttcctttctaaagacttcctctccaggacagcctgcaggagccatgggagcccactagcaccaggcgccagtgctgtctccattggcaaagcaagggtggtcagtgccactcagcaaataatccacagcaagcagcaggccagggagactggccagctgtcagccttcccattgtaggcagcacaggcagaatgggtgccaaaaccacatcaccaccagttactgcagtgcacacatgtgtgcatgtttcacgggccccagcagccaacaagaaacatggcaccaagaggcttctgggcaattatttctgaggtgccggtttgaatagtccaaaatccagcctgattcatttattgtagatcatgtaataattatgaataaaaaactacttaaaattagtatctagttgatatcagtcattaaatataagtttcatttaagtgtttaatacatcagaaacttaaatagagtccttaagggaaaggttaatgttagaccaaggtaaaggaaaaaatgcaactaatagctcctattttcaatttatttttattttttcccaaactgatctgcactgcaatcccagtctaaatcctcacaggttttgtagaaaatgacaagccgattctaaaatgtatatggaaatacaaagaacttagaaaattttcaaaatattttgaagaacgaagttggagaatttaaaatacctaattttaagacttcctataaagctacaataattaagacagtgcgatgtgggcatttaaggatcgacacatggatgaaagaaccaaacagagcacaggaacagagatgcacagagagtgtattacttgatttttgacaaagattccaaggtaattcaatgggggatgataggtctattaacagatagtactgaaacaactgtacacccataaacaaaacataaacctcaagccctacctcacaccatacacaaaaattaacttgaaatggatcatagatctaaatataagagctaaagctataaaacctctagaagaaaacatagggctggacacaacagctcacatctgtaatcccagcactttggaaggtcaaggtgggaaaattgcttgagcccaggagtttgacaccagcctgggccacaaagcaagaccctgcctctacaaaaaaaaaaaaaaaaaaatttctcgctctgtcacgcaggctagagtgctggagtgcagtggtgtgatctccgctcactgcaccttccgcctcccgagttcaagcaattctcctgcctcagcctcccgagtagctgggactaccggcacacgctgccacacccagctaatttcttttgtattttcagcagagacagggtttcaccacgttgcccaggctggtcttgaactcctgagctcagacaatctgcccgccacggcctcccaaagtgctaggattacaggcgtgagccaccatgcctggcaaaaaaaataatttttttaaagttagccaggcatggtggcatgtgcctgtggccctagctacagggggctgatgtggtagatcacttgagcccaggaggtcaaggctgcagcgaaccctgatagcaccaatgcaccccaacctggagacggaagaagatcctgactctaaacaaacataaaaaccttccaggtcaggctgggtgcggtagctcatgcctataatcccagcactttgggaggccgaggcaggcagatcacacgaggccgggagtttaagatcagcctgaccgacatggagaaactctgtctctattaaaaatacaaaattagccaggcatggtggcacatacctgtaatcccagctactcgagagactgaaggcaagagaattgcttgaacccgggaggcggaggttgcagtgagctgaaatcacaccactgcactccagcgtgggcaacaagagcaaaaccccatttcaaaaaaaaaaatcttcccggtcatcaaaaacaaggaaagtctgagaaactgtcacagccaagaggagctaaggggccaggacaactaaatgtcatgtgggatgctgggagagaaaaaggacatgaggtaaaaactaaggaaacctgaatagacttgtgttaagaataatatatccataccggttgattaactgtaaccaatgtaatatactaacatttctttttttttttttttgagacgagtttcactcttgttgcccaagctagagtgcaatggcgcgatctcagctcaccacaacctccgcctcccgggttcaagcaattctcctgcctcagcctcctgagcagctgggattacaggtgcacaccaccacatctggctaatttttgtatttttattagagatggggtttcaccgtgctggccaggctggtcttgaactcctgacctcaggtgatccgcccaccttggcctctcaaagtgctgggattacaagcgtgagccactgcacccggccataaggtttcaatcataagggaagctgggtgttggagtagatggcaacgctgtactatctttaaaatttttctgaaaattgaaatctgttctaaaatatttactaaaaaaaaaaaaaaactatagatttttcagatgtagacagaaatcatctgttgccaggcgacccgcacaatgtgattttaaaaggaaatggtgagactaggcgcggtggctcccgcctgtaatcccagcactttgggaggccaaggcagtcagatcacttgaggtcaggagtttgagaccagcctgaccaacatggtgaaaccccatctctactaaaaatacaaaaattagccgggtgtggtggcatgtgcctgtaaacccagctacttggggggctgaggcaggagaatcacttaaatccggggggcagaggcctcactgcagtgaggtgagatcataccactgcactccagcctaggcaataaaatgagactctgtctcaaacaaaaataaaaaggaatttgtgagggtttacaacaggtatatacataaaatatttgacatcaaaagaaaaagatgattttgccaccggaatgatactgttgtaagattcttacaatgaagtgttaaatatcaattcaagctagacagtgataaattaaggctgcatattttattccctagaaaatcccctaaaaataacaaaaagcaatgtagctgagatatcagtagatgagatggaatggcataatacctctgagaccccacaagaaagcttccttttctaaaactttaggtaagaataatctatcaatattagttaattaattgtaataaatgggctgggtatggtggctcatgcctgtaatctaacacttgggaggccaaggcgggcagatcacttgagggcaggagttcaagcccagcctggccaacgtggtgaaaccccatctctactaaaaatacaaaaattagttgggcatcatggcacacatccgtaatcccagctactcaggaagctgaggcacgagagttgcttggacctgggaggcggaggctgcagtgagctgagatcacactactgcactccagcctgggcgacacagccacactctgtctccaaaaaaaaggaaaaaagatgaaacaaatggaccatgacgctcccatcggctattgagaatagaaaaactgggtcccaaaggatataatggagctctaaattacctgctcaaattttctgtaaatctagaactgttctttaagaaaaaagaagacaaaagacaaaaccaaaaatcattattgtaacataaatggtcttagtaccaggaagtactggcacatgaggactggcccctctgctaaagaccaagaatcatgtccccatgaccccttgccccagcacatccattttcaatcatctgcaaggaacctctgtgctgaaaacaggaggaaagcacagggcgctgcagccctgcccacagggcccattccacagccaggccagctcagcaaaggcagggagagaagaaacccactccccacccaatccttatgaccaagggctatgacaaacagctggcacgtaccacggggctcagtctggattctctaaacccaagagggagtgcgtaaagctgacacctcacaaaagcccctcctttaattaaaacagccatcccttcacaagtccattcattcacgcgtgcctgcattcatttatgtggcatgaccttcagagcaagccagcaccctaaaagggaatactcagatcccaccgaggccagtctgtccacctctccacagagacagacacccccgcaatgacgccgtgaccctgggatgacaggtcctgaggcagctgtctttggatgcaatgtctctcagggcccctacctgatcctctttggcctaacttttcagccttaaaatttccacaaggctacagcagcagccacagcactgcttcgtcggcattttgaggggaaaacgcagttaaaaatatgaaaagagtacattaaaaataagatatgtttagatatgttaatacctgcatataccaaaaccctgtgtggccatatgctaagatgttaccagtagttattgctggatgatggggtgatttcaaattttcttcttttctgcttacctgcttttccaaaattttctataatgaatgagtgctactgtaacactaaattatagccagagttatcctggtggtacggacggccagtacgtccctgggacccgagacatcactagaaggcggatcctgtccttgctgcatggccgggcctgccacacgcctggacactgagggaggtacctggatggtgatggtgcctttctcggcattggtctgcaagtgaatctccatttctggcagtgcttggccgtcagacaccagtttgtgacgcagtttttccaaggcatcgctggcattggagatcagctcccgtataaacacctacaggaatagaaatgggaggcacagacaatgaaggacactcatcctgcaggatctatctggtcagctgcacttccaataactgttaaaaggtagaggagaatagtcaattctcaaagcataaagagtttctgctttagtcaaaggcagttcctctgggccggtcacaaagtgactgaaggtgctgactttcctttcaggatttctttgagagtctcactctgtcactcaggctggaggctgcaatcacggcttattgcagctttaacctcctggacccaagcaatcctcccacctcagcctcctaagtagctgggcccacaggcatgcaccacacccagctaattgttttaaaatttttatagacacagggtctcgctatgttgcccaggctggtcttgatctcccaggctcaagtgatcgttgtgcctccgcctcccaaagtgttgggattacagacgtgagccacggtgcctggcccttttcaggatttttaatcaagcctgaagttacgtgtccatctgttaattataactttaagaagagccctctggctggggttgggggctcatgcttgtaatccaggcactttgggaggctgaagcaggtggatcacttgaggtcaggagctcaagaccagcatggccaacatggcaaaacccagtctctactaaaaatattaaaattagctgggcgtgatggaacacacctgtaatcccagctactcaggaggctgaggcaggagaatcgcttcaacccacaaggcggaggttgcagtgagccgagatggcaccactgcactccagccccgacagagagagactctgtctcaaaaaaacaaacaaaagaggcctgcgaggaacaatttctttcccaactcctgcacagggatgacggcatatcactcaaacatccatttctccttgatatggtttggctgtgtccccacgaaaatctcaccttgaattgtactcccataattcccacgtgttgtgggaaggacctggtgggagataagtgaatcatgggggccgtttccccagtactgttctcgtggtagtgagtaagtctcatgagatctgacagttttttggggtttctgcttttgtgtcttgctcattctctctttgcctgctgtcatccatgtaagacgggacttgttcctccttgccttccaccatgactgtgagacttccccagccacatggaggtgtaagtccaattaaagctccttctttggtaaattgcccagtctcaggtatgtctttatcagcaacgtgaaaatggactaatacactcctactccacaaaaacaggttccctagcttcatctcatctagtggggaccaccaaacaccaggtctaccacacccggagaaaaacaggcctcagggcccagctgtccctcaggagctgaaaagcacactgacctcaaacagaccttccatttaaaatcagtgagagaggccgggtgtggtggctcacacctgtgatctcagcactttgggaggctgaaacaggcagatcacctcagcccaggagttcaagaccagcctgggcaacacggcaaaactccgtctctacaaaaaaatacaaatatcagccagaggctgaggaggaaggatggcttgagctcaggaggcggaggttgcagcgagccgagatcataccactgcactccagcctgggcgtcagacccagaccctgttccaaaaaattaaaaaaccaaaaaaaaaaaaaacaaaaacccacacaattaaaaatagaaaaattaagtccgcaagagcacataggtgaagaggaagcggtggctgatctgggcggaagctggaggtcactgggagtcaggaatgcagcactcatcagtacgaaacccggaaacagctcctagaaggccctctgagctttgaaatctgctgctttacaaactttcttcaggactctcctttgccttccagcaataatcagcatgtcaacgatggtggccttcatctttctttttccttgtcctgtcaccccaaatgagttttgcggggttttttttaatagagatggggtctcttcacgttgcctaggctggtctcagactcctggactcacacaatcctcctaccttggcctcctaaagtgccgggattacaggtgtgggtcaccgcacctggccccaaatgcgttttaatttcctcagtaactcctccctgctccatacacacaggactggggaaccttcttcctccggcagccaaagccgccaagacctgcaggtagtcccaccaggcaaaggggcctcagagcgtatccaaagctccacagagacggaattcagcagagctgcacgctaggatttgggggactttttttttggagagagggtcttactctgttgtgcaggtcagtgtagtaacacaatcatggctcactgcagccccaaagtctgccaggctcaagtcatcctcccaccccagcctcctgagtagctgggaccacaggtcagtgcccccatagctggctaattttttaaattttttgtagagacggagtcttgctgtgttgaccaggctggtctcaaactcctgggctcaagtgatcctcctgcctcgacctcccaaagcactgagttcccaggcatgagccaccacaccaggcctgtatttcgggaacttttaaaattattggcaaaattcaattaattcccagagttgatccagcccaaagaaccatctggatacacttatccaggaaaccaaaacagattctggtaaaactcctctcactggtagcttaagatgaggacctgtccaaagtttaatgctttctcacagctaatatattatctggcaattctccagaatggcataaaaaccagctttgtgaaaagaaactttgctagcatcgggcatggttagcagggaacgcacctctttttctgagtacagggaccgggcaacaatgtccaaaagcttctttgtctcggcctggaactcatgtttggaagtggaacctagtaatgaaacacagacacaaccaacaaagtttaacttctatttttgtgcaagaatacgctacgtcacattccaaagaaagcttaagtttatgagttttaaacttttttttttttttttttttgagacggagtctcgctctgtcacccaggctggagtacagtggcacgatctcggctcactgcaagctctgcctcccgggttcacgccattctcttgcctcagcctcccgagtagctgggactacaggtgcctgccaccacgcccggctaattttttgtagttttagtagagacggggttttaccatgttagccaggatagcctcgatctcctgacctcatgattggcccgcctcggcctcccacacatttaagatcatgaacaaaaagaaagaagcagacagaaacaaagtctggctgggcaccatggctcatgcctgtaatcccagcactttgggaggccaaggcaggagaatcacttaagcccaggagctcaagaccagcctgggcaacacagagggatcccgccatctctacaaaaaatacacaaagtagctgacggtggtggcacacacttgtggtcccagtgactcagggggctgaggtgggaggatcacttgagccagggaggtcgaggcttcagtgagccatgattgcactacagcactcggcctgggtgacagagaaagaccctgtctcaaaacaaaacaaaacaaaaagtctctcagaaaggaggtctcagggcaggacaaatcctcccactgctgaggccagacatgcctcgggctatgtcgagggaatgctgagcctggtttcccaatgtgcatggttacgagaactggactgcctctaagaaccagattatatgttctttcttttttttttagaggcaggatctggctctgttgcccaggctgctatgcagtggcaggatcgtgctcactgcagcctcaacttcctgggctcaaccgattctcctgcctcagcctctcaagtacctggaaccactggtgtgtgctaccatgcctggctaactttttaatttttttctgtagagaaagggtctatcttgcccaggttggtctcgaccacttggcctcaagcaatcctcctgcctcggcctcccaaagtgctgggattacaagtgtgagccactgtgcctggactatattcttcaaaaaagcggtttccaaattaattagttagaaatcaaaataacaagaaaacctcacttctctttttaacttcaaagattctactcttgtcgacccacttaaaagccagaaatggagccacttcaggactggctccaaagactgcttttttatacttcagagggaatgaaaagacagctccagaattcggtcctgcgcagactgggccaatgctgagtttcccctcccgcttccatgattattagcagatgtgccatgaatcaccactcaggggaggtgccggacggcaaactcacgggtggccaccagagggggcaagacacacccgacactggcagaagtccctcgctgggacagaaatggagggcgcagcactccctacagccaagaccttctgatttcacacctaaggcggtggctctaccaatcactgcctccaccctgaaaatgcccctttacgcacagcagtgaaccaaaaagccctcccagaccaaagcacgagccaaggctaccctgcacgctctctgtgctgctgataatcgagtgcaggggttcctccttgtcctcggcggtctgcgtgctgaacagtcgtcctgcctgcaagctccaggctgggtttcgcctggggcccaactgggctgtggtcctccgaggacacagaattggttttcctgaaaagacaaatatgcagaaagaatgagaattaggaagacacgagaaacaatatggtaattcgtcccatcaagggtgtctagcagaagctagcgtggacatctctaagtcgggctgttgctgaaagagaaatccacaggaccaaatgccacagtgtcagggtgtggttttggcaaggagccctcacagatgtcatcagtgtaagatactgtgtcttctcagaaccgcagaagcgaaactggagggggtgggctgctgccttcttttcagagggggtctcgctctgtcactgcgatcacagctcactgcagccccaacctcctggactcaggcaatgctcctgcctccgcctcacgagtagctgggaccacaggcacagaccaccatgcccccataattttttaaaaaattttttgtagaaatggggttttgctatgttgccaagactggtctcgaactcctgggctgaaaccatcttcccgccttggccttacaaagagctgggatgacaggcgtgagccaccatgcccagctggcagatgcctgctgacagcacttcccacattcgcctcacgggtgacacctcgcatcaacctaccaaactgaaacctgtctcgaccctcgcagcccctgcagaagcccccgatgggccacacttctttgctcttgacagtcaagcaaaaaaaaaatcctcccaaaagggatccaaatatttaaatgttaatattctgaaactgtctcatcttctaaaagttgattctttcccattgctttttcatccaaaacagattttttaaaaaaaatttgtgtactttaaaaactgaaaaacagctgacgatgggttctaccttctaactaagaaggagacttgtcttctgtaacttcctgctcagtccagtgggctgagaaagttgccggcagagcccagcgagggaggaaagcagccaatgtgtccccagccgcacgcagttcaccgacgcaggcccagaaaccagacactttcactccaacacaggactggaccgacccaacaccaacacccactgaccccagggaccacataccaggaccctgccttggtcagtagatttgcaatacgtgatggtgtcaaggatatgtggccagccagccacgccgtgtcaaagtctaagcctaaatgaaccgcatctaactgggagcctctcctgttcttcacaaatttgtaacaagtagaaaggaaagacaacagaatatccaggaatcaaggttttaaaaatcagcatatcagccaggggtgcggtggctcacgcccgtaaacccagcactttgggaggctgaggtaggcggatcacatgaggtcaggagttcgagaccagcctggccaacatggagaaaccccatctgtactaaaaatacaaaagttagccgggcatggtggcaggcacctgtaatcccagctactcgggagactgaggcaggggaatggcttgaacttgggaagtggaggttgcagtgagccgagatcgtgccgctgcactacaggctgggtgacagagcaacattctgtctcaaaaaaaaaaaaaaattaacatatcaactttcatactcctaaaaggtacaaaaacttgccttttttttttttttttttttgagatgaagtctcactcttgttgcccaggctgcagtgcaatggtgcaatctcggctcattgcaacctccacctcccgggttcaagcgattctcctgcctcagcctcccgagtagctgggtttacaggcgcctgccaccacacccagctaatttttgtagttttagtagagacagggtttcaccatgttggccaggctggtctcgaactcttgacctcaggcgatctgcccacctcagcctcccaaagtgctaggattacaggcatgagccaccgtgcccagccaaaacttgcctattctttaggcttattcctggacttacaaacagcacaaacctggccttttgtttttgtttttttttgagatggagtctcgctctgtcgcccaggctggagtgcagtgatctcggctcactgcaacctccatcttctgggttcaagcgattctcctgtctcagcctccaaagtagctgggactacaggcaccagccaccatgcctaatttttgtatttttagtagagacgaggtttcaccttattggtcaggctgctctcgaactattgacctcaggtgatccacccacctaggcctcccaaagtgctgggattacaggcgtgagccaccatgcccggccaaccctagcctgtctttatctctatgcagataccttaaaaacatctaccacaattcagaaagtattcaaattccaaaccatgtaaacatccagttatttgggcccatgtaattgcattgttcactttattcgtacagttaaaaaaaaaaaaaaaatcccgggacatttcttctggaattaaatggtatttggcattagaggagttcgcgaacagtctacatcaaaccagggtgctgaagtctctgtgcctccttccaaagcacagccagccctgggggcacaggagggaagtgtccaagtgccaacacctgcccacagagcatatcagtgtttctcaccatttgtgtaaaagaaacacaaaaaggataaaccagaaactgatgtgactgtgtattttgtttcctaggactactgaaacacagcaccacaaactaggcagtttcaaaaaggtccacagttctgagccaggcacacaacctcacacctgtaatcccagcactttgggaggccaaggcaggagaatcgcttgagcccaggggtttaagaccagcctgggcaagaaagtgagactccatctctgcaaaaaacacaaaaactagccaggtgtagtggtgtgcacctgtagtcccagctacttgtgaggctgaggtgggaagatcacttgagcccaggatgttgaggctgtagtgagccaagatcacactaccgcacttctgcacttcaggctgggtgagacagcgagactctgtctcaaaaaaaaaaaaaaaaaggtcccaggttctgggcagcggtgcttcccactggaggtgccgagggagagtccatcccgcacctctccccagcttctggcagtagccggcatccttggtgtttcatgctttgcagaccctccaggctctgtctcttgtcacatggcaagctcttctctatgtgagtcctggctgtgtccagatttccctcttcttatacggataccaggaatactggagttaggccccacccccatgcagtgtgacctcatcacaacctgatacatctgaaatgacccaaataagctcacactcacaagtaccagggatgaggacgcgaacgtatctttctctttttttttttgagacagagtctcgctctgtcatccaggctggagtgcaggggcatgatctcagctcactgcaacctctgcctcctgggttcaggcgattctcctgcctcagcctccctagtagctgggattacaggcacgcaccaccatgcctggcttttatttttaaaagagacatggtttcaccatgttggccaggctggtctccaactcctgacctcaagtgatctgcccaccttggcctcccaaagtgctgggattacagacgtgagccaccatacctggcctctttttaaaaaagaataaaaatagagacaaggtttctctttgttgcccagcctggtcttgaactcctggactcaagtaatcctcccactttggcctcttaaagcactaggatgacaggtatgagccactgtacccggccttcaaaccccacagcttggttacctacaggaggtgtgtattaaactccccgtggcacaaacccggtagcttacagtaacagacacttattctctcacagtcctggaagcaagaagtccaagatcaaggtgccactagggctggttcctcctgaggctgggagggagggtctgtttgcgcctcttccagcctctgcagcctctggcgttgcttggcttgtgggtggtcatcttctccctgtgtcttcccttcaggacgtctgcccttctccctctacacatgtctgtctgttcaaatgtccccattttataaggacacagtcatactggattagggcccacccaagtgaactcatcttaacttgatcacctgcaaagaccctatttccaaatatggtcacattcacaggtactgagagctgggacttcaacatctttcgtggggagacacaattcaacccccaaccagcatatgtacagagaatgcaaagaaagcgggaaggggagagggctggcagagctgagggaacatgacacttccacatacatcttttcgtatgtctctcttagaaccatggtcaggtttctcatactcaaaaaacaaaccattacttagccagacgtggtggcgcacttctagttatcagctactcgggaggccgaggtggaaggactgctcgaacacaggaggtggaggttgcagtgagccgaggtcgcaccactgtactccagacttggcgacagagtgagactctgtctcgaaaaaaaaaaaaaaagaaaagaaaaagaaaaagaaaaagaaaccgtgaaaacaaaacagggcgcacatgaacacaaaatgaaatacaaacagcaaatatgcagagctgtgacgatgacatcaccactctgaaagaagaactaacctaagagacttcagaaaatagcactttgactgttactgtaaaactaacctcagaggacagcacaccatcaccaggctcgggcaggagatgtgtcccctgcggagtcagcaggtctgagcccgatttacgcatgtgccaagatcaagcggaaaagctgattgtggctactgagttggggtcctcacagttgaagaaaagtcactgataaggaaggggcaggaataaaccctgcggggcggcactggaggtacaggcatcagtacaggctcacaacctttgccatgtgtacagactggatgcagaaatcaataccggaacatttacacacacacatttcccagctctgtccactgacgcgtgacagggcccaggcgcgatgaccccccacttaggctacagagagcaaagtccaaaagctgttccagtttcagcactctaaagtcccacgtcccagggaaagcctttgtcctggcaaactaggacggctggtcaccctacctggcagccagatcttggtttgtgaatacctctctccaaaaacaggaaccagagatccctgcggagcacacagaggagcctaggacacccagtggtgtgcagaaggacgagaaaggacggggtgtgtcaggagaacacacagcccagccagaagggctcccagtggcagaatctaggacaatctgtgcggcaaaataacgaacgacaataatggattgtaagctgtgacccggcaaatcaagcaaacatcggtgcacacttaaacagaggaggagcagcagctcttcatcacagcagaattccaatgaataaacacaaggaatggcagaaaacagaaagcacaccatcaggaaacaccacagcaataactggctggtgtaagttactactattttgagacagggtctcactctgttgcccaggctggatcacaatggcacaatcacagctcactgcagcctcgaccttcccgggctcaggtgatcctcccacctcagcctcctgagtagctgggactataggccgtgtattaccactcctagctaattttttttttctttttttttttgactgggtctcactctgtcgcccaggctgaagtgcagtagagtgatcttggctcacagcagcctcaaccctccggattcaagtgatcctcccacctcaaccttccgagtagctgagactacaggctcatgccaccatacccggctaatttttgtgttttctgtagagacagggattcaccatgttgcccaggctggtctcaaactcctgagctcaagtgatcccccggcctctgcctcccaagcgctgggattagagccgtaagacaccacgcccagcctaaggttatgtatttgaagcagtggtagatactgccaagtcacactccacagagatcctatcagtttacgttcccacagcaatgtactaaagtgcatatcatcctacattcctgccaagtcagtgttgagatgaaactcttggatctttgcctattggtcagataaaattttcactgcagttttcacttacatttctcttattataagcaaaactgagcactgtcccgtatttttaaatatttcctatttccttttttgttaagggactgttggtatcctctgataatttttctactacattttaaatcttcttcttattgatttgtaagagctttttatatattaaggaaattagtcgccaggagcggtggctcacacctgtaatcccagcactttgggaggccgaggcgggaggatcacgaggtcaggagattgagaccatcctggctaacacggtgaaaccccgtctctactaaaaatacaaaaaattagccaggcgtagtggtgggcgcctgtagtcccagctacttgggaggctgaggcaggagaatggcatgaacccgggagacggagtttgcagcgagctgagatggcgccactgcactccaccctgggcaacagagcaagactctgtctcaaaaaaaaaaaaaaaaggaaattagtcttttggttgtaaaagccttcctcactctaagattaaacatgatttccccatgtttcatttttctagtctttttggtttttccccaattaatatgcagaattttttttttttttcctcgagaaggtcttgctctgttgcccagagctggagtgaaatggcgtgatctcggctcactgcaacctctgcctcccaggttcaagcaattctcctgcctcagcctcccaagtagctgggattgcaggtgtgcaccaccatgcccggctaacttttgtgtttttttgtttttttgtttttcttttttaagtagagacagggtttcaccatgttggccaggatggtctcgaactcctgacctcgtgatccgtctgcctcagtctcccaaagtgctgggattacaggcacaaaccactacacccagcctatatttttgaaaggatttaatataatattcattatgggaggagtatatagaagtcctcacaattgggaaaaagaaaaaaataagaaatctatatttccagccagaattgcaagacttagtatcataacgccaagattacattaattgaattgacagcattcttaaaagcagatttgatttcaggttatgtaaactttccacaacaacttttttttttttttttagagtctcactctgttgcccaggctgcagtgcagggcgccatctcggctcactgcaagctccgcctcccggattcatgccattctcctgcctcagcctcccaagactacaggcgcccgccaccatgcccggctaattttttgtatttttagtagagatggggtttcaccgtgttagccaggatggtcttgatctcctgacctcgtgatctgcccgcctcagcctcccaaagtgctgggattacaggcgtgagccaccgcgcccggcttctacaacaacttttaatcactaactcaggtgcagtggctcatgcctgtaatcccagcactttgggaggccaaggccggggggtcgcttcagctcaggagtttgaaattagcctgggtaacatggcaaaaccccatctctacaaaaaaacagccaggtgtggtggtgcatgcctgtagtctcagctacttgggaggatcacttgagcctgcaaggcagaggttgcagtgagccaagatcacgccactgcatttcagggtgggagatgcagccaggccctgtctcaaaaaaaaaattaaaaattaaaaaaaaaataaaccattagaggaataaatctgcctgaaccagataccaaacacgctagctgtacaatttccgtctttgtgtttctcctacaccctaaaggaaaaaccacaaacctcaatgtcaggctacaagatcttactgttaaactatctggtggtttggggtcgcacaaaatgggaagcactgatagtttgaatgtgacaccacacacccctccccttccaccccccacatccctacccactactgccagtgcccatgcagctcctccactctgcagctgcagtctcagtagctgggactccttcccatccgagttgctgcagggcctggctgcaggccctctctcccattcaggcctccctggccccagcagttcacaataatctcttcctatgagttcactgcacttaactttttatgctgcccatttaaaaaaattttatactggccaggcgcagtggctcacaccataatcccagcactttgggaggccgaggcgggtggatcacctgaggtcaggagttcaagaccagcgtgaccaacagggtgaaaccccatctctactaaaaatacaaaattagcactgggtgcctgtaatccccgctactcgggaggctgaggcaggagaatcacttgaacccacgaggcagaggttgcggtgagccgagattgtgccattgcactccagcagcctgggtgacaagagtgaaactccgtctcaaaaaaaaaaaaaaaaaaaaaagatttattcatgtatttactatttctttctttcttagaaaagagattgctctgtcacccaggctggagtgcagtggtacagtcatggctcactgcagtcttgaactcctgggctcaagggaccttcctgctttactctcctgaacagctgggactgcaggtaagcaccatcacacaggactaaattcttttttttttttttttcctagagatagggtgtttccatgttgaccaggctggtcttaagctcctggtctcaagcaatcttcctaccttagcctcccaaagctgctgggattacaggtctgagccaccacgcccagcctgtgctgctcatttgaaactgctgctatatgccagcatatgacatttcccactgttaattttttggttaatgtataatttatctcaccaaattagggcaggaaaaagcttgtatttctcagtaacactctttgaagacaggaacatccatatttcttggtatgccaaagtatctatcacaaaagctactctttacaaacttttttttttgagatggagtttccctcttgttgcccaggctggagtgcaatggcgcgatctcagctcaccccatcctcctcctcccgggttcaagcgattctcctgcctcagcctcccgagtagctgagattacaggcatgtgccaccacgcctggctaattttgcattttttgtagagacggggtttctccatgttggtcaggctgctctctaactcctgacctcaggtgatccgcccacatcggcctcccaaagtgctaggattacaggtgtgagccaccacgcccagacttttttgtttgtttgtttgagatgcagtctcactctgttgcccaggctggagtgcactggcacaatctcggctcactgcaaactccgcctcccagttcaagccattctcgggcctcagccgcccgagtagctgggactacagatgcacatcaccacgccaggctaatttttatatttttagtagagatggggtttctccatgttgcccaggctggtctcaaactctggggctcaagggatcctcctgcctcagcctcccaaagtggtgggattacagaagtgagccaccgcacctggccaagggtgcatatttcaaacaccagagtaaccactaaaataataattcaaagaagaatagctttaaaaagcattagataaaccacaatggaaatctcaaatacatttcattgataaggaaaggaaaaacagggaaaaaatccaaaaggacaaataaaaggcaaataataaaatggtagcaataaatccagccacatcgatatttactcttacattaacagactgaactctaattataaggcaaggattgtcagaattggtaaaggaagacctaattacatgctatctacaagacactttaaacataaagaaaaagatacacttaagacaaatgaatggaaaaatacataccatccaaaaagtgtgtttaagaaagctggagtggctctattaatatcaagtaaaatacatttcaaaataaaaaatattattaggaaaaaagaaggatatttcagaatactacaacaaacaattcatcaggaaaatgtaatcacaagtgtgtatttgcctaataacagagcttcaacatatatgaagttaaaacggaaagaattaaagacaaaacaattccacaatcacagctggagatcttaacactcctctctcaataactgacagaatcaaaccaaaaaataaaacagaagccgggcacagtagctcacgcctgtaatcccagcactttgggaggctgaaacaggagaatcgcttgaacccgaggcagaggttgcagtgagctgagatcgcgcccctgcactccagtctgggtgacagagtaagaccctgtcccaaaaaaaaaaaaaaaaaatagccagacagtccagaagaaaaacctggggcaaaagatatgaacggcatttcacagtggctacagaaagcgaaggagcaccaaactatatatgaacacagcaagctctccacgagctatgtagtgagtaacagaacacagagaagggtgcgtccctgagggaatatgtacatctgcacttactacagtcatacaagtaagtagtggcaggacccacaggcaactaatagtggttatgaagacagcaggtgctctgaacagcagcaagacttctcaagctttacctgttcacatggttttggttaatcaaaccatatttatttattcaaaacagatattaaattattaaaaatatgaggctgcccggcacggtggctcacacctgttatcccagcactttgggaggccaaggcaggtggatcacaaagtcaggagttcgagaccagcgtggccaacatggtgaaccctgtctctactaaaaatacaaaaattagctgggtgtggtggcgtgcacctgtaatcccagcctgggcgacacagtgagactccatctcgggcgggggaaaatatgaggctgtcacaaaagtgctaatgttttccctgctgtcgatgttgaggtcacttgaaagctggtatggacacatcggatgaggaattcagtctaggggcctcttaggagccaaggcccaatgactagactaagtggacccagcaaacacagagggagggggcctgaggcacaaacacagacaaggtcctatgctcgaggcaaacaaggacgaggtacaaggtgagagccagaaggggccactgtgctgcttcacagacctgggaagaagttttttgagaaaagactttcatttttcaagaggcagatcattttaaagaataaggcctagggcagtggctcacacctgtaatcccagcactctaggaggctgaggcaggcagatcgcttgagcccaggagtttgagaccagcatgggcaaactggtgaaaccccgtccctaccaaaaatacaaaaacttaggtggacatggtgacacgcacctgtagttccagctacttggggtacttgaggcggaaggatcacttgagaccagagggtaaaggctgcagtgagccgagatcacaccactgcactctagcctgggtgacaaagtgagaccctgtctttaagagaaatttaaaaagctgggtgcggtggctcacacctgtaatcctggcactttgggaggctgtggtaggcggatcacctgaggttgggagtttgagaccagcctgaccaacatggagaaactccatctctactaaaaatacaaaattagccaggtgttgtcgtggatgcctgtaatcccagctacttgggaggccgaggtaggagaatcgcttgaacccaggaggtggaggttgtggtaagccaagatgctgccattgcactccagcctggagaacaagagtgaaactccgtcttgaaaaaaaaaaaaaaaaaaaaaaagcattcagtaagatggtagaatacaaaaatcaacacccggacgtcctatatacagaaaactagttagaaaatatgacataagagaccccaggaacaaaaactaaacaattaagaatgcatttaccaagaaagcaaaatctttccttttttttcttttttggcaagatcttttaagaaaactctgaaacactactagggccaaagactgtcattaaataacccacttaagactgttacatatgctacatactcacaagcggaggactaacaagtaaactacagacgtaaggtaacacttggaaagcatgggattatagagaaatgggacaatgctgtgtaatgtgtgctgatgctgaattacctctaacacaaagaaaaaacactagaggtagaacagcggtttgcacacactaccatggtgttcaaatgcatatacatgttatgtgatacatgcatgcatagctattctcatatgccacgcagatctctgcaaggacacccaaaaactggctaatggacttgccaccaggaggggtgttgtctgaggcatgtcagtgggagacgagtttttcatcagatatacctctgtatcgtttgcatattggactacatatatcaataatctacaaaataaataccctacttataaaactatttacaaaagttaggctgggcgcggtggcttacgcctgtaatcccagcactttgggaggccgaggcgggcagatcacgaggtcaggagatcaagatcatcctggctaacacggtgaaagccagtctctattgaaaatacaaaaaattagccgggcgtggtggcgggtgcctgtggtcccagctactcgggaggctgaggcaggagaatggagtgaacgcgggaggcggagcgtgcagtgagccgagatcgcgccactgcactccagcctgggcgacagagcgagaccccgtctcaaaaaaaaaaaatcaaaaaacaaaactatttacaaaagttacattacaggccaggtgaggtgcctcacgcctgtaatcccagcactttgagaagccaaggtaggcagatcagctgaggtcaggggtttgagaacagcctggccaaaatggtgaaaacccgtctctactaaaaatacaaaaattagctgggcatggggatgcacacctgtaatcttagctactcgcgagaccaacgcactagaatcgcttgaacctgggaggcagaggttcagtgagctgaaattgcatctctgcactcgagcctaggcgacagcacgactctgtctcaaaacaaacaaaacgttgcattataaaaaacacttaaaaacttacgagaaacataaacacatttacaaaatttcaaacacatttttaaactattctcattctaaaattcatgtggaaaagttagtgtacataaatagccaaagaaattttgaaaaaactgaggaaattcatcaaatattaaagaacattaatataaagctacaatattaaaataaatttccagaccaggcatggctgctcacacctgtaatcccagcactttgggagggagatccaggcaggaggaggctccctcgagctcaggagctcgaggccagcctaggtaacatagggagacccccccaactctcaaaaagtaaacacacacaaaaaaaggttaaattaatttccagcagggcacaggggctcatgtttgtaaccccagtgctttggaaggccaagttgggaggaacacttgaggccaggagttctagaccagcctgggcaacatagcaagaccaacctcttatttttttttttttaatttccgctgtcacttattaagtcaaaatgaattccagatggaccatagaagtaaaaataaaagctaaaagtactgaaagaaaacatgaaagatttagtaactttattgagatgtaacacatctgccatataattcacccaagtgcacaattcagtggttttagtatattcacaaagttgtacagccacgaccactaaccacagaacatttttttttttgagacggagtctcgctctgtcgcccaggctggagtgcagtggagccatctgggctcactgtaagctctgcgtcctgggttcatgccattctcctgcctcagcgtcccgagtagctgggactacaggcgcccgccaccacacccggctaattttttgtattttttttttagtagacacagggtttcaccatgttagccaggatggtctcgatctcctgacctcgtgatccgcccgcatcggcctcccaaagtgctgggattacaggcatgagccaccatgcccggacaactacagaacatttttatcaccccaaaagaagccctacagccactcatgttcactctcttttccctctcccaccagctcttggcaactactcatctatgtctgtctctatggatttgccttttctgggcacttcacagaaatgaaatcatacaatatatggttttttgtctggcttctttgacttagcataaagtctttggggttcatccacatatagcatgtatcagcacctcattcctttttataactgaagagcactccgctgtatagattatttttttccattcatcaaatgatgggcaactgggttgcttccaaattttttgtgagacagagtttcactctcgttgccaggctggagtgcaatgacatgatcttggctcactgcaacctctgcctcccgggttcaagtgattctcctgcctcagcctcccgagtagctgagattacaggcatgtgccaccacacccggctaattttatatatatatatatttttttttagtagagacggggtttctccatgttggtcaggctggtctcaaactcctgacctcaggtgatcggcccacctcggcctcccaaagtgctgggattacaggcgtgagccaccagtcccggccctttttttctttttttttttttgagacggagtctcactctgcagtggtgtaatctccgctcactgcaacctccaattcccagggtcaagtgattctcctgctgaggcacccgccaccacgcccagttaatttttgtatttttagtagagacgggttttgccatgttggccaggctagtctcaaactcctgacctcaagtaatccacccacgttagcctcccgaagtgctgagattgtagacatgagccactgcaccaggcccagcttccaactttttactgtaacttttgttttggggtggggtgggggtctcactatgttgcctggagtgcagtggctgtttacaggcactgtcatggtgcatggtagcctccaactggcaggcttaagcgatcctcccacctcagcctcccaagcaggtgggattagaagggcgcaccaccactcctggcctatttgcactcttttttttttttttttttttttgagataggttcttgctctttgaccaggctgaagtgcagtggcacaatcacagctcaatgtagcctcaaactcctgggctcgagcaattctcccacctcagcctcccaaatggctgggaccacaggcatgtgccaccacacccagcaatttttaaaaattttttttcgagatggagtctcactatgttgtccaggctggcattcaactcttggcctcaagcaatcctcctgccttggcctcctgaagtgctgcaattacaggcatgaccaaccgcacccagcctcgtttccaccttctgatggaccttcagattgttttcattttcgggttattatgaataatgctgctatgaacattcatgtgtaggctgttctgtggacatgttttcatgtctacaaggtatgtgcctcagggtagaactgtggggtcatatggtaattcggtttgactgtgtgaggagctgcaagaatgttttcctgcagaggtcgcaccgttttacattctcaccagcagtgtgggagggttctgatttttccacatcctagttatccattttgtatcacctgtttttttgttgttgtttctttaatttttaattatagccaccctagtgagtaggaagtgctaactcactgtagttttgctttgcagttcctaaactgccaggcatcttgagtttttaaaaaaaatgatttaagaggaaatctttttttttttttttttttgaggcggagtctcgctctgtcgcccaggctggagtgcagtggcgggatctcggctcactgcaagctccgcctcccgggttcacaccattctcctgcctcagcctcccaagtagctgggactacaggcgcccaccaccacacccggctaatgttttgtatttttagtagagacggggtttcaccatgttggccaggatggtctcaaactcctgaactcgtgatccacctgcctcagcctcccaaagtgctaggattacaagcgtgagccaccgcgcccggccttaagaggaaatgtttctaaacaaaatatataacccaaaaggccataaatataaggaccacataaaaatttaagtcaaaagacaaacacccgggtgaggtggctcatgcctgtaatcccagcactttgggaggctgaggtgggtggatcgcctgaggtcaggagttcgagaccagcctggccaacatggtgaaaccccgtctctaccaaaaatacaaaaattagctgggagtcgcagcgggcatctgtaatcccagctactccagaggctgaggcaggagacttgcttgcactcgggaagcgaaggctgcagtgagccaagatcgtgccactgcactccagcctgggcaacagacagagcgagactctaactcaaaaaaaaaaaaaaaaaagacaaacacattaagaaaaaaactgggggccaggcacgacggctcctgcgtgtaatcccagtactttggcaggcagaagtaggaggatcacttgagaccaggagttcaagacaagccggggcaatatagtgggaccccatctctaaaaaaaatgttttttaattagccaggcatggtggcacatgctccttgggaggaagaggtcacagccacttgggaggatgaggcaggagtatcacttgagtccaggaggtcaggcctgcagcgagccaggatcgcacaactgcactccagcccggatgacaaagcaagaccctgcctctaaaataaaatttagtgccgtggctcacgcctgtaatcacagcactttgggaggtgggggcgggcagatcccgaggtcaagagtttgagactagcctggccaacatggcaaaaccctgtctctactaaaaatacaaaaaaaaacaaaaattagccagaaagccaggagcagtggctcacacctgtaatgccaacactttgggaggctgaggcggatggatcatgaggtcaggagttcaagaccagcctgatcaacatggtgaaattccatctctactaaaaatacaaaaattagccgggcgtggtgacgggtgcctgtagtcccagctactagggaggctgaggcaggagaaatgcttcaacctgggagacggaggttgcagtgagccaagattgtaccactgcactccagcctgggcgacggagcgagactccatctcaaaataaataaataaataaataaaaataaatgagccgggcatggtggcgcgtgcctgtaatcccggctacttgtgaggctgaggcgagaggactgcttaacctcgggaggcggaggttacagtaaggtgagatggcgccactgcactccagcctgggcaacagagtcagactctgtctcaattttttttttttttttgagatggagttttgctctgttgccgaggctggagtgcagtggtgcgatcgcggctcactgcaagctccgcttcctgggttcacggcattctcctgcctcagcttcccaagtagctgggactacaggcgcccgccaccatgcccagataattttttgtatttttagtagagatggggtttcaccgtgttagccaggatggtctcgatctcctgacctcatgatccgcccgcctcggcctcccacagtgctgggattacaggcgtgagccaccgtgcctggcccgacactgtctcaatttttaaaagttatttaaaagggctagcgcagaggttacggtgagccaagatcacgccactgcactccagcctgggcaccaagtgcaaaactccatctcaaaaaaaaaaaaaaaaaaaagaaaaaggccattggttcaagagaaaaatggccattcacaaaaacaagaaacatcaatggctttacgtcctagtaaaagatgttttaccacactcataactaaggaaatgcactttaaaacgagatagcattttcactaccagattgacagatgttttaaatactgtcattctagcactggtgaaggtgtgagaaactgttggcaatgccgtctgttatcttggggaaactcagcaacaacctaaatgtccgccatgagagggttacataaattacaaaacatcctcgctatggaataccagagctctgtggcgacaggaaacaaaccccagaatataagtggaaaatgcaaggtacggaagattacacacggttccttcccagtttacctttgtttcccttttttttgtgtgtgtgtgtgagacggagttttcgctcttgttgccaggctggagtgcagtggcgccatctcggcacaccacaacctccacctcccagattcaagcgattctcctgcctcagcctcctaagtagctgggattacaggcatgcgccaccacgcccggctagttttgtatttttcgtagagacagggtttctccatgttggtcaggctggtctcaaactcctaacctcaggtgatccacccgcctcagcctgccaaagtgctgggattacaggcgtgagccaccgcgcctggcgagaagattcttaagtacatgaacattctgaacagaaagacctgtattccctcacaaatgtctgagttcttagctctggcattctcaacactcactgtttcttgaggtttcctgtgttccagaacctggtctaatcgttctctactatgatatactgatacttcattcatcaggaaacataactccttgaacataaagaaaaagaacaaaaagcgaaagggcacctcggaatagtcaaaatatgggcctgaagccctcaccctgagctttgctcatggaagactactggccccatatgaaatccatctcattctaacaatttgatgctaacaagtttcccagccacatctgcaaactaggaaaggagagaacagggctccagacagacctgcaagttaaggccacagtaagagaggccaaaaatataaacactcacaatgcagttttgatgtggggacacttcatagacgaaggattcttcacatttcaatggccctacgggagcctacatattaaaacagaagaccaaacattaacacccgtaataatgaccctgaaaacatccaagagaggttcagtcatgggccatcaaatgatggagtgttctagaaagacttctcatcataatggttaaaatgaaatgttttaaagtcagcctcgtggaaaattcgcttgaacattccattgcctgacaaatgctgaaatactggcaagtgtgaactaacatggcaatgtgctgtcttaatttctccttcgaggtgcatatcactaacccgacacacatagttacattagaaggacccacgtccttctgtcttcttctcagcagcattgctgaatagcctcctgctcttaatatggcatttaatttagctatctcaaaattaatttcttttatatgtgtgtgtgtatatatatatatatatatatatttttttttttgagacactgtcactctgtcacccagactgtagtgcagtggcgtgatcacagctcactgcagcctcgacttctcaaggcttaagggagcctcccacttcagcctcttgggtagctgggaccacaggcacacccagctaattggaaaaaaaaaaaaaagggttttttggtagagatgggggtctctctaggttgcccaggctggtctcaaactcctaaactcacaggatcctcccgccgcagcccccaaagtgctgggattacaagcatgagctaccaggcctggccaattttttaccttctagccacatttcttaattatatggctatgaagtaactgagccattccttttaaaaccaatgattcagctacatgtcctttcaatctacccaatctacaggaattcacctggttaaaaagccaatggcagggctgggaacggtggcgcacacctgtaatcccagcactttgggaggccgaggcaggcagatcacaaggtcagaagttcaagaccagcctggccaacatggtgaaactctacctcaactaaaaatacaaaaattagccgggcacggtagtgcatgcctgtagccccagctacttgggaggctgaggcaggagaactgcttgaacccgggaggtggagattgcagtgagccgagttcgtgccactgcactccagcctgggaaacagagcaagactccatcttgaaaaaaacaaaaaaaaaacaaaaaccaaaacaaaaacaaaaaaaacacaggtggcagtaatactcccgcaagtagatactgtttctccaagctacagcttttatggtaattcctagtggttttagcagaaataaccagccacaccacaaataaactccctgaaatctattttgttaaatgctgtggaactacagggaagccactttgtggactaagagcagcttcctagtagaaggcaggtcttcagtaggactaagcaggacggtggtaagaaaagttctagctggctacacttgaggcaccaaaaacgccatccatgaacattctctggctttgaacccaaaagcactttttacttcatttgagtatgaatggatacattttcaatcgctatcaagattctttgtcaggcccgacgtggtagctcatgtctgtaatcccagcactttgggaggccaaagcaggcagatcaaaaggtcaaaagattgagaccatcttgcccaacacggtgaaacctcgtctctactaaaaatacaaaaattggctggccatggtggcatgcacctgtagtcccagctactcaggaggctgaggcaggagaactgcctgaattcaggaggcggaagttgcagtgagctgaggtcatgccactgcacttcagcctggcgacagaaagaatctgtctcaaaaaaaaaaaaaaaaaaaaaaaaaaaaaaaaaagatatgtcagcattttgagacaagcaagtatcacaggcctcagtaacagcctctttcatggaactcacctttgtcacatggtatttactgacatggggggcaggagtaaatgtttattttcccacagttttcttatcaacctgacacccccatccccaccccgcaagctgcattccctctcttcctgccaaggggtagcaaaatacttggagattcctcttttgtcttagcttaggccaactactcacccagtaaccaataaacgctttgctaatctcttacattcggattgatgtgtttgtttccaagacagagtcttgcactgtcgcccaggagggagtgcagtggcacaatcttggctcactgcaacctccaacctccacctcccaggttcaagcaattctcgtgcctcagcctcccaagtatctgggattacaggcgcctgccaccaccctggctaatttctttgtatttttagtagagacggggtttcgccatgttggccaggttggtctcaaattcctgaactcaagtgatccacccacctcggcctcccaaagtgctgggattacagacgagagccaccgcgcccggcctgatgtgttctttttcaggcactcagataactcagttcccttggtcctaactaagctgaaggtcctcctggtggccttggacagctgggccacaccttcctctgccgtctaagtgccagcaccacagcttaatcagacgacaaacatgtcatggacgctacacctctagcgtcatctcagcaacacaaagagctgtttcacagacagagtcgcaactgaccagcaagtactactcccctccactctgaaaagaacagccggagagcaccagaaattcacctgaattctcctgaagggtgcagcacacaagacacggaaatcaaacagcacaggctccaaacaaagggagagcagagggaggaggcaaaacccgtcaacaaaacgaagtactgaaggggagggcgcagcaggcaggcaccacctacaggagcggggtccaggtgaggctctttttggaagatgaaacaaactagctagtacttgagccctgagcaaagtgaggaaaccagctctcccgaccttcctggtgctggcaggggacctactctcacaactctgatttccaagacaggaagttccagcaaaggctccagcttacagagaacaaaaaggcccaagatcttaacgcctgcaccaaccagtcctatcgtggttgcctcagtcatgttctggcaatttcacgaaaacaagagcatctggcatgaccaggagactggactcggcacccttggtgattgtggcagtcacctcgtcatgcaaaatgaccaacccgtcaccgtacctgcctgaccacagaatcacgtttgctttgggagactgcgtctgctgttgatctttccaggtcttccctctcctttaggaggcggcctcatccttctactggcacatctgacacttctgacagttggagctctgacgaaaagctctcatggtgggccacgtggctgggctccccacacaccaggcccagggctggctctgtgactgtcctgaggaatgcaggatgaggctcctacgcacaagcttatatctgacagaaaagacacaactgctagcctcattcaccatcactcctgcacactcccgcaagtctttcatcaaaccaattattcagagctatctccttacccttgcacctgcagctttccagacatggaacgttcctccctcccctccagtgaaaacagccttggacactcggcccaaatcgctcctcatctgtgaaacttaccctggggcaagcagctcttgtttctctaatgtgctgtccaggccaccaagatggccctggtacactgctcagcagccacctatgactccagacagcagggtcacattttctttgacgactcgggggcattggaaatgtatttgctgaataaactgttatgggcaaaaatgacaaatataaagtccacaagcggatatcctagcccacccctcacagaaatattctgagggtaggccaggcgcagtggctcacgcctgtaatcccagcattttgggaggccaaggctagtggatcatgaggtcaggagttcgagaccaccctggccagcatagtgaaaccccatctctattaaaaatacaaaacctagctgggtgtggtggcatgcgcctgtagtcccagctacgtgggaggcgaagtcaggagaatcactcgaacccaggaggcggagggtgtggtgagctgaggttgcaccactgcactccagcctgggcaacagagcaagactccggctcaaaaaaaatcaaataagatattctgagggcaagtgacagggctggcagtgtcaggggtcagtgaggtctgaaagggtaagagggctgagctcatgggtgactgaggcagcgtagcatgggcgagaggattccacagacataagacacgcacacctgaagccaggcacatgctacaacctggaaatactttcccaagaaaagaaaaaaatttcaagaggtctggattttctacataggtggatctgcctaaactattctttctcccctgttgcacaagacatgtattttcttagctaaattctctcatcgttcaatcaatccaaacaatttaccttcccattcatccacacaggtgacaatgacaagggcacctgccacgcagaaggctgccaagaacatgttccatttcttagactcaggcagaggaatgcttgaaccaccgcaccagaagatggaggacgagaggagagagacaatttttaagaaaaagagataaagggctgggcacagcggctcacgcttgtaatcccagcactttgggaggccgaagtgggcggatcacgaggtcaggagatcgagaccatcctggctaacagggtgaaaccccgtctctactaaaaatacaaaaaattagccaggcatggtggtgggcgcctaaagtcccagctactcgggaggctgaggcaggagaatggcctgaacccgggaggcggagcttgcagtgagccaagatcgcgccactgcactccagcctgggtgacagagcaagactccatctcaaaaaaaaagaaaaagaaaaagagataaagaaacagaattaaaatgtccctgggctgaaaactgacatattttccaaatggaagggacagtgcatgatacaaagcatgaatcacaaacacctgtggacgcgagaccacaaacgacaaagagaaaaaatcttaacctccaagggggaaaaaacccgagtcagctacaaaagaaacgagaaccaaattaacagaacagttggccaggcacggtgacacacgcctgcaatcccagcattttggagggcaaggcaggcagatcacttgaggtcaggcactggagaccagcctggccaacatagtgaaaccccacctcataaagacaaaaaaataaataaataattgatcagacactggtgctagaagagagcaacagcatcactttctgagggaaaattattattatttttgttgttgagatgaagtctcactctgtcgcccaggctggagtgcagtggtgcaatctcagctcactgcaatctctgcctcctgggttcaagcgattctcctgcctcagcctcccaagaagctgggattacaggcgcgcgccaccacacccagctaatttttgtatttttagtagagacagggtttcaccatgttggccaggctggtcttgaactcctgatctgcccacctcaggctcccaaagtgctaggattacaggcgtgagccaccgcgcccggccacaaggtatcttttatagaccactggttttgaaaagacataagattcagcgttgaagaaaatacctttggaataggcagtcttgatgcctgctaaaggggatataaattgataaggcctttttggacaatttggcagtatctgctaacatttcaaaaatgcataggctctgaaatatcaattctaaaattctaattatgtaaggctaaagaaataccgcacgtgaacaaatatttaagtactcacccattctatgcagcattgtaataaaaagtaaaacctgaaataacctttattgcgtccactaataggacaatgtttaaacaaatgacacgtccatcatacagaatactgtgtggtcactggaaggcacatggacctgtatacactgacatgaaaagatgtggaaagaatgctgggagcgttaaaattttctgaagtacaacgtagcacaatgcatacatggtttaggctttttagaataaaaaatacttatacgcagacatttatatttacacgtataacactgtgtacagccccgaagcaatgccgaaactttcactgttgttacctccgagtggggactgggaaagcagaggttagggtcgttctctctgttttacaaacatttattggcgcatccatcaattccaggccccgaggacacagctgcgtcaacgacatcgagtccacctgctctggggacccggatgactgctataggttttgttcactgtggcgtccccagaacctgcacggcgccgggcactgagcgggcgctcacatgtgcgtccaatgaacgaattaacaaatgaaccctcagtgcgctactgggaggcggggaggggtaaagcacgatccatggaactagcacgatcaccccgagtgagtccattccccgcaacatgcacccgcaaagactccgcgctccgcagcggctccacctgcacgtgcgctacctgactggaccgaagctccaggagggacgaccccgcagccgctccgcccgaccccgcgaccccccaagacccagcctccttcagggctcccatgggcgggtggcgaggggagtccagccgaggaaaaggcagccaagctggagctggcgaggagcggagcgaaagtaaacgcgtctgccgcgcttggcctcgccggacctcccacgcctgtgaagcaggtgccggcgcctcgctccccggagcacagggacgtccctgccgtctccgtggcccggcccgcccgctgcccgtccagccaggacgccctcacctcccggcacggccgccagcgccggcgcccgcagcaaaggccgcaggcggcggccccacagcagcagcgcccgcagctcgcgcgccatgtcgtactcccagagcgccgcgcgcagccacgcgggaccgtacacgatgggaaggggcgggacggggctgcgcggggcggggcttcctcgggcgcggggcggtgacgtcacggcgggcgccgggctgtccgggcagctgcctgctcgggcgcgtggcggggtactacccgtctcgtggacggtcgggcctgggggtgggacctccgtgaccttggatcgcgttgtcaagggcgacgggccttgcgcgcggaggtgggggaggtggccccgccgcccccggcccacgctggccggctgcgcctagctgtgcgcattcctggaatggggcggatgtcagtatccacgcgagggtgtggaggcgacgctggggaagaagcagttcccgtgtctgcgacctttgtgaatcccggccatccgtctaggccgctgcaagtctcttgcaaaccaagactggacaaaaagctaaagcgaatgaggaaggggattccaggcttgactggctactactccaaaacctgaacccagtgaccaataccaccaggaaaactgcggttattcgtttattccacttctcttgtccttgtcgagaagagtcaaactctaaagtatttagaaggttattctgagccaaatatgagtgtgcatggagggaggcacagtctcaaaaggtcctgagaacttggcccaaggtgcttgggttacagcttgcttggttttatacattttagagagacataagacatcagtcaatgcatgtaagacataggttggttccgtgtggaaaggcaggacaactcaaagggtgaaatacttagaggtcataggtggattcagatactttctgattggcaattggttaaaagagttgagttctggttgggcgcggtggctcacgcctgtaatcctagcactttgggaggctgaggtgggcggactgcctgcggtcaggagtccgagaccagcctggccaacatggtgaaaacccatcatctctactaagatacaaaaaattagctgggcaaggtggcacgtgcctgtagtcccagctcctggggaggctgaggcggaagaatagcgtgaacccgggaggctgcggttgcagtgagccgagatcgtgccacttgcactgcagcctgggcgacagagctgtgactccgtctcaaaaaaaaaaaaaaaagaaaacaaaaaaaagaaaaaaaagagttgagttatacagacctggaatcaataaaaagagtgtctgggtgaagataaggggttgtgggcacgagcacggtgactcacacctgtaatcccaacactttgggatgccgaggtgggcgaattgcttgaggtcaggagttggagagcagcgtgggcaacatggtgagaccctgtctgtaccaaacatacctgtaccggatgtggtggcggaggcctgtaatcccagctacaagggaggctgaggtgggtggattgcttaagcccaggagggagaggttgcagtgagccaagttcgtgccattgaactccagcttgggcaagagagccacaccctgtctcaaaacaaacaaacaaacaaacaaacaaaaaacaggttgtgaagaccaaggttcttattatgtagaggaagtctcatagatgaccacccttacaggtaatagatggcaaatgttttcgcaaatattgtttattcagaccgttaaaaattcctagaccctcaggatcaggaaaagacctgcaaaggtggcctggcatggtggcttacgcatgtaattccagcactttaggaggccaaggtggtcttatcacttgaggtcaggaggttgagaccagcctggtcggcatggcaaaaccccatctctactaaaaatacaaaaattaggccaagagcagtggctcacgcctgtaatcctagcactttgggaggctgaggcgggcagatcacctgaggtcgggagttcgagaccagcgtgactgacagggagaaactccgtctctactaaaaatacaaaaaatcagtcaggcgtggtggcgcatgcctgtaatcccagctacgcaggaggttaaggcaggagaatcgctggaacccaggaggtgaaggttgcagtgagctgataccgcaccattgcactccagcctgggcaacaagagtgaaagtctgtctcaaaaacaaaaaaaattacctgggtgtggtggtgtgcacctgtgtacagctgaggctactcgggaggctgaagcaggggaatcgcttgaacccaggaggcagagattgcagtgagccaagatcgcaccactgcactcccactccagcctgggcaacagaacaagattccgtctcaaaaaaaaaaaaaagtcctttgtaatgttaacgctggtcagttgtgcctcatttccaaggggtggagggtgtaatgaggcaggacccaccccatccttccaattatggcctgaactagttttttaggtttctttgaaatccccttggtggagaggaatgatccattccatgggttgggggacttataatgtgtttttgccggctgggcacggtggctcacgcctgtaatcccagtactttgggaggccgaggcaggcggatcacctgatgttgggagttcaagaccagcctgaccaacatggagaaaccctgtctccactaaaaatacaaaattagccgggcatggcggcacatgcctataatcccagctactcgggaggctgaggcaggagaatcgcttgaacccgggaggcagaggttgcagtgagctgagatcgtgccactgcactccagcctgggcaacagagtgagactctatctcaaaaaacaacagcaaaaaaagaatttgtttttgctttacaccttgctggaggttagagactagttggagattcagaccatacaccctggtctaacatttggtccagacccagctgcagcctcataatgccgatttcccggcacctcctcagtcccggagtggggcccaggcggctccactgaggttcccaggtaattcggaggcacactgaagattcactgccacactctaataactgtacaaaaatagcgactccagctcgtggcacgtgctgcagagaagcacaggagccaggagagtgaccttcagtggggccgggacagagctgggtggaagaggatgtgtcaggaaacgcttccaggtggaaagtggcaagttcccagcttaagcaattgagaagggaatggaaagagggtgggcagatttgggtggaagagcagggtcctgtcacccagaccactccagcagccctgacaggccccctgcttccgctcttgccagcctcccatcctccacagcagccggatcatactccgtctctcagatcctccagtggtccccctaccaacacacatgcacatatttacaatcctttccaaactccttctgcctcctcctataggcctgcatgggcctgcctgtgttccctatcaccacactccaggcagagccctttccagcatgtcctcagggaatgggggtgggtggggggtgtctcggcttcacatttcatccctttttcgctccattcaggaaatcatctctctctttttttttttttttttttttttgagacagagtcttgctctgttgcccaggctggagtgcagtggtgtgatctcggctcactgcaagctctgcctcccgggttcactccattctcctgccttagcctcccgagtagctgggactacaggcgcccaccaccacacccggctaatttctttttgaatttttagtagagacggggtttcaccatgttagccagaatggtctcgatctcctgacctcgtgatccgcccatctctgcctcccaaagtgctgggattacaggcgtgagccaccgcacccggccaatcctctgttttgtaacagctgtcacattggtccatggggcaatatatctggcttaggccttttatttctttttttgttttgttttgttttttgttgtttgagacagagtttcgtgcttgttgcccaggcttaagtgcagtggtgtgatctcggctcactgcaacctctgcctcccatgttcaagtgattctcctgcctcagcctcctgagtagctgggattgtaggcacccgccaccatgcctggccgatttttgtatttttagtagagacggggtttcaccatgttggccaggctggtctcgaacacctgacctcaagtgatccgcctgcctcggcctcccaaaatgctgggattacaggcttaagccaccacaccaggccagtttcaacaaggggaagtgatatttggcaaaaggagggaaacctgggctttagttaagggtggggggcctctgccaagactggcaggccccaagttctgtggagggcaaatctaccaagttccagaaaaacccccagagccttctgtcctgttggcctgtagccttcagagacaaaccctcagcctcagagccttgtggtcctggggcctctgctagcccagggccctgtgacttttttttatttttttatttttgagacggagtctcactctgtcacccaggctggagttcagtggcgcagtcttggctcactgcaacctccgcctcccgggttcaagtgattctcctgcctcagcctcccaagtagctgggactacaggcacgtgccactatgcccagctaatttttttgtatttttggtagagatagtgtttcaccctgttagccaggatggtctcgatctcctgacctcgtgatccgcctgccttggcctcccaaagtgctgggattacaggcgtgagcccctgcgcccggctggacctgtggctttgtaaggtactgagggatccaaggcatgtcctaaggtggccacacatggacttcaggctccgcgtaaaccaagaatctagaaagaggaaaaaatgtttacacgcagacgtacttgacttgaattagtggagaatgactgggagctgcttggggagggaaagggaagaacccccaagtctcctgcccacctctatggccaatacgaggctgcccatatgaagccactgccttccactggggtcagctgagggccgtgaaaaatgcccggtgctttattcacaatagccaaaatgtggaagcaactcaggtaaccatgaacgatgaatgggtcagcaaaatgtggtctattcatacaatggaatattactcagccataaaaaggaaggaagtagccgggcgtggtggctcacacctgtaatcctggcactttgagaggccgaggcaggtggatcacttgaggtcaggagttcgaggagtcctctataaaaagatgtgagcccatcaaaagcaccgttttatgcacaatttagatcaacggcaaagcactgtcatctactcatcaaagctcctcagaatctactttgctagtctgggcattacactcacttaaatttcttcagtatcttataagggacctatgttttcccacctctgcctatttattatgaagtgtatacaagtaattcatgtggaattaacacataaaatccatacgtccatgaggctgcgatgtcttcatggtctgagatgaagttattctcctgcctacatgcccctgcccgtctgttacggcgctgtgggcgcagcctctgcttcccggcacacactgtcctgtgctgagaatgtcctggtagcaaaatggccactgatgtgcaatcctctccttcataaaaggtgtgtttcttttttaaaaacagcttatttcaccatgcaatgctccaagcatgttttggctcaaataaaatctttggttctattttatagtaatcaaaaggaccgggcatgtttgctgacgcctgtaatcccagcactttgggaggccaaggcgggtggatcacttgaggtcgggagttcaagaccagcctggccaacatggcgaaatcctgcctctactaaaaatacaaaaattagctgggcatggtggcacatgcctctagtcccagctactcgggaggctgagataggagaatcgcctgaacccggaaggcagaggttgcagtgagccgagatcacgtcactgcactccagccagggtgacagagggagactctgtctcaaaaagaaaaaaggaagacagttacacgtcttcaacctgagattttttttttttttttttcagtcagagtcttgctctgttccccaggctggagtgcagtggcgtgatctcggctcactgcaacctctgcctcctgggttcaagcaattctcccgcttcatcctcccgagtagctgggactataggcgcatgctgccacgcctggctaattttttgtattttagtagacggggtttcaccacgttgcccaggctggttgtcaactcctgagctcaggcaatctgcccacctcagcctcccaaagtgctgggattacaggcgtgagccaccatgcccagcccaacctgagatcttagaagcagaagcctctccatgccacattatccagggacagctcattctatgtttctaacatgctagaatttcaaagatagcatcaaacacatgctctgtagagaaaaactccactgaacatctgcaattttttttttctttctgagatgaagtctcactctgttgcccaggctggagtgcagtggcgcgctcttggctcactgtaacctccgcctcctgggtttaaccgattttcctgcctcagcctccttagtagctaggactacaggtgcacaccaccatgcccggctgaatattttttttttttttttttttttgagacagagtcttgctctgtcgcccaggccagagtgcagtggtgcaatcttggctcactgcaacctccacctcccgggtttaagtgattctcctgcctcagtctcctgagtagctgggattacaggcgtgcgccaccatgcccagctaatttttgtatgtttagtagagacggggtttcaccacgctggtcagactggtctcgaactgctgacgtcgtgatctgcctgccttggcctcccaaagtgttgggattacaggcgtgagccactacacctcggccaattttttgtattttttgtagtagagatggggtttcaccatattggccaggctcgtctcaaactcctgaccatgtgatctgcccgcctcagactcccaaagtgctgggattacaggcatgagccaccaagcccggccagcaccacctacaatcgtttttttgagacaaaatctcactgttgcccaggctgtagtgcagtggcacgatcccggctcactgcaacctccgcctcctgggttcaagcgattctctgcctcagcctcctgagtagctgggattctaggcgcctgccaccacacccggctaatttttttgtattttaatagagatggggtttcaccttcttggccaggctggtctcgaactcccgacttcatgatccacccgccttggcctcccaaagtgctgggattacaggcgtgagccaccgcaccgggcccgcatctgcaatcctataatgacgagccgttgagctaactgtaagtcattagccaatctgaaccatctttgaatccaagtagttttaccatcttttattataaacaccatcacatttcaagtttcctctttttgatcacaaatataggactttttcttctcctcttaagtatacagcatgagacacagcgttggggctttccaggtttcttacagaaatttccttacgacaaacttagggttagcatccacagaccatgctctcggtcacatccttcgacatctggattgcccaagacggttgcacaggatgcagactccaaagaggatgaggttggtacataacgttttgaattccaggataacctgaaacagaggcccctccactgcccacattaaaaggctgcacaaccaggagggcgccactttctgagtgtgggcttagagctgctgctctcgggctctagccccacttcttgtttgaacacatggctcaaggtttccctacgggtggaaaagatgaagaggacactggaggttaagaacccagcaggccgagcagtggcagcaatctccaccggaggcccggcctgtgcttcccctcctgggatggggtgaatgggggctggtcaggggtgccagatggtggtcttatttttacttgaattattctgcattttataactcaaggttcaaagctctgtgctaaaactagatcggacctttccaacttcttagaaaggttcctcgaattcagattcccaaaccaagtattcagctatttaaaacctatctgtgaatgtaagggcccaaacggaagctatttggggcgtgatttctaaaattaccatcacccccacctagaccagcctttgttgggggactagggataaagtgggttctctgggtgctgggggtggtagacttaggggatgaacttcagctcccctgcccatggtcctcctctcagttttacggtttttgtgaacttgtctcacccactcagtaagggagcctggaactggactccaagggaggcaggaccatgtggctaagtgcaagtatcccccgaagtgggggacctttctcactgtaacagggaccggagctggtgctccaaggtgtctgtccctcagcatttcctcaaacgccacacgggacatgctgcgcggcagcggcaggatttggggggaagtcagaaagcacctcgcgagcctggagcactctctgcctcagattctgggagtcgtgtacggggggggggagccgcctgaacacgggaagaagcgccgcctctgggggtggcagctacgacggacagggaggatggaggagtgggccaaatgcagtttcagaccaactgacgaccctaactgtgtgagcgacaatcacctgtgagcctcgaatgtgtggggccaacgctgagccgcccacctcagtcgcccacctcagtctccgggaagaaaagcctccgggcggccgctaagcctgggccacagttcccagccaccacccacgccgccacaaccacaaccgcagccccagcctctccgctatgagcgaacaaccagaaccatgtcttacaaagaacagactcaaaaaatatatataaataaataaaaaccttaaacattcttacagggatcttaaagaacagaatacatgttaaaaacctcagtaatttatatcaattttaagcggtactttatatacaatggggaaaaaacacatgcatagtccaaatacaatgttgaaaacagcattttcataacaaaaaaccccgaacactaagtgttaataccatgtacatgaattcaagaaggaccaccctttttgtctgttgcacacagtttatttaacaatatgatataagaaatgagttggtattttaccattctatacagtgattgaatcttctcgagtttcgtatttataggaattagagcgcttgcatgatttacactagaattgcttttcctcatttcaagtttcacatagaagaaagaaaagaaggcttcttctctagtaacattagcatggtctaagagtgatcatccctattttttgtctaaaaccagttttatcagagaaacaaagcaacaatttctacatctgcaagacaagtttggcttcagccattatgtatagatagatgtgtgtgggtgtgtacgtgtgtgcacgccggagtcaattcctatcatccagggtaatactgggagacgcccacagagttcactatagaaaaaaatcttcccgaaacatcacaaagttatcgggatacattataagcttgcattatttcaggaatcagttctgaatattatttttcttcttacttttaaacataaatgtttaaagtcttgaaaatacaaataaaaaatatgaatataatgaacttgtttttcccgttaaaaaaaggcatgagtcaccagcaatgacgacaaaaagaatccaaacaaaacccccctccccccaaacaaaaacaaaacggaaaaaaaagaaccccccccacccccccgccaaaaaaaaaccaaagagagagaccagatatttaaatcaactggtttttaacaaaaaaatatattctttgtattgtttctttaaacatcaatccacccttccatggctcggaagtcgcagttccatctaggaataaaaagaacctagatgcctggattttcagtacaaaaggtccaagaacatgaaagggaaaaggtgatgctctcacaatgctacaagccctccacaaacttctctagcgtgtcccccgtggtgtccccgaccagggacagttcgctggacagcgcactcctgctgggggtgttcagctgggggagcattgcactctgttcggggttccccaagtgtccctgatctatggagctggccatggtgactgcgagtccggggtggggggaaccagtctggggtgagacgtggtgtggcgaaggctggggctgtatccgtggtgacgggctggaatgtggaggctgggactggggccgtggagactggacaggggctggagaccgcacctggttactaagggacgtggcgatctgctggccagggagatgcgaggcctgtggctgtcctgagagcatgtgttgctgggggctcatggggttcggctggcctggggacccaatctgctgcttcatctgctgttgctgcagaatccgctgctgcagggcttgctggatgttgggggtgctgtctgcccccagccccggctgccccatctggccaagctgtcccatctgagccgccatctggcccatggagctgccctggagggggagatgctgctgcatgcgctgctgctgctgcatggccggtgggtagcctccgggtccttgaggctgctggaactggccgtgccccgccatgcccccagccatgccggcactcccttgctgctgctgctgttgctgctgttgttgctgctgctgttgctgctgctgctgcagcagctgcctccgtaacatttctcggtactgtggattcatactcgccatgttggggttgtgtcctgggttcatgatgttcaaggcctggccctgggggttcaggcctcccatcgcctgctgctgtggaggcacaccgggccgcggcacgccagcctgcatggcattcaggttctgcaggctgggctgctggtgcatgccaggctggggttgcatgccgggctgggactggaggccaggctggggctgcatgccgggctgattggccacgtacttggctgtgcgctgtttgatgaaagctgccattagctgcgggtttgatttgagaatgttcagcacctgctgttgctgctgaggggagctgggcgacttcagggtccgcagcaggtcttgcagagcgctgggtgagatgctcctgggtggctgcacgctgggcatccggggcccagccacggccgcctgggcctgcatggatatcacaggcctgggcaagcctggcatgggctgctgctggggaaggggcgcctgctgccactgcccgggaggcatgctgggcatgacgggcccgctcacctggttgggtcggggcacattcaggctcacgggggccatctggctccccggggtccccatgcccgtgcgtcctgggggcatgctgttgttgatgttcacccggtacaggtgctgctgctgctgggcctcacgctcgatctgccgagccgcttccaccgctgcaggagggggctgggccgggggtgggggggccggcacctggctggtaggcttccctgtggacaccgtggtggggggctgagtccgggccacgctggggaagccagctggtgacatgctcacgggtgagggttggggctgggcagggggctgcggcgtctggggtgtgctgggctgctgtgtgggggtcccgggcggtgctgaggtaggagaaggcagactctgctgaggcacgttgcgggtgttcatggtggccatccgccggcgcatgagctgggcctgctgcaggcggtgctggatctgctgctggcggagcttgtgtttgatgttgaggcagaagggcacggggcatttgttttcttggcagtgcttggcgtggtagcagcagagggcgatgagctgcttgcacaccgggcagcccccgttggtcttgcgtttgcagcccttggtgtgctgcaccacccgcttcatcttctggcaggatggcagcgagcagttggcgttgcggcactggcacgcgtgcaccagcgactggatgcagcgctggatgctcagccggcgtgactcctgggggctctttgactgtggctcgccctggctgctgccctcgtcatccaggcccagcccccacttcaccatcttatgggcatggctcttcgtgttatagcagttgatgcagaggtcgtagtcctgcaagcaaggaaaggggacaggccggtgtcagcatgggacccagtaccaccaggcatcctggctgcttccctccaccgctaagtctgggtctgtgccaggagacccaggcaggataggagacccagacaggatgcgagcacggacaggtgggagacccggacagggcgggagcacggacaagatgggatcatggacgggatgggatcatggacaacatgggatcatggacaggacgggggcatggactgcctatgtgttgctcccaaggaccttcactcctggcaacagccctgaaggctcaaagataacctgacccatgccccaagaacccctggcctgtaagctcacggacagtagacaccagcccccttccttccgacttcctctgacctgggagtcacatcagcccttgccacagcctgtccaactcctgtactcaaactatgaagccagacagtgaaaggctgagggaggccggtccctcccaaagcgccgacagctgccgtgaagtgcctctgggaaggcctgagctatccgcagtgcaccagtgggacttccccaacgcgcaagcccaagttactgaaaactgctcgcacctggcaacctgatggagccctaggaccaggtaccatgactgtgttcacaaaaagatatgaaaactgccgcattcagaaactagaaagaggacaaaggagactggagaaaggtggaaagcggaagaagtgtgtgaaggtggggagggaagaaaggccctcgctctgctgaggacccgctctgccccgctacagacaccacagcaagtgaggaggctccgggttggcaggtgatggtgactgtcctgggagggggatggtgggatctgtcacctgcctgccctgcacagcctgactcggcccatgcaagggacacccacgtcatttcacaggggggtcaaaattcctagaggggagtgagggagcatgaccggggggtccttcaggaacaagtggccagaggggcccaagctgccaacaggacagcgggtgtttccagccatttagcaagactagaactgggcacagacaggccagacttcccagcagagcctccctctggccgtccccagggtcaggcctgtggctgtggctacacagagcaggtttaggaaacacacacacagcaacgccttctgccttgtgacgctgtcctagttctggaggagtcagtgcagccaccatcaggtacagacaccaacccgggcacccatgcaaagggacaggatgcttcgtcagaccccaggccggctgtgggggtgggggtgggggcagggcctacctcgcacacagtgcagtgccagcgcgtctccacgtggtgcttgcactcgttgcaggtgtagacaaagcggtcctggccctgggtgtgcagctccaccagcatgcagagcgtggaccacttggagcggcgcaaggaggagaactcccagtgcttgtctctggcgagggtgaggaaggcgtcgcgcccatccatgaggtcacagctgagcagggggtcggggtcgacgatggggggcagggtgttgatgacaggcccagcgtgcaggtggatcacgaagaagacctgcaggagaggaggggctttagtcccacacaagggacatggcacctccagtggtgagctcagggcaggcgcagccacccagcctgcagaataggcaggtggctgagcctgatggccctgatgccttgggatggaacaaaattggtgacacgttgcatgatgtcacccaactggtccacttggtttcctgggggccacttccctcccaccacagacctgcacacgggcccacgcccgccagctgcgagtctttccctcctcccggccagaggcacggctgcagcaccgcagcccacgcctacctccttgtgcttctccatggtggcatacagcttctgggacaggtcattggacacgttgggcatgctgggcttcttcttgttggcgcggctgatgctgcttttgttcttgttggttttcttgttgttcttcttcttggcattcttgctgtcgccctgactgccctgcaacaacacgcaaggctgtgagaccaggcaagtgcccctccacacttggcacggacgcccagctcccaggccgtgggcatcaggaagctcaggccaaagtaggtcaccaccaggcagaccccatacgtgaacggctacaggtggctgtaggtgctgcagccttcgggacagagcagggcctgtcctcggccaggctggtgtcattatcagctttatgccacgctgcctctaaaggggaaaagagacccagagtgcgagttcagaaattaacaaatgagggcagtgggggctgtttccactgtgccacaaccagatgcggaagattccacgtcacaactgtggtcagcagctgtctgccttgaggaaggctctacacacccgagaaagcatgagagcttccaggagacaggaaagctgctgatgggaaaagcagctgccccatcaagagcagggactctgaggcccctgcggggtccactcaaggcccacggagagcaggctggctccctgctggggccatcagtgctgcgcctgactggctgaaggtgggcttgctctcagcccacaggctcctcctctggaaagaacgcaggattaccactcacttacactttaacagagagctttattttttttgagagacggagttttgctcttgttgccaggctggagtgcagtggtgtcatcttgggttcaagtgattctcctgcctcagcctcctgggtagctgggattataggcacccgccaccatgcccggctacctatcattttttttgagacagagtctcgctcttgtcacccaagctgaagtgcaataacgcgatctcggctcactgcaacctctgcctccaaggttcaagcgattctcctgcctgaacctccctagtagctgagattataggtgctgccaccacacccagctaatttttgtatttttagtagagatggggtttcaccatgttggtcaggctggccttgaactccggacctcgggtgatccgcccgcctgagcctcccaaagtgctgagattacaggcatgagccaccgtgcccagccagagagtttcatttttaacaagatgagagagactcttggtgttcaaagagaggggtcagtccagagagaattcaacaatccagccgggcggggtggctcacacctgtaatcccagcactttggaaggccaaggcaggcggatctcgaggtcaggaaatcaagaccaacctggctaacacggtgaaactccgtctctactaaaaacacaaaaaattagccaggcgtggtggcgggtgcctgcagtcccacctactcgggaggctgaggcaggagaatggtgtgaacccgggaggcggagcttgcagtgagctgagatggcgccactgcactccagcctgggcgacagagcgagactccatctcaaaaaaaaaaaaaaaaaattcccaccccaccgacaagcagcccgaggagcccaaatatcacgtgggtcctccgcaggattcagagacagaaaagggacgtcaggggaaaactgaggaaattggaacgaagtgtagacttaacaataatgcatcaacatcaacaaatggctcaccgtggcagcaaatgtgccacactaaggtaagacattagtaacaggagaaactgcgtgctgcaatatactggaactctgtgctcaatttttgtgtcagccttaaaacaaaggaagcctattttttttgagatggagtctcgctctgtcaccaggctggagtgcagtggcacaatcttggctcactgcaatctgtgcctcccgggttcaagtgattctcctgcctcagcctcccaagtagctgggactacaggcgtgcgccaccacacctggctaatttttgtatttttagtagagacggggtttcaccatgttggccaagctggtctcaaactcctgacctcaagtgatccacctgccttggcctctcaaagtgctgggattacaggcgtgagccaccacgcccggcctggaagtctatttttacaaaattataaaataaatatgttcatgaaattaagaaaatatagacaagtaattttaaaaagttttgtttttctggtcttcccgagcagcagtgttctgtgttctggagctttccctgggcacatttgtctccgtgtttgcgacattcctcacgaagctgggactgcacacagggagctggttccgtttctcgccccacctgacactatcgcgagcctttccccatttcccagaattgacagcatgatgcagagcagagctaatagcaaagcagtgctccaccccacgcaccagccctcactaaggctgacccccagagcgagctcctggggtgttgctgacgaaggcatgtccctgcccattgttgtccatgaaccaaacacacaagggacagcaggtctacatgccgacacctcagcatcccgcctcctaacacatgcatgtccccggtgcacagggaaggctgccccagcaggagcccctatcaggcctgtcttctggacaaccccactgctgccatgccacaggcaggtgccccctcctggggtggaactcagctgcgcaaagcctgtctcggacgcggtaacctcccgtgtcacccttaggagatggaactcaagcattaactcaccagacaccagtgagaccagctacactccagcgggagcaagtccgaagacaacaggccaggagctctgcttaggagccacctagggcgtaaacccacgccaccccctgcccgcgcctcctctgtcctgcgaatgacactctggggcgccgtccagcaggtggctgcctctcaaccacctgtgcagtgagcacgagtgtgtgtggcggaagcggcccaggccccacgctccgcctacagcccatccggcacccacctcacagacgtgctctcatatgggacaggcaccagagtggcagtatgtccccagccggctcccggctgcctcacccatggcagcagcccacgcaagagccacctccattcaccgcttttcctcactggtcacaatcgcctgtcccaagttctggggctgcagccttcaacgttcgtcatcgctctccctgcacctacagctacagcccacacccacgccaccatcatctcttccccagacagccgcacaaacccgcacacagcgcgcctcctcccaccgcctggcgggtcctcttccagcaccttcctgtggtgggcgggtctggcccacacgccacctccccaaggctccttccccttcagagctctgccacgctcagagcacaccatgcttgggtctgggttctttttgtttcacatcctaccaggacacagccactcccttgggggcggagatggggttttgtttgttctgaaacggagtctcgcactgtctcctgggctggagtgcaacggcgcaatctaggctcactgcaacctccgcctcccgggttcaagcgattctcctgcctcaacctccctcgtagctgggattacaggtgccccctcccacaaccggctaaatttttgtatttttagtagagatggggtttcactgtgttagccaggctggtctccctttcctgaccttgtgatccgcctgcctcggcctcccaaagtgcggggttacaggtgtgagccaccgcgcctggccagggatggggttttgtttggctcagtctgcactgcctggcactcaggggcagcgccaaggagagagggcagcagggcatgagcatcatgtgcagagtggccaccaaacacggaataaggcctggcaaccctgtgcctcctcgactcactttttacatcagcgggttgtgtcctgactgccccatgtcccattttctgtcttcctctcttccctctccgagtctaagtggacccccagctccccagagcatccactgtgcagagagtgcagagcccacactgctgcccaccaacgccctgtgctgcaggtggtgtcgacgtgcatgtgtgaacggagacaccaccacaggaaggacctaacagtcgacacgcgcctcccagcctgccaccctgcagctccagcgggacacgtgggcaatggagctcagagaagggtctgtacctcagtggtttcactggctgcagtgctctcttcctttttcctctcctcttcttcttgttctagttccttaatgctctcttctaacacattgggccagaaatcaccttcaaaatagggcagttccttggcactggtgagcctgtcttcagttgcttgtttgaaaatatcctgagtgggcaaagcacaacagtgagatgagggccatgcacgcgtgccccccaccatggtgcgacagacccccacgcaagcgtgcccctcaccatggtgtggcagagtcccatgcatgtgtgcccccccaccacagtgcagcagacccccacacatgtgcaccccccaccacagtgctggagcccctatgtgtgcaacagtgatgcacaggccccaatgcccactgatggaaacagctccaactgtgctgctctcagacggccaggggaaagcctcaatcagctgaagaaaatgcttctaagttctcactttaggcttttatttttctgctttctaatcctcataagtgaaggtaattaacaagtatgcgaatgcaagaaaaaggcacacaaatatcctcccctcagttgtgacaaaagccaccaccttccttcagcgccgggtaccttgtagtcatggatgatccgctctgcaaacgccttgtccagcatctttttgtaccactcctgcagtcgttttggcttgggtattttttgatcaggtgggtggcaatggaagatgtaatcatctccttcacttggaggacaggcccagatgtgccctgtcacatacctgcaggacccacgcacacacgtcagatgaacgtgccagtgaaatcggccctgcctttaaggagttatagcagaggagcaaggactaaagccaggacagaagtaaccagagagagagaatgaatgcccacaaagctgggtgtggtgggggcaaggctcgaactttatcctgagcaaatgcaagcctgcaaattagccctgcaacacttctcccttggggtgcacacacagggcagggccgaggctgcaaaagaaacctgaggcctcattaaagaaccagggaatatgatggctcatcaaggcaatgccatccccttcctcctgtgcactgtaaaggcagttcggttgactatttttctccaagggtcaatgtcaacataaacctcattcattctgttcaagacactttgatcaaatgcccctatccttttcaagtttcagaagggaatggggcaggtctagagtacagaaaccaagggctagagaaggaagccagacccaagacagcatacgctgcagggttccgtttacacaaaggattcacaaaagacaaattcagagagacaaagtagattagtggtcgcctggggcagggaaggtttaacagcaaggggcaggaggaacattttttttcttttttctttttttttttttgcgggcggggggcagagtttcattgttgttgcccagggtggagtgcaatggcatgatctcgactcagcgcatcctctgtctccctggttcgagtggctctcctgcccccacctcctgaggagctgggattacgctaggcacccgccaccacgcctggctcattttttgtatttttagtacagacagggtttcaccatgttggtcaggctggtcttgaactcctgatctcaggtgatccacctgccttggcctcccaaagtactaggattacagactaggtgagccaatttttttttgtatttttctttttttcttttctttcttttttctttttttgagatggagtcttgctctgtcgcccaggctggagtgcagtggcacaatctcagctcactgcaaccccccgcctcctggattcaaggaattctcctgcctcagcctcttgagtagctgggattacaggctcatgctactatgcccggctaacttttgtatttttagtagagacagggtttcaccatgttggtcaggctggtctcaaactcctgaccttgtgatccgcccgcctcggcctcccaaagtgctgagattacaggtgtgagccaccgcgcccggccttttttttaatttttagtagagatggggtttcaccatgttggtcaggctggtcttgaactcctgacttcaggtgatccaccgcagcaggagggatcttataggtcaataacaatgttctgaaactgacttgtgatagttgcactaatgggtaaagttactaaaaaccactgaatcatatatccaaaaaaggggaattctatgatatgtaaactttgcctcaataaagttaaaaaaaaaaaaaaagggaatgaaaaggaagtaaaggtagggaaagagcttgctacgtgcccaggagccagacctgtgaggctcggggagcacctggaaagaggagctttggagattctgaattgatcttaggatggaaaaataaaaacgcataaaacttaaaatacccattatttcacggaataaacatacagtaaaaaataaagggttcttactagttccaaataatttaatccaaactcaccctaatttcttcacatactctaaatatccaataaggatctcatggtaaacggctgtgcggaggcaacgtggccggaagaaatgaatactatccagataagaaatgtacacacgcctgtgggaaggaggcacatgtttaactcagggtatccctcaaatctgaaatcaaacacaagcaacaaacaacaccctggaagtttactttttagacagggtcttgctctgtcattcaggctgcaatgcggtgacgcggtcacagctcactgcaacctcaacctcatgggctcaagcaatcctcctgcctcagactcccacatagttaggatgacaaggcatgtaccatcatgcccagataatttattttttgtagagctagggtctcactttgttgttcagacttgtctcagactcctgtggtccagttatcctcccacctcggcctcccacagtgctgtgattggccagtttttcttttgatggtatttacactggccaccaaacaggatgtgataaacaaacaaacaaaccaaaacccaaaaaccaaccagtcaccaaccctgctgccaatcagttaaatggaattcagttttcgtcactgaacaaaaggatgaatggcaccactcggcacagagagccacagttaaggcaaactgagaaaagccacttttagttccttcttgcccagattcctgactgcacatgaagccctcgtggcagagctacttcctctgttcaggtgccaggctgtcccatcccaactccccaggtttacctgcgttaggtaagagcgggtcccacacagactcgccacacaaaacacgctcactgcagtcatctcaacagttcatttcccgctagtttaatggaaaacaaaactaactactttggttagttaattgtggtttcatttactttaatcccctatgaaggctcacaggctcctctgggacacttaagagccctggtctatcctaacacggctcactgaatgacacgccctggaaggagctggaaaactacctcgtgtttggaggggggcaatcagagccgtattcttggacgtgcattccaaaaaagcagacatccacgccgtcaatttcctcaaaagcaaacagagctttggttcgatatgggaaagattcagacatttccccagaatccacaaacctgaaacaaaagccagagccggacatttacaaaggctgttgctgacaaggtgcttctgcacaccaggcctgctcctctaactctggccactgcagatgagcggaggcatggccacctcctcagaccgtggcctggagtcctccctatgggccagtcagccccggagcagggagcacttgctttctgaccagtttccctcactagggaactgcacctctgtgaatgaaatacgggattctgaggaggactggctatacagcagtcccccttatccacggggtgtatgttccaagaccagcagtggatgctggaaaccatggacagtatcaacctctatgcgttttttcttatacacctgtactggtcacaaaattttaatttataaattaggcacagcaagagattaacaagaataagtaataataaaataagaaaattataaacagtatactataatatggtatgtggtctctctctcaaaatagcttactgcactgtatagggtaactaaaaccccagacaggacaaccgcagctgagggggctactgcacgcattcgctgctgcaaagtcttggaaggatgacctcaaactcaagagctttgcagagagcaggctctggcaagcgggcgtggggactgctcgcagagcactgtagagagcaggcacactgaccgtgacttcatcccgggcttgacctccaccgtcttgtctgagctggccaccactcggacaaaaacctccccggcttcagggtgattctggcgccgcaaaaatttgttcactcggtcttccaagtggtttcccagtcttgtggtctgcagccctaggaagtccagaaggagcaggtgagagggcttcaacagcactgctgagacagtgactgagactagagaatccaccccactttgcagcacaggctgatattttaaaggactaatgttctccaaacacggaagaaatctaatctgtcctgtgacacgagtgttatataaaggaaaggtggactctgggatctcaggcactccactcctgaaaaccgtttacgtgcccaggtaacctgcatctttttctaacagtatggggcagaagacctatagcggtgggtccaaaattgacaggggctctagggcggagcagatggatgtttccctgttgcttcccgctttccctggagggcagagatggcacaccctcagtgggctcctcctgcccagctctgaggagaaagtccctactatggagtctgacgtgaacgtggaacgttctagggctaaccaattaagctctggccagagcctgtccggtgcctcaggagctggcaaagtattggtgtccaagcctgccctgagccatcgcctcgtgcggtgcacgaatgaagtttccgagccttggcgagggcagcctttcctgggctcacctccccgccgccacccctcctcacccagggccagccccgggagggctaccgtcacaggagctagccagaggcaggacattacttcaggacagagaacgcctcatatacaggttaaaaaactataagggaaagttgcaaaaggttcttagtgattacgtatagacaatgagattttaaaagatgttttcttctttgctggcttttaaatatttcctacattagtgagaaataggaaaattgggaattttcgaagattccttagcgagctagaaaatttagaccaaacttctaaatttcatttttctgcaataaacaaaccagtggtgctgatttttggataagttgtacctgaataaaaatgatttaaaaagaaaaatgtggccgggcacaatggctcatgcctgtaatcccagcactttgggaggccgaggcaggtggatcacctgaggtcaggagttcaagaccagcctgaccaaaacggagaaaccccatctctactaaaaatacaaaattaagctgagcgcagtgactcacacctgtaatcccagctctttgggaggctgaggcgagtggatcacctgaggtcaggagttcgagaccagcctggccaacatggtgaaacccccgtctccactaagaatgcaaaattaagtcgggagcgatggctcatgcctgtaattccagcattttgggaggccgaggcaggcggatcacgaggtcaggcgatcgggaccatcctggctaacacggtgaaaccccatctctactaaaaaacagaaaaaattaggactacaggcatggtggcgggcgcctgtagtcccagctactcgggaggctgaggcaggcgaatggcgtgaacccgggaggcaagagcttgcagtgagccgacatcacgtgactgcactccagtgtgggcgacagagcgagactctgtctgcacaaacaaaacaaaacaaaaaaaaaacaaaaaaaccccccaaaaaaacaaacaaaaaaaactcttccagagtaacttcgctatttgacacctgtgatccacacatggctgcatactccagaggtggtctcagacagcacaggggtctaggcgcaggccgtgctcactgcggtgcactctgcgcaaccttcctcacagtgctgcctccttttctgttatcactcgatttggccactgttcctactttttcatcactccttgccattgctgcagttatgtccttgtatgtgccgttatgcatatgtgcaaatatttttataggatacatgtgtgaaagtagacttgctaaatctaaaaatgaacactttaaattgtgcccctcgctttctggcattcaacttgtatcttcatccatggcgcatgacaggggccttttgtgccttttcctttctcatctctgggctgtatctttttaaggaaggcttttcataactcaacacaataaaattattatcttacttttatcctgaatgcatctgcagttttgtttacttttctcgctttttaatctacctgaatttggttttgcatatggtgtatgcgaaggagatggttttcaatgcaagattaaggaagcatacctttactctgtgatcagacaccacaacgcctgtgctgacacacgctcacactgagagtagagctacctctagtctcctaggcccttttctccagtaatgttccatttctagatcttgggctcatctaccgaatgcccacgggtctttctggatgctgcggtgggagggggctggacctgctctggggccacttgtgccattccgcccagtcacctcctgcccctttcaggcaatgactgttctacggaggcctagttctctgggtaattctgttttggctactgagcctctggcccagggaagaacttccaatttgctcaaatgcattagcgaactcactcagagtgaatcctctgaagcagggcctctcaaatggaggcaactgtgcccctccaggggacatctggcaatgtctggagacatttctgacagacgtaatgaattgctgaggaaggtgttactggcactgagtgggcagaggccaggcatgctgctaaaatcctgtaatgcgcaggacagcccctaaaacagagggttacctggcctgaaatgtcaacagtgcctcagttgagaaaccgagctaaggaaaagtattacaatagtttatcaatgagtgatatttcacaagtttttaacagaggcagtgtaagctattgcataactttggatgttggttaacaacagagtttgaacttgaattaagactcagtctcaagtctacagggtggcttcctcctccccttcccccagtgcatggtccatcctagcatttccatctctcttctactctgagctccccaaatgaccctggttctattggggatctcctgagcaacatgctagtcacctgtcctgccagagaaaggtgacagctgtagggagcagctggcaagtcaatgttagaacactgctgcagttgccgttcttgtgtgggtttgctggttaactcggcaaaaggccagcctggcgcgtcaagctgcagaaggccatcccaagacttgagaattgactctataaagattaaataaccataaacttttgataacaatgcaatgtggtcttaaaaaaaaaagtcagccgggcgcggtggctaatggctgtaatcccagcactttgggaggccgaggcgggcggatcacaaggtcaagagattgagaccgtcctggccaacatggtgaaacccgtctctactaaaaatacaaaaattagctgggcaaggtggcgggcgcctgtagtcccagctactcgggaggctgaggcaggagaatcgcttgaacccaggaggtggaggttgcagtgagctgagattgcaccactgcactccagcctggcgacagagcgagaatgtctcaaattaaaaaaaaaagaaagtctactcatgcaaagttacttctagcagtaacaggttgttccttctatttctgcacaggcaccaccagctgcagtaacatgtccagccaagtccacatgcaggccaggctcctaccgctcctggggtggtggctggttcccagaggccatggctcataccccactgtagcagaagccagcacccacgggacagacccacggcagcccacatagggcccagggttagagagtgctggccaacattacaccacacatgcacgcacgaggggtgaggggtcttaggtctaaaccacttgagaataatctgttgataaattttctcagaatttacaaagtttactgcacatctaacctttcatctaaaacatgcgctgatcataaatgctgactttcatataacaatcaggccaaatattccctttaagggtggactgagatgttttacacttgatgaagatccacagcccaaggctgcgagtcctgctctgagctctgtgctcagcagccccgtggctgagatgaccattctgagaagcacagacttcagggactcacagctgtgctgcctattctcagtgaagcccctgaagaacattcttgcattcttaccctcatgactggcctggctctccttaaggatgagacaagaaaaatacaaagtactggggaaaaaactaacgaaaatctttgacaaccgaacctcagaaccatgtgttgagaggaaccaaagaacaatggggacaatttctacaagtttctaaaatgtgcagtccaggaaacagaaagcttcccgaaacttactcttagcactgaatttgttttcttttcgaggtctgccagttttcttcaagcagttgtcgcacacaaaactgcaaaataatagtggtatgatgagactgtatataatgatgtaaattgtcaaaccaacaaaatgcagcattcagatagtttgttggcagtttaaatcacattattataaaattaaagagtgaagaggcagactgctttgattccacaattcctaaagcggacaaacgcttagaacttaaatttagaaccaactgccatctctcttaatcgctgaattcttgctgacaacaatgaatgagatgcagtagccactgcaactgccccgccactggctctgtgcagaactgccctccaggccaggggaaacaactcaccctgaaggccaaatgatgtcatagtgcagaacgcaaatctgatgcatcttccggccacactccttgcaatcaacgaaactaggaggcaaagaaggcgcactgttaaagcacacggaaccacaagaccagagtcacttgtagaagtctgtgtgtgcgtccacaccttgttctctgggttactttgagtagtgctgacattaatgcgtgtgttggctgattcagctatattttacaatgcatccgtatgatatcttctacaggaaaaagctttcttcttttgtttgtacaagcgcttcattcctcttttctcccaatctccctttgcaaccagaaaggaaactttactttttaaaaattgctgcgacaaatacatatttcacaggccggtatttctgacactgctacacatttgcaagaacaatgccttctctaggtgatttcacatgccaaaactgacttaaaaaatagagaacaatactttgagttctaaacatgtgctcttaagtctaaaattgttgaggatactaatgggaaacacggccagttcagagcagccacgctaggcgcgaggcacaaaaacaccagttctgagtcagttacaaaaggtggaatgtgtcaggcctactggcaagttgacaagggtttattcaagtaaacactggtgaagcgagagaatggaccacccattccccacgaatcctccacactgttctacggcagcccacaaccacggcccaccagggctccgtcacctccaggaaccgcctcaacccaggaatcttaaatgccaagatgacattttgaggtcaagaccttgggtttttgtcagctccctcccttgctgccaccacaatgcatacctccgaggataggctgaagggactggtgagtaatgtgattccctgtgtgctcctgagctttgagctacagctcctctaaagtgtgcccctgccctcgtccccttaatctgtccattgcacgtgctatgcaagccctcagccatgggtctaccctcatctggcttctctgcccagtctgctggagggaaagaaaagacacacacacagatctgtgaaaaaaaaaacacacacacacaaatggcggcacccgttcatggtcctatggcactctctgacagcccggctctgtctggctacctctcccttccacgtggcagctgctctgaatctgcactcctttcctccagtgcttatcctccacaagctctgtctttgacaactcagccactgagctcatccccaacgctaagaatttcaaaggttggggccaagaacttcctcaattcctgtgccgtctccaaaggtcccctgctctcaactcttccctcccatgtcaggggaaaggagtgtcccccaaaactacactggggacaggtgcagtggctcacacctgtaatcctagcatgtggagaggctggggtggaaggattgctttactgggagtttgagaccagcctgggtaaaatagggagaccccatttctacaaaaaatttaaaaattagctgggcatggtggtgtgtgcctgtagtcccagttacttagaaggctgagctgggaggactgcttgggtctgggaggttgtggctgcagtgagctatgactgcaccactgcactccagcctgggtgacacagcaagaccctgtttcaaaaacaacaaacaaaatccaaacaaacaaaacacactgcatattctagaccccatgacatccattttgaatttccccctttctcccactcccaattattatgggccaactagatgtctccccttccctcagtcccccagcaagcccccctgcctggctccaaaagctcttgctttaattggtgtttcagtttcttgccttctcctgctttgtgtctcttaactaacttctctactacagaacaatgtcttctcctcttctgttcagttcacctcatagaccaaagatgaccctcttacactagaaccagtgctattcttcaaaacctcctcagcacattataggataaagtctaaacgtcaagagacagtgtaatggcccttcatgaagttaacctctgcctaccaaccacccactctaggggccttgtagttttattgagcaacctgtgttctttcatgcctttgtttctagaatgctctgcagcttcaatgtaaatgtcatcttgtccaggaaaccaggcgcaactgtggtgatgccgctctgcccaagcagggtcccttctgtctgggactcacttgtactgtctcctgctgcaggctgtgccattacccagctgtctctctagactacaaccagcaggaaggagaccccttcactcatccatgtgttccctctgcctggcacctactacttgaatgtaatatattttgaagttgaaaagtagatataaattggccgggcacggtggctcacgcctgtaatcccagcactttgggaggccgaggtgggtggatcacgaggtcaggagttcaagaccagcctggtcaagatggtgaaacctcgtctctactaaaaatacaggctgggtgcggtggctcacacctgtaatcccagcaccttgagaggccgaggcgggtggaccacgaggtcaggagatcgagaccatcctggctaacatggtgaaaccccgtctctactaaaaatacaaaaaaattagccaggtgtggtggcacatgcctgtaatcccagctactcgggaggctgaggcaggagaatcgcttgaacccgggagacggaggttgcggtgagctgagattgtgccattgcactccagcctgggcaacaagagtgaaactccatctcaaaaataaaaataaatacatacatacatacatacataagttagctgggcgtggtggcgggcacctgtaatcccagccacttgggaggccaaggcagagaattgcttgaatctgggaggcggaggctgcagtgagccgagatcgcgccactgcactccagcctgggggacagagcaagacttgtctcagggggaaaaaaaaaaaggaaagaaaagtagatataaataataatgaaactataaagccaaggagagaaagacacaatgtgaaaagaaaggtggaaagtcaggaaaaacaatccgatggtcatgagaggggtgggcgctctgccctggcatctcgccaagactacagctctaggatttcacatcatcgtcctgtctgtgtaccatgtgctggtagagatgaagtaacctgccaaaagtcaagctaggtttccagaggtggcctgggtagaaatctgtgcttgccactctagccactggcttccctggagagggtcaggatagggagagcagggtctgtttcttgccttggctgagtcacagcccacacttcccaagtagccaacgctcctggagcctgtgctcaccctggggacaaaaaatagccagtatcgccatgccaatttggagcgccctcagaactttacattggggacctgggaagaggctaccacactgaaaaaaatctgaagtctctttaggggctgttatgaagcaaggttagcaaatgcagcactctcactcatcactgtagaaaagtgcttaacagggccgggcgcggtggctcacgcctggaatcccagcactttgggaggccgagacaggcacatcacctgaggtcaggagatcgagaccatcctggctaacacagtgaaaccccgtctctactaaaaatacaaaaaattagccaggcgtggtggtgggcgcctgtagtcccagctactcgggaggctgaggcaggagaatggcgtgaacccgggaggcggagcctgcagtgagccgagatcgtgccactgcactccagcctcggggacagagcgagactgtctcaaaaaacaaaacaaaacaaaaacaacaacaaaaaaagtgcttaacaatggcaagaaaatgtgccaagctttacattatttgagaaagcagtttccaagaggttttctttctggtatttccctttaaacgatactactagtactaccccaccaaatactcctaacctttggtctctaaagattcatgctaaatggcttcttaaagacacccatgaccaaattattagagaggttctcatagaactaaaacatccatttaatcttatcattgttaaaatccagtaactagagtacatgttacagagacatacatattttgtttaagtttaaaagaaatctatatctaaaagataacctcacaccagaaattccacttacggcaacatatttccaatgtttttacccacaacccactccataaggagtaactttaccgatttcaaaccaaaactgaaagtaaaaaagaaatagctatatacttacggttcggggtctaaggtatcatttttcttcttttcaaactgatcctttgaaattgtccttgttttaaaataagaaaacatgttttattaactaaaatttatctgttgagtataaactatagggtctctggaatgttattttgtaactagttcttcaaacaaaaagacatgatggccccttaaaatctcaagtacatgtaataacggaatgaacagaaaatttaatttcgtagaacactacaatgtctttttctacatattccactatcatttcttttccttctgttttttcagagacaaggtcttgctctgttgcccaggctggagtgcagtggcgtgaccatggctcactgcagccttaacctcctaggctcaagtgatcctcctgggtagctgggactataggcatgcaccaccaggactggctaattttttgattttttgtggagatgagggtctcattatgttgccaaggctgaactcaaactcaccccggttctgagtagctgggactacaggtacaaaccaccacgccctgttaagtttttttaattttttgtagagatggggtctcactatgttgctcaggcaacaatccaattattaatcacacaactagactaaagagaattaggatgacaagggaaataaattgaaaatgtagaatttcagtcactttggtttgtttgtcttacaagttaggttttttctgcatttgaacaaagaaaatggtagagcgtaagtgcctacactgctggaagaagctcctgtggcaaacccttcctttctgttggggaagtcacactgtggtagggtggtaggaatcatggaagactggggaactcagtctgacgaaaagagggaacggcagacctgggcagatgtggtgggtggctggcaggtttttagttacttaagtatagaaatgagttgataacacaatttgtgcatttgctttttcttgccacacagtggccattctaacactcgaaggtaactctgccggataataaacactggaaatacaagtttaaccctgtgcaggagtgaactaacaaagtcatagctgtccactttggagctggtaaacaacaggtaaagcactagtgaaggaaggaaacacatttagactttaggccaaaaaatggggttggagaacactggaatccattaatctggattagacttcagtaactgaaaggatggaggtttaagtggagataaactaaatgtaaagggcagggcatgtacaccaaactcattttttgctactgccagttctgcaaatggggatacctggtttctcaggtataactgaaaatttacatggtcgggcatggtggccccagcactttggaaggccaaggcaggaggactgcttgaggcaagagttcaagaccagcctgggtaacaacagtgagaccccatttcaaaaaaaaaattaaaataaagaaaatttctaattccccaaaatggaaccactaggaaaaagcaattattttagaaaaaaagacagaccaaggtcaagagagaccagtggtctccagtggtaggccacagtaccaccgccttgaatgataaaggcagaggtggcgctgtggttcagccaaaacacatttttcagtgtaaatgtatacgtatacacatattcaaattaaatgtgatcatagttaatatgaaacaaaccccacaacacaacagactgtaatcccagcactttggaaggcccaggcaggtggattgtgcttcagtctaggagtttgagactagcctgggcaacatggcgagacctcgtctctacaaaaaatacaaaaaaattagctgggtatggtggcgtgcacctgtaatcccagctacttgagaggctgagaaaggaggatcgcttgaacccaagtggtcaaggctgcagtgagtcgagatagtgccactgcacaccacccaggtgacagaatgagaacctgtctcaaaaacaaaaaaccaaaaaacattgcaaggaagtcaaaatggcaccggtaccttccttatagtcattggtaagaggaaaaaacaatttaaggtcaccctccctcaccccagagaaaatgacaggacggtacttacgtctggggctgtgaagggtcgtcacccagggtcacattctcgccctggatctctgtgaaacacttctcacagaaatgatacctgtcagcaagaaggccatacttgggtgaactggtccatcataacacacagccacccaagcaacgaagccaccaatcagagcagggcagagcaccacgacgaagggggggcgttgttggttgattgatgggtcagtgaggacaatgaaaggaacagggggcaggtggggaaaggcaggattagagaacagggaagggaacaaatagcacagacacagaggtaagacgcagacaccaagacaacacagagcagaaagccaaggcaaagcattgattagcattcggtctcattgcacacatcacaggccatcatcactaacaacgacaggctcggtccggctccaagaggcaaatgttttcaaggagttgttaatactagaattgcatggagcccaaatttaggaatctgaattttgttcttactcagagaaagtcaaatataactccagggtttgagatggaaaaatttacttgaacaaaacagtctgacaaaaggccttaaaaaagcaatttaaactgaaatagctttatttttcaaaatggaaaatttatgcttgacagcaattcagagattttatttccggtattaagccagatctttaaatgtatgaaaatgctgagcacccagaactgattttaattttttcctgtttttttttttttcatgttaatcattcagttaattgtgttacaatacaaatgaaaccaaatccatattctagacaaacatttaacataaatgcagtcagggtcaaagactttccacccatttatcaatatgaatatacagagtaagaaatgtgatatattgtataagaaatacaatatatgtaaatccatgaacaatctttgaaaattcaattctaagctttgatttgacatttttggtactgggaccaatcattcatcaatctgaaagacttagcgaatgactgttctgacttgggggcaatccaagttaagtgaatttagagttaatctttaaagaacaatctgcatttgagaaattatccatcaccccaatttcttgtaagacaatatagagcctgggctcaagctatcaaatacaaacaattaaaataaaaactactaaatgtttggaaaggacataaatgagaaatcaacagaaatgcaggctgatgctgcataaaacaagatgagtacacaagaataccgtaagaataaacaagcgggtggaggtggatcacacaagcgagaagaatgagtgtcaggtagcgacggcagcacgaatgcggtttagtgctcaaaactatgtctacaagatgccaggaaggattagtattaaaaacagtgcgacaggactcgagcgccaggctgaaccaccaagtgcagaatgggacgcggcagctgcagtctcactcacttgcgcactcacacggctacagaagactgaggcgtgggccaccgtgtggccagttcactaccactaggacaggtcccccacaagtcccaaatctaatcttaattcaatacattgagcattttgtctgttgtatttcactaaccacacacatacagcaaattttaaagcatacaacttcagtgcatgcacatctcaagatgagccaattttttgtgtttggttgatgaggaacatgacagattcactagattaatgaaggtttcttgctgggactaatttatttggcactaactcaattaataaattatgtcaggatttaacactctgacaggcaagaggcagattaatgtttttctttaaatatgtattttttttttccctgaatgaactatagcaatattctggccattcactattttgtaaatatcctaaaatccggtatgaagaagaacttccgtgtgcaggagggtatggtcatcactggcaagaaggaattaaagtacagaaactataaaccaattcagtggcaaccaaaacaatacacaaaaaagacattccctcaatccccaatacttcccttttataagtaaaactcctaattgagtgccccattcatgatacaatcaaacacgcagaactatggccaactagaagggaccgttcaagacattctgaaatgaaactcccaccgtaatcacaggtgagtctaaatggttttaaaatcctggagaaatcctttgcttttatttaaggacagcaagcccagcaacatccaggaaacaagaaccataaacccatccttccccaccgaggaaagtgacactgagggaggcactggtggtggaatggcagcccatgcagtggctgggaaactgaggctcttcctgtatgactgactcccaccctggaaaatcccaggatcagaaccggggaggcaaagcattatcaacagactccttgtctgcctcaaaactgctggagaaatggacaatttagcctgttcgtgtttaagaaggggaggaagaggggcccgtggcttcactttattactgttctgagagaggaagacagcacacagaaaagggaacagtcacccccaactagtaaaatcagctaaagcaaccctggcagtctatgagtgatagatgttattgccagactgcccctaccttcttacctagtccacactttattctccctggaaacacataaagatttagaaattcacttttcaacttaagcgcctagatgacattttgcctggtgtgaaggaagcagcttgatgaatatggaattgcaaaggagaaatacttcacataatccagtgatgatgcatttcagggttgctatagtaccatggaactgcatagtttatctgtaagggtaatttaatatatggactaagttttcaaatgcagattgttttaagtaccatatcagtacatatcactgggatatctatagataatacttatattatctacagatactaactgggaaagctaaagaacagtttttccaacatgagttactttcaaatttgcaaagtatgaaaacaagtgaaaatgtaatcatacgctcacttatatattagggtttcacttgtttaaatgatctgtaggattttttattgttctaagtgcccagtttaggactacaagtgccaagacaattattcataagaacactgcagtgttcataaatagtcaaagttgaaaataaaaacataagcagttaaagtatttgttacagaatcaggccactgctttctcaggatgataatatgctaacctactcagtcagatacactgttctagagagcatgcctgtgatcgtctgaggaacgctacgcctacgctttaaaaattatcactaataaaatggaactcctttatttgcatttccactcttaaaaatacattacttttgtttagtaaaaatgaagttctatacagaaataaaattagacgtttcagaactttcatgccatcaatgactttatatgccatcaatgacttcatatgccatcaatgactctttggtcctaccaattccatttaactttaattgctctcaatgtaaaagaccaaaatctgtgcaaatcagcaaaggcagggtaccaacggacccaggaacaggccccacaacactttagagacagtggtaaacaatctaccttccttctagaccaaaactgtgttgggcaacgtagcaggggtggcatttttctgggtgtagttaatattaacctttctctgaagatatcattaactttattttgcttggcacaaatggtttttaaagtgcattcctattcattatttcatcattgaggacctgacaaaatgaggctgcgagggaagacgctattgtctgtatcacagacaaggctaagcttaatacattaatacatcatggggtctgctgaaggtcatggggctaaaagcataaaaggagtggccagaacttcccaaagagcagcaagtcactatgggagagatcccattaggaaggggctatggtatcattttaaacttggtcataaaatgtttctattgataaaggggaagttgagatggaaatcagactctgaatgttaaactattttcagcaggacaattgcacacgctgcacttctagcagggatgcagtttagggtctgtccttcccccttgcaccagtgtttcactacactgaacagtattaggaataagcaggccaggcttattcctaatagaaaaggcttaggaaccttttttgagacatttttgtgtcaaaaggattttttttaaaaataggattttgatgggagttattacttatcttgaatatggatttttaaaaaaaacatagaagaattaaaacacataaccataaaactccaaaattttcaggcctgtgaacaaataacaaaaagccttctgtcttctttgaagtataggacataattactctgaccaaatgagagtaaaataataaaaaacgccaaaccccactgttgacgcttattatttgaacctaaagacaaagaacaggcacaaacctctatcttggccacagagaatccagctgctggctcataaaatagaggcaacgtcacagtttgagcaagattcctgacctgtgcctccacgcatggtgcgctcacactgcagcggcacatggacacttacacgctgcggtacagataagctgacttctcaaacaactccaaaactacgcaagctgtattttgtgggaaaccacaacaaaaaatactattctcactctctacctattttaagacaggagatctattctttagccatcttcatattccaaaagaatggcaagtatttcttaagcagatccaccactcacaaaaccctgaaatggccatcttataataggaggcaacagaatcacattcttgaactcaattaaaacaccagatctcattttgtatcgtgctgctagtgtaaaatttaaaaataaagatcatggacccttttcctctgccttataggaagcagcactcatgcaagtctttccatgagactgatcaggccaaattaccaggcaaatatttgcaggtagaatagtaaaatccacattttctactctatgaacatcttgaaaaaggcatgtcaacctttatcagagttactctcaacttcagacgcttgcttctagggctgcgttttagaacgggcagggctgaagaaataacgtacctaatccaagtagtacggcaagacttggctctgaggttacagtttttacactgtaaaagtacgctttataactaactaagaggccatgggcctaagtgactaacaagacactgaaaccgagccactttttctctttttttttcttttcaaatagagatgggggtttctctatgtcgccaaggctgataacataactcctgggctcaagtgattctcccacctcagcctcccaaagtgctgggattacaggcgtgagccaccacacccggcctgaaattgggccactttttattggaacttcaggaaagaaataatgtacacagactataaccagatgaacgtgccttgccctaagacataatgcaggatgctgcttgacgcttacctattctgatagctgtagtaggcagcatcgcgaggaatggtacacagctgcttcccatagcagcacaaagtctgtggggaaaactcatactgcaaaaataaaggagaaatacttttatataaaaatacattccatttactgtcttataatgttctagtctactatagagactagtaaattatttctgttagtatattagacagttttctaacaattttagtagctttaaagacattttgggatagcatgtgatagaactggctctaagagacattcactacagacaggtaccacaggcagagaggggcagccagaaacgcttccccatggcctccctcagtaagcgcctgtacacccagctctgatcacccatcacatcgcttcaggcatcaactgtgtcaccagacagcagattgcacatatgcactcccagtatacaggcgtggtctcatattagtataacacccctctggctggattaaccaggaaaattcactttccggaaaaacttaaaactgtaccttgcgtccacagcaatatccaagggactgcatgacagggtcaatttcctgctcaaagacctctgcaagcttactgcaaaacttatagactcgggatgtcttgcgattatagagccaggcattgttgaacatgagccagacgtcgtccacgtactgccagggctcttggtattgccctgtgtccagcttccgcttgatggtggagaggtccatgggattctttacgatgtcaaaatagtccttaaaaaaaaaaaaatggtctcagtatagggaatcccccaatatccaaatgccagtctcatctggcagctttgttttaaaataatagaaacagaaagcaccaaaataacttccattcccaacagtaagaaataggaaatgaaaagaaaataacctctgacgcaactgattttactcactaaaagtgtaattagtattttcaggtatgatcacattataatactccaaaggcaaaagtaaagaaaaattgttaaaagatacttctaacaaaaaattttaaaaatagatctttaatccactgaattaaaatagtgaacaagtttatcaaacagtgtgtatttctagatattcactcttgatcctagcaagcaaaatgaaattacaagacaaatataaacacaaagctagtaatgactgctacatagaatcggctgggtccccatggcctttgcaaggctatccaggaatataaaagagagaagcccaaatatttttttacagttcatgttcacaaattctttcagacaaaagtgacacaaggccccaaatataaagtgaagtctcaggggcatgtgcttcccttgcttcagtgcacccctcctccaaggaccagggcttcatgaacaggtgaaatcaaacaaaataaacactttcactgataactgttaacagacaacagttttttatattaggagaacaatcttcaaggcagggggattattttatctaatttcaagagataaaacaatggacactcagaagtcacaccagcaaagttataatctatttttatgaattaacttactggaattccgaggagctggggatctacaggctgccggaaaggtaatgactctgggtcctgtcgatacagtgcttctagggttggcatgagggcctggcgtaactcctctggtttaaagactgcagagaaaacatcaagaaaagacactttgtaaaaggtgctcagatccctcctacctcacatttaaaacggaatcctggctgctgtgacatcccagccacgatgctcctaaggcactcgaggggctctcgtccatcaccgttaaggactaaagcttctgaaaacacactagtgtcagaactgtgttcagcttgtgaggcaaaatacaacactgggaagtttgcttcttccatgaaaggtttccaacattaaaaacttggctgaaaaagaaagtaaagctaactcccaaatctgtctcattcatcaaactgggtggcaaataaagccatttcaggctgggcatggtggctcacacatgtaatcccagcactttgggagactgaggagggcggatcacctgaggtcaggagttcaagaccagcctgaccaacgtagtgaaacctcgtctctactaaacacaaatttagcctggtgtgtgtcgggggttcctataagccccgctactcgagagggtgagaaaggaaaattgcttgaacccaggagacggaggttgcagtgagccgagattgcgccactgcactccagcctggacaacaagagcaaaactctgtctccaaaaaaaaaagaccatttcattggaagggaccttaaaagatcctctgagtaaagttttttatccttggctaaattaaattcaggccactggagacaaacggttttgaatctcataaatgtaaacagtaatagagctacaaaataaagcatttttataaaaagttccatattgcttactcccacatttactaatgccaatttctccaacccctcagacaccttactgcctactacactctctgttttcactaatacaaacataaaatactggctgccaaatacattcaagatggtacattcatacaaaccctcaacaagtatgggaacaggtgccagggaagctgttcggtgtgggaggccggccagtcagcagtcagcgtgtcacgaccccacctggctcatgttcactcacacagagaagaaactggaggcaaagatgtctcaggcattctgatgccttagcttataagtgatgtattttttcttggtgttctttaatttttaattaaattattatttttgagacaaggtcgcactctgttgcccaggttgggggacaatggcatcatctcagctcactgcagcttcaacctcccaggctcaagccatcctcctgcctcagcctcaggagtaactgggactacaggtgtgtgctaccatgcctgactcatttttaaattttttatggagatgaggtctcactatgttgtccaagctggtctcgaactcctgagctcaagcgctccccctgcctcagccttccaaagtgctgagattacgggcactaagctatcatgcccaggtttttttttttttttttttttttttttttgagacagagtcttgctctgtcacccaggctggagtgcagtggtacgatctcggctcacagcaacctcagcctcctgaattcaagtgattctcctgcctcagcctcccgagtagctgggattacaggtgcccaccaccacgcccagctgatttttgtaatttttagtagaagatgggtttcatcatgttggccaggttggtctcaaactcttgatctcaaatgatctacccgccctggccttccaaagtgctgggattacaggcatgagccactgtacccagccatcatgcccatctcattttatatttttagagacagagtcttgctccaacgcccaggctggagggcaatgtagtggcgccatcatagccactgtagctgcaaactcctgggctcaagtgatcttgtcatatcactatgttgcccaggctggtattgaactctcggcctcaagtgattctcctgcctcagcctctcaaagcaataacattataggtgtgagccactgggcctggtctgttttttgtatcttgaaaagatttgttttttttgagacggagtttcactcttgttgtctaggctggagtgcaatggcgtgatcttggctcactgcaatctccgcctcccgggttcaagcgattctcctgcctcagccttccgagtagttgggattacaggcatgcaccaccacacccagctaattttgtatttttagtagagactgggtttctccatgttggtcaggctggtctcgaactcctgacctcaggtgatgtgatctgcttgcctcagcctcccaaagtgctgggattacaggtgtgagccaccatgcccggctgaaaagatttcttacaacaggtaagtggtaaactgtaatttaaaaatcagattaaaatatggtaaacatttaaagttccagttgggaagcggcaagcatcaggtacatggacctgccatcaattctgtgtggggtggggatggtctaacttgacaaattctggaaagcgtcatctgattcctaactggtgaaagcaaaagttaaaagttggaaggaaaaacccatgtgtttaacaggctcactttagagatgaaaacaggcgcaccaagaacatgcctcagggctcatttccatcaaagcccaggatacagactcttgaccaacctccgcagacaccgcctcctctccagggcacgtggctgcttcagacctctgacagcagcctgaggtccgggcaaccaggtaaaaaccccgacgcagcactccccacgcacacggtccccagcacttgaaggtgcaaaggcctggtccagggtgcagacgtgcccttcacagtgggaagcgtcggaaacacacagccttgcttcctactaactcctttcttctgttttatgcacagacgaagcagcatttgctagtctttgaataactttttatgagaaaacaattatgtaacaaatagccttttgatttctctgaatgaggggttggcaaattatgaccaagaggccaaatgtggccagctgcttgcttttctgtatggcccaagagctaacaatggatttcacattgtttaatgtttggcagaagaaaaagaaaagaatactatttcatgacatgtgaaaatcacacaaaattcaagtgttagtctccaaaaatacagctttattggcacatagctgtgctcattcgtttatataggatctgtagctgcctccgtgccacagtggcagcactgaggagtggtaacagaggcctcaggacgcacaaagcccacagcgtggatcactgggcctctgcacggagaaggcctgcagaccctgtcaccgccccagtggtaatcgggagtgacagggcctgaaacaagtgtcactttggttgatcatttattcattcattaaataactattcaaattccgtgctgaggagagcattttctttccttttttttttttttttttttgagatggagtctcgcgctgtcacccaggctggagtgcagtggtgcaatctcggcccccaaagtgctgggattacaggcgtgagccacggtgcctggccgaggagagcattttcagactcctgtcttcaccagcacctttctgtaagaagatcccatatgtgcagaagtgaagtcaggagtgtatgtgaactgcgccgctcccctcctctggcccgaggacctgctccacgcggcagggctgttgcagcgcaccagcatctcccaaaaacgcggctctcgagcccttggaggctgctgtctcatatcgcagtccccagcccctgtgactactgaaattttaccaaacgaataatattacaaaaaataaaaaactcagttcctcggtcaccctggtcacatttttatttttttgagacggagtcttgctctgtcgcccaggctggagtgcagtggcgcgatctcggctcactgcaagctccgcctcccaggttcatgccattctcctgcctcagcctcccgagtcgctgggactacaggcgcctgtcaccatggccggctaattttttgtacttttagtagagacagggtttcactgtattagccaggatggtctcgatctcccgacctcgtgatccgcccgcctcggcctcccaaagtgctgtgattataggggtgagccaccacgcccggccaccctggtcacattttaggtgctcaagttatagcactgccctaggcccttctatgtgctgtaagatgaaaactatttcaccaaaactgaaaccaattttttttttttttttgagacgaggtcttctggagtgcagtagcgtaatcacagcccactgcatgcaaacttgacctcctaggctcaagcaaccctcctaattcagcctcatgagtagcatgagggactataagcatgcaccaccataaccagctattttcttatttttttctacagagacagggtctcaccatgttgcccaggctggtcttgaactctgggcctcaagtgatcttcccacctcagcctccaaaagtgctggagttgcaggtgtgaaccccaaagcccagcctgaaacaattttgttttgagacgaagtttctctcttgttgcccaggctggagtgcaatggcacgatctcagctcactgcaacctctgccgcctcctgggttcaagtgattcttctgcctcagcctcctgagtagttgggattacaggcatgcgccaccaggcccgactaatttttgtatttttagtagagacggggtttcgccatgttggccaggctggtctggaactcctgacctcaggtgatccacccgcctcagcttcccaaagtgttgggattacaggtgtgagccactgcgcccggcctgaaacaatttttataacactaaattatcatttgccttttgcactatgttggacatctgcacagatgggaaaaaagcaatcttttttttttttttttttgagaaggagtctcactctgttgcccaggctggagtgcagtggcataatctcggctcactgcagcctccacctcctgggttcaagtgattctcctgcctcagccttccgagtagctgggactacaggcgcatgctgccacacccagctaaaaagcaaaaacaaaggaaaagaaagccaacatcaccaaactctactgttatcacacacactgctgctgctgtacagtcacaagaaaaaaaataccagccatgcttaagaaaatttgtttaaaatttttcttcttttttttgggtagagatgggttcttgctatgttgcccaggctggcttgaactcctggcctcaagtattcctcctgccttagcctcccaaagtccttggattataggcatgagccactgctcccagccaagaaaaaatattctttatttttaagacagggtctcactctctcatccaggctagaacgcactggcacaatcatggttcactacagcctcaacctcctgggctcaagcaatcttcccacctcagcctcctgagccattgggactacaggtgcaccaccacacctggctaatttttaaactgttttgtagagacagggtctcactacgttgcccaggctggtcttgaacgcctggccataagtaatcctcctgtgttcgcctcccaaagtgctgggattataggtgggagccactgtgtccactcatttcttaattaattaatttatttttgagatagggccttgctctgttgtccaggctggagtccaacagtggcatcacagcttgctgcagccttggacccctgagctcaagtgatcctgctgcctcagcctcctgagtagccaggactacaggcatgcaccaccacacttggctgatttttaattttttgtagagacagggtcttactatgttgcccaggctagtcttgaactcctggcttcaagtgatcctcccactttggccttccaaagtgctgagattacagatgtgagccaccacacctggctgaaaaaatattcttgatgagatagtaaaaagtattccttgtattaaatcttaagcgtttggtacatgtgtgtggtttttttttttgttttgtttttgtttttgtttttgttttttgagacggcgtctcgctctgtctcccaggctggagtgcagtatctcggctcactacaagctctgcctcctgggttcacaccattctcctgcctcagcctcccgagcagctgggactacaggcgcccgccaccacgcccgcataattttttgtattttgtttagtagagacggggtttcaccgtattagccaggatggtcctgatctgctgacctcgtgatctgcctgccttggcctccgaaagtgcggggattacaggtgtgaggcaccgcgtctggccgcctggtacatgtcttttattctgtgtgatgaaacattctgcctatctcctcacacagaataaaagatgtgcgctgcataggcacagtggccacatcaggaggcagtacttgggcaagtgttggaatttacagctgaagtagctgcttgccctcgtggagcacattaaaactttcaggaatgactgagagataagctatagttactaagctctggttatatgtcagacattttctcagaaatgaacaaagagggccagttacttcaaggacaactgacagtatttgttgccaatgctaaaatttgggctttcataaaaaaatcaaatgctttggaaaacttgtacatgggcttcacagcttctcaaaatttattattagtattattttttgagacagggcctcactctgtcacttaggctggagtacagtgacatgatcaaggctcagtgcatctttgacctcccaggctcaggtgattctcccacctcaacctctcgagtagctgcagctacaggcatgcactaccatacccagctaatttttttttaatagagattaggtttcgccatgttgcctaggctgctctcgaactcctgagctccaggctagagtgcagtggtgcaatcatagaccctgaattcctgggctcaagcaatccttccccctcagcctcccaaaatgctgagattacgggtgtgagccaccatgcacgccctgcttttctaagttggtaagacttgtttgaagagactgatggtggtattaacaaatgttgatttttttttgacactgtatagtgaaatatgtcaacatatggaaaatctgcagaacttaagtgtcaattgaaaaaaaaatcatgcaagcacaaaagatccattccaagtacaagatggatcaatggattctaatgtcacagactatgaaaaatccagtgctatagattctggttcaatgtcgcaactaacctttaagaaaccttcactggctgaattttggtatagtatcaaagaatatccacaatcagctgaaagggctacgaaaatacttctccctttaccaactacaggattttcttcatacacttcaaccaaaataaccaatcacaacacagtaaatgcagaggcagatacccttaataacgccactattcttacttatttttgttttggaaaaattgtttttcatataaatgttttctatgggtgccatgtaacagactattttaaatgaactaaatatttaaaaatttttctctttttttttttcagacaacaatctcacttttgtctcccaggctagagtgcagtgatgtgatctgggctcactgcagcctcaaactcctaggctcaggcaatcctgccgcttccgcttctcgagcagctagaattataggcgtgcaccaccacacttagctagttttattttagttttgtagagatggagccttgctatgttgctcaggctggttttgaactcccagcatcaagcaagcctcccatctcagcctcccaaagtgctgggattacaggtgtaagccactgtactcaaatttctcaactttagtttccagtagagtaagcaatgatagataatccacacaacaactctctggggccctcaatttctaagagtataaagagccctgagattcactgtactccacactctccagggtcccttccagctgcagagtaacatggtctcagtctctaacatttctctgcaatctttcccaaaagtgtcatctgcagccttggactttctgagtcctgtctcccatttctaaggttcacttgacaattttctgataccctgttatctctttactgtggatacatctcaaatggattccatccaacttccactgtgaggcgggcttacctcacacatctcagaccccaaagatgcctaacctacccctcccccatgtctcactacacagggtccctaggcgccaccctgcccctcactctgcatgctcagcttcctcactgcacctgcagaaaccttctgcctccaagtcaccctgtgctgtcataatgaccatcttccttaaattatggcttttttggttattctcctactcacatacatcactggttctttatacttttatgagtaaagccaagctccttaacctgctcaaggacccagacacatttcaactcggcccctgccagcaccatcagaagacagctctgcagcctgggtgccctcggagcagcagctcatctctcactcctgccatgagccccacaggcacagggcaggggtcctgctcagcctgagtgtttctgcaggggaaagtctggggaatggcaggcaagaaaggtaaaagggcagatagaattatgtttctactttagcttttaatcctccacatggaatcctaacaccgtggaaaagcagcatgctttaataaggtaatgaataaatggcctactttttttgcgcggctgcgaaggagatgttgactgagaggctgtgccgttactgctactctcttcttcctctttaacttctactttcacttcaggtttcttttcatccacttccattggttctgatttctgctctgctatgtctgtttcttctttaacttgggaagctccttgcaaatcctcctccatcatcttgagaaaaacattacagataacatatgaatatcaaacacctttatgttaccgcaacctcacgggaagactcttacaagcctaaaacaggtttgttaaaaccttcctctagtcagagttgcatttatgattcctcttctcttccggaagaagaaataaagtacttggtgttcattaagtcgcttcagcacagagtcagtgcaattatggtcctaaatttaaaagtgtttttttttttttttttttttttttttttttttgagacagagtctaacacccaggctggagtgcaatggcaagatcttggctcactgcaacctccccctcctgggttctagcaattctcctgcctcagcctcccgagtagctgggattacacgtgtgtgccaccacactcggctaattttttatattcttggtagatatggggtttcatcatgttggcgaggctggtctcgaactcctgacctcaagtgatccacctgcctcggcctcccaaagtgctgggattacaggtgtgagccacagctcccagcctaatttaaaagtttttaaatgtaaaactgctttaaaaattgcacatactcagatttttcactacagatatttctaatttggaataaaaatctccttgaaagttggggcagggaccaaaagtccttctcagaggcaggtgtggtatgagacaggaaggagcagtggggactgtggctaattggagagcccactacagttggtgctcacaaccagactgctgtcacacagggatgcaggcacaatgctgaaagcatctcatttttcaagaaaagccagaaatctagagttttatttgcaatttcctgatttttaaggtattgtgtgggccaaacacatttagaggctggatccagcccacggtctgccagctttcagcttctgccataggttaattagtaaatgaatccaccaccccttctgtagtctacctctgcagaactagaaatgaatggagaacataaaataaaaggctgttggatgattcaagtatttcaaatataagccagtattcttcatttcgggcaaaataaacccacccctcatatttaaaaatgaaaaaccaagctgttttcaatcaatttcctatacaccaaaccccgaacccacattcaaacagaatattttaactaaagtcagggatacccatggcaggctccaagcctcgcccgaggacacctgggtaaagttgcgatacgcagtcaatgcattcctagggagcggcacccacctcagacctgggctcccctttggattcaccaggatcgggctcagtgtcctctgcttgggtctccgtcttcatttccagcacaggtacgtcaggtcctggctgctgggaattggtttctgcgctggccaccgaggagggggtagggactctgttatcaatgctggctgctgcctgggaaagctgtgaaaaaaccgaaagcactgacttcagtaagcaaggtaacataaatgatcttcaactatgctgctcatgcaacctacaatttcccattaacatttctcaatactgatccagcaggtgcccttctgtgaaaccgaagaacaggggttaaagtaggaatgagttctagagggaggtaacagcagccagaggtacaactcaggtcttgccacaaaggcagaggaaacagcagagcttttcaaactttgacataaatttattttctcgaagttttctagctaaatcatgaaatctcatattttgaaattaattcccttcaatatggtggttaatgtgtatggtaaaaggctgaattatgaatgcctaagcacatctgaagggagggaaatcaagtgcctacccaaagacagtgttacccagcctgtgtgaacggtaggaacacgggtgctggtggagtaaatgaacattacacgaaggaaccactaaaagaattcctaatttgcaaattcttactcaatggaatttttttttttttgagacggagtctcactctgtcacctaggctggagtacaatggcgcaatctcggctcgatacaatttctgcctcccaggctcaagcgattctcccgcctcagcctcccgagtagctgggaatacaggcaccagccatcatgcccggctaatttttatatttttgtagagacaaggtttcacaactttggccaggctggtctcgaactcctgagctccggtgatccgcctgcctcagcctcccaaagtagtgggattacaggcgtgaaccaccgcgcccagcctcaatggagttttaagtaaacaaacaaaagatgacaatgtctcgctctgttgcccaggctggagtacagtggcgtgatcttggctcactgtaacctgtacctcctaggctcaagtgatcttcccacctaagccttctgagtggctgggactacaggactacaggcacacaccaccatgcttgtctggttaaaaaaaatttttttttgctggagacgaggtctcactatgttgcccaggatggtcttgaactcatgggctcaagtgattctcccaccttggcctcccaaggtgctgaaattataggtgtgaaccaccgcgcctggcctgacacacaatttttatgggaaaattatcttctaagagtcttggcccaaaaacagcagagacagagaggcttaccggtgtgccaggaggctgggcgtgcacaggcgtcggctgttgctgcgatgactgaggggtagccacagacgggggctgaactggggtttgaggctgcggggtcacctgggcctgggctgctgcctggactgtaggggtgctctgggtttgggtagcactgggcactgagccaggagtcggggtgggagtctgcccggaagacgacacaggagttgatggctgagtgggagctgctggctggggaggagtcatcccaggtggtgtcgtgtgctggagagatggcatgccagcagccgtggaagcaggaggcggtgttgggtgcagtggtgactgtgtcactggagggcaaggtagctggctggcctgaggccccagcatgttgagagggttaggaagagcagcaccaggcacctgtccctaccagaaatggacagagtatggtaaaattatttcccccgtttgaaaatgtgatgaaacatttgaaaaattaaatgtatgaaaaaaaaatttttttttttgagacagtttcactcttgtcgcccaggctgcaatgcaatggtgcgatctcggctcactgcagcctccgcctcctgggttcaagcaattctcctgtctcagcttctcgagtagcagggattacaggtgcccgtcaccacgcccagctaatttttctgtttttagtagagatcgggttttgccatgttgtccaggctggtctcaaactcctgacctcaagtgatcctcccgcctcggccttccaaagtgctgggattacaggcgtgagccaccgcgcccagccaaatgtatgggaatttaatcacattttcttgggagtgttctgcttgtgaaaattcatcgagctatacacttgtaatgggcactcctcaataacggtaaaactacacacgtttcttatagtctgatttatataattaaaacaaccattgaaacttatggcttaaacacacacatctacagcagtcccctcatatccactcggatacattccaagacccccagtcttggaacgcctgaaactgcggatagtactgaacccaatatttaccaagatttttggatctgacaaccaaggtggacactcagtgactaagaggtgggtagtgtctacagtgtggaaatgctggacaaataaatgattcacatccctgggggcacagagtgggatggtgacagaattcatcatgcaacttggaatggcactcaatttaaaactttttttttttttttttaaaaaaaaaaagacagagtctcgctctgtcacccagtctggagtgcaatggcatgatcttggctcactgcaacctccatctcccgggttccagtgattctcctgcctcagcctcctcagtagctgggattacaggcgtgcaataccatgcctagctaattaatttaaaatttatgaattgtttattcccagaatttcccatttaatatttttggaccacagttgaccccaggtaactgaaacctcagaaagtgaaatgacagattgggggagctactgtacattgacccagcctataagcttcatgttctataacatgtacccaatgttctttaacattttctaagcttagcttagaaaaaggtattttttttttaagttgcttcttccctggggactataaaataaataaataaaaataagaataaaagttattgaccataaatatatacatccataagtacccttaacaattaaaaatttaaaaaaaaaattctctctgaaacacaaacacacacacacacacacacacacacacacacacacacgttagttactgaaagagaactgtttcagtgcagtggttctatactggggatacacttcagaattatttgtgaacattttaaaaatgattctgaatcactgttctagagcaggggttggcaatctcccagggcaaacacactgagctgcttgtttctgtaaataaagctttattggcacacagccacctcatttatgtaccacagcagcttctgcactacaagaacagaagtgatgaaaaccaagattgaatggcctgcaaagctgaaaatatttagtatctggccctttacacgaagtttgctaatccttgttctagagaaatgaaatgttatggaaagttaagaataatcatttagtgaggaaatctaatatataataatgacttatgcagcattatttcacattaaaaactcaaaacaaggctgggtacggtagcttactcctgtaatcccagcactttgggaggccgaggtgggtggatcacctgaggtcaggagatcgagatcagcctggccaacatggtgaaatcccgtctctactaaaaatacaaaaaaaaaaaaaaaaaaaaaaattagctgggtgtggtggcgggcatctgtaaccccaggtacttggcaggcttaggcaggagaatcgcttgaacccgggaggcggaggttgcagagccgagattgtaccactgcactccagtctgggcaacaaaacgagaccctgtcttaaaacagacaaacaaacaaaaaaaaacttaaaacaagaattttatcttttagggaggatttggtgtgttttaaatacatgtatattttgtatacagtagcaatgatacgcactacaactaacaaaagaggaaaaaaggaaggaataaatggaaaatcaatttcttcagctctagattgagaaattaaaaacatttaacaagaagggaactattgaaatgattctgttagcttgatttcacctggcagtggagacaggtcaaaagaaacaaaagccaaatcatcaagagtgaattcatgggtccttctcactcgctttttaaaatcctaatgcctctcagggtcacgttaaagttagaatttaaaatacacaaacaaaaaataagaaaacaaaaactcaaagatcaaaacacaaaagcatacaaaccaaaaattctaaatccattcccacttttgcatatagttaacccagaaaggataagagaaattccaaacgagttaaggactacaggacaaaggtggagaaaacaaagagaagctgatacaaagacatgaaatgtgcattctggaattttaatttccacgaaggaagacagaaaaaaaaaaccaaaacttaacacaagaattttatttcctagggagccacggtcccagtggggcacagtacctgtgacacgcctgtttgggctggcggctgccccatgcccacactcatcgccccgctggatgacgggaactggttctgtggcagaaactggctctgagcgggcgcctgggccatcatgttgttggtgtgtgcacccatcatgttcggaggctgaggcattcgggaaggagaaatggccatctacgagacaacaagcaccaccagagctgtagttcggaagctgacggccagagttttcaaggtgagccagaatgatccaaggcttcacaaccccagaggatggcaagcacagggctcacatcctgcccttcctcatgggaagagaccaccacttgctaagaactcccgcgctcctgggcaccttacacactttctcaggcaatctctcaaatgagccagcttcaaaatgtcctctgaatagaaatcaatagcaggctataatttaaagtttaagacatgcctatgagttctctaaagtgtttagaaagcagcctcggaacagcgagctctcagtcaacagatgctgacaattccctgctggccacatatctgaggctgccttctccagccttggaactcccacattctcacaaagccacacattcctatgaatttgttattccaataaaataactaacagtcaaataattctgtgtagtaataatttttttaaaatgagagatgaaagaaataaagcataacccaaattcaaaggaacaagaaccacaggattctcaagtgacatgaattctgctgcttagataatgttccatgtgagagggagggctatctgcagcacagcgaaagagaacacttacccctggcactgagcccatgctgttcatctggacagagtggttcattggggaggctgcacgaggtcccatgggtgcttgtggcaactggacgttccccaaggacatggggttaaatgaattcatccctgtaaatgtacccacaacggttcattaggaaaagcacccacaggaaaacagaattacaacttgctaaataaactcttaagtaaaataagatggaacgcacaggcaacagaaaactgaaaagaaatcacccaattaatcaatgaagatgatgaaggaacagacttctccatatccagagaaaacggcatcaatgtgggggtggtgacggtggcatggtgaggggtaccagggaaggacgaggacatgaaggcataaggttgggtaagacaggaacaagtgagacattaaacgaggctgtggtagagctgagccagagggcacagtaccaaagtgtcatagcaacaaagagggtgaggaggtgccctgaaaggacagcaccctcacaagctacagaagagatgtttccagagaccagggcaagcttctgtgcacacccatacctaatgcctctggagcagctgacgcccatcatccgaggattcccagctccttgctgggtttacattcattgttagaatctgtgctaagtctccaaatgttcttttaattttgcaagcaccttaagcattaagaagtgcccaagggtcagccgtcctcaaccttagcctcctgtagtttacaggaacaccacatcactgaaagacacttcacagccagtaagtgtctccagactgcggtgtctagttccttccaatttccaataatactctgtaaactctgagttctaaagaagcaccagttcaaattagtcttaggaccaacactagaatctgacagaaccctttagagaatttctggaaggtgctgccttagcgctgctgtagtcatgagaaggctcaaaggatgactcacggagcactaccttcaatggctacctagaaatggtaccctcaaataacggagtgccgatgcagaccaggaagactttccagggagtctataatgtaagcttccccactccttgagaatttttttaaacaaaatgaaaaacaattactaaggaacagcacttaaagaaatctgtatttacccagatgtgctggtagggaggttgctaagtgcataactagaaaacatctattccaatattctgctggtaaacagcaggggcatcataccccacaccagcagcatcttcctatccaggctgaagtcctggaccaatccccaacacagcatccagccactttcccaaggctcaatttctctgactccttgatttctttcttttttttttttgagatgagatttcgctcttgttgcccaggctggagtgcagtggtgtgatctcaactcactgcagcctccgcctcctgggttcaagcaattctcctgcctcagcctcccgcgtagctgggattacaggtgtgcaccaccatgcctggctaaattttgtatttttaatagagacgggggtttcaccatgttggctaggctggtctcaaactcctgacctcaagtgatcctcctgcttcggcctcccaaagtgctgggattacaggtgtgagccactgtgcccagcctgactccttgatttctttcaaaaatcaaagcctgagcaaagcctctttccttagagtcttctggataatgtcaccaccttgtttcacaacctggaaaaatgtcctcctgcttgggtctcaatggtcaagagctacagggttttcaaatgctccctgccccaaaataaaaatcactgcttcaaccaaccaaaaaccagaggctctctacttaagaacctttcaaggttgttgagacagctgctgacaccccaacctggcacaggacctgtgtgtacactctctccagaagttgacatccagccagctgggcttaacccctagggccaagagcagcccgtgccgtccccatttcagcctctgcaagtgctcagcagtctaggactgtcttgcatgcttctccttctcagcattcagaagcactccctccccacatctagggtgcttctttctcggactcttcctaagagtaacgtaccacacccccttcaccatccattaaaaaaataaaaagctggccgggtgcagtggctcatgcctgtaatcccagcactttggaaggccaaggtgggcagatcacaagttcacgcgattgagaccatcctggctaacatggtgaaaccccatctctactaaaaaaaaagatacaaaaaattagctgggcgtggtggcaggtgcctgtagtctcagctactatggaggctgaggcaggagaatggcatgaacccgggaggcggagcttgcagtgagcccagatcgtgccactgcactccagcctgggcaacaaagtaaggctctgtctcaaaaaaataaaagaaaagaaaataaagtaaaataaaaagctaaggccgggtgcagtggctcactcctgtaatcccagcactttgggaggctgaggtggacggatcacggagatcaagaccatcctggctaacacggtgaaaccccgtctctattaaaaatacaaaaaattagccacgcgtggtggtgggcgcctgtagtcccagctactcaggaggctgaggcaggagaatggtgtgaacccaggaggcggagcttgcagtgagccaagatggagccactgcactccagcctgggcgacagagcgagactccatctcaaaaaaataaaaataaaataaaataaaatagaaataaataaataaataaatagctaaatactgcttcttatctcttggaagatctttcctataatctccaaacttcatactataaacatatccatactacctgtagaactgaattctgcttatcagcaaaaaggaatggaaagaagaaagggttagaaagaaatatacagggggagaggaaaaaacagtgaaagttatggctgttgaatgtaaaactaaaatatgattcaccacaaacagttcaataccttgagaaacttgcatgcgattcactggcagggacaggggtccatctatggtggcaaaacaaaaacaaaaacaaaaccaccctagttatttaatataatccttgattcaggaataggaaatttcttattaggacttcaaacttaaaagggaaaacagccaataggtccaaaagcacgtgtgttccaatgccagcgcaccctgtaaagggccttcccaagagagaaactcagtgtcccaacacagcctgaggcaggtggtcagggccactgccacatcaacagcttctgcagggcatgcatcagatattctaattctctgttcttagaaatacaccccaaacacgaaggaaaaccaaggaaacaggctaagggatggcagtaggaaataaaatccttacttggaggtctcacaggttgtgcctgtggaatcacagggggctgagcccccggggctggtaaggctggctggttccccaagatgccttgtttatgtaaacgcgacctccgtttttcttctagttctttttgtatcttgtagattttctctgctaataagtgataatattcatcctaaaaagcaataatattcaatatgaaacagttaaaactgtaaaaagcaactgaatgatctgtgttgtaggttctaactaatgaacttcctcattgagtacactggcaaaagtagtatgcaaatacctgatacaccagaagcccacattcttgctgaattcccaatgactttataggacatatcaaatagtaggtacttaatacatgttccatttcattcaaatgaacttcttgaatattcactgatgctaacaatattacaacaccacctactatgaaaaatatatcccatggatataatgtaaatttatatactccatgcaccaatgtagctaatcaagagagttctgcaggagatttgtgtcttatctgggaagtctccttggtcagtggcctcaaggggaggagtctgtcccaactacatagattccactatttccagataacaaagcagacaaatgtagtgctgtctactacagatgctgtagaggccagagcacggtaaacagcaacctaccctgctgttggcagactcgtacatgtccccttccactttcttagcataggctaccaggttttccatgcggcgatcctttagagctgcgggatcaggtgttgggaagatggcttggacgctgaaaggataacacatctatcaaactacttttttttttcttcttttttttaaagacatggggtttcgtccaggcgcggtggctcacgcttgtaatcccagcactttgggaggctgaggcgggagaatcacctgaggtcagcagtttgagatctgcctggccaacgtggtgaaatcccgtctctactaaaaatacaaaaattagctgggcatggtggtggatgcctgtaatcccagctactcgggaggctgaggcaagagaattgcttgaacccgggaggcagaggttgcagtgagctgagatcgtgccattgcactccagcctgggcgacagagtcagactccataccaaaaaaagaagaaaaaaaaaaaaaagacacagggtcttgctctatcgcccaggctggagtacagtggcatgatcatagctcactgcaactttgaactcctgggctcaatgatcttcccacctcagcctctaaagtaagctgggaagtacaggtgcacaccaccatgcctggctaatttttaaattttctgtagagatggagttttattatgttgccccggctggcctgaactcctgggctcacataatcctcccacctcagcctcccaaagcactggaattacacgtgggggccactgcacctggcctgaagctacttccaatgccatcaaataagcactacaaaatcaggatcatgtatctctggtggcaatacagtgtggagagaaatgccaagcctctcttgcctcgcatgtcaatacatgaatgaagttaactccctggagacaatcctgacctatcaacttatctacacatcaaacacatcaatattttgctattaacaagtatgtgctgggtcatttccagaataacacgattttcaaatccctaatttttaaactacttattactaaaaaaaatttgatcaaaataaggaagggaaaaaactcaaagggaatgtaagtctagctcatttaaaataactagctcaacaacgttaggcttggtgtggtggctcatgccacccagcactttgggaggccaaggcaagaggattacttgaggccaggagtttgagaccagcttgggtaacctggcaagactccgtctctctctctcaacaacaacaacaacaaaaaggccgggtgcggtggctcataaccccagcacttcgggaggctgaggtggacggatcacttgaggtcaggagtttgagaccagcctggccagcgtggtgaaaccctgtctctaccaaaaacacaaaaagtagctgggggtggtggcacgtgcttgtaatcccaggtactcgggaggctgaggcaggagaatcacttgaacctgggaggcggaggttgcagtgagctaagactgtgccactgcactccagtctaagcaacagagcgagactctgtctcaaaaaaaaaaaaaaaaaaaaaagttaactgttaactttccgttatgttaactaactgtaaggtgataatgacatgccatctatactctaaacttttccaattctgaggggtctccacaactagaatctggaactacaaaataaggtgaggctcttgagctaaccccagccccctcacgcagcctaaagtgcagaagcacattaaggccgggctgcactgagggtctttgcctcggtgataggggctgcaagtcagtgcccctcggcagtacagagccaccaatgctctctttgtcacccccgctcaccgaggacatagagtgtgggaatctctggcctgcctagggctgccagaactctaccagcagtgagagtggctccctaaataagcacgtgacttgtataggctcctagggtactgtcatctggtagccaatgggcaacacaggaataaaatcaaacatctatgaaactgcaaaactgttacgtacagtttatgcactagatggctccgcaggtcctgagtgacatgttcgtgccagcctttccttacaccggtgctagaaggaggagctgctgttggtatagtgctgagggttccaatgttaccagagttggagccatcgttcatcagtgggctaaggaggaaataaagacacttcatccatctactgaagtgactcaaacacactttgtctagtaaggttcttctgccaccacatgtgacttttaaaagtttaagtcaggagagccaagtgatgtaaataaataaaacttaaactatgttttaatctattatctgctctacatttataattaaagaaaaaaaggaaaacagcattcacccctcaccaccccatttaaactattttctctgccacacatttagaaagaatcagttttgtgtggttctcagtccatgctcctgttggactgtcactcagatctgaaacagggtcttactttgtggcccccagggaagtcggaagagctgattctgaaatcaagtttgggggctgctgatctgttgttattcctcctgctggaatgttcattggattatttcctttaaagacagaaaagaaatcaatcaacagttaaattttaatatatacttcaaagttttgatgacagataaccaacatgccaccatataaacaattggtggttatttaaataagtgattctggccagttatagtaagcactgcggcaggaactctgagtgtcatattttcaataatggtaatcaacgtgcacaaataatcagtagacaccctccccactctactttgtaaccaaagtaaggtgtgtttatggaggttagctgctatctaagtgaaaaagttataaatgacccacatgcagcctcttactttcattctgcttcattagtatcgctcctgagtgactcagctgcactgacacacacctctgtgtctccacccccaatatcagaaaataaaatcatagaaattaagctcaggaaaaaaatatagaggtcaatttgtctacaatcttcctattaaaggaaacgaaagctgagactaaaaaaggttaagctagtcccaaattataccatcaacaggagaggagttagattaacacttgggtctcaggattctaactcagtctcctggccagtattagttagacattcattagggcagttgttttccagaaagcaacaagtaagatgactttagctgggcatattttaaggagtaatttttaagtgtaaaatagttactctattagggaaagaacaaaactagcacaactagtcagccagtcttgacttcacagacatcactgcttagcttaagcctaaatgtaaagggactgtgtccacttaaagaaaaatattaaggaaaccatatgcagaaatggcaaaatcatggcgatgtgtgagcaaacgatcaaaggctggcaaataatgggctggggtgacaaaagaaaccatgacatgtccagcagcctgagccaagagtttccaggactcctgtcattgtcattaacctgctgaagtccaggctggtcacttccaactgaggggtagaccctaaccaagatgtgtgagaaactggcaaacacaagtactccaacaaataaatgacaacagtcagcatgaggcgtccagtcagcatcctgacttgtgagatctgcattctgaggcacatggcacattctttatgaaaaccgtccagacagaagtggcacagcaagcaacaaaaacattgcttcatttgcaaatgctgctctttttataagcatgtaacattttccttgcatcagatacttcagctttttcctgggagattttttatttcaaccaccgtagtaaaaaacacaaaacaaactgaaaactgccttgggttccatcactccattccctttgctgcatgtggacaagtaagaacgaagttgagagttccttcacctacccagggggttgagagtcctcatctgctggtgggtttgaggctgtgctggttgctggccaggaacctgaggctgcagctgcgtctggggctggttcatgtaggggagtccgagagcagcataggctcgctgcatggagctggggtctatgggatttgggttacttaaagaagtggcattctgttgccctgtgccaacagaaccaattgtgttttgaattccactagctggagaccccaggatggctataacgacaaacagacagacagacaaaaacgagaggtaagtaaaagggagaagcccacgaatgatttaaaaactattgagaagcaaatacatttcatcaaaatactacacatgaatatcataaagcagtaaacaagcctagggagaaaggaactgtgctgaaggactcatttattctgcctagcagtaagtgaggaacaaaaagttaaagaaaagtcaagtttctatcttagcatgcaacagaccataaaatctcacagataacacttgaaaaaaattattatgtcttaaaacctagagactcctcaagaagtcagttccagggagtggcaaatgtatgacaagggaaacgtctgattctctggggaccagcagacacctctgagatgaacagaggagccccctcctgttgaccccaaccctgtccttcactgctcacctgcacaggtacagagggcttaagagaaggagcagagatgatacctggtcggtcagttttgattaataaatctataatgtgctcttccaaatcacataattgcaagtccttgaaacatacacaaacaatgacagcatggacatatccttctgatgggattcctatgcagcagagcaccatgctgagctctccggctacatgaagctgttcaagaaatactgtacttgattgattgactgactgagctgtttgaaattaaggttggagtgaggcttcgcaattctgcatgggtcttattatccaggggctacctcagcacctctgatattcaggaggtggctctgcctcacgtggccaaagtcagcttctgctactgaggcccactgctggctggcagggaagctgccccatccagctagctaaccccaggagactaaaggaaaaactggtgtcaacataaggagctccatcccaaagggcttccaaggtaatggagagacaactccaaacttgcatcaacttggacatttcaaggtcaattcatctacccacctacctacccacctgttacctgtttgcctgccccctcatctgtcgcaacaacccaaatgctgttgtgtgaaaatttatcatatggcagaagttctatatgataccatttattcctatttttgagttcctttctaacttccacaaattttagagtcatgttaaaaatagcatcttatagtgttgttgctataacacaccatttttgatacataaaacacgaccacaaagcctttctttcaaatcccaaccactatgtgtaacagtaatattctcacattcaaccatcagcacacctataataaacccaatacctaccagagcaacttaattaaactaaaatgtgtgaaaaaaaattcctggtaattatactttccatactattaacttttctaataatgatattcagatcaactcattaacactcatcagacacaactacatacaccaagcactcattaacataaatgaaaagcaactcccaaggtgcactttatgacaagtgtgtagctgaagtaagtcacgcacaatacctttaaaagtattctaatacttactactccccaaaactttaaacatgtgtccaccatacttctgaaaccgacatcctacatttttaagaagcactatggtatagaaatcaaagttaacagtggtaggatagtttatttttctacaaccttgcgctgtaaggaagaacagggctacactatatttaacacacatggtgatggactgtggagaagaacttaaaagaaacaaagtatggagccttccatttcccgtaaaccctttattgacttcttcctactacatttctcttttatccacacctccccaagtgccatctacttaactaaaatgccccaccttacagtgaatgccactcctaagctcacagcacttacagggcagccaacgcctcatactcacataggcctcccacggaagctgctgacacggtcactgcattttgtgttagaggcattcattttctaaacgtaaacattattatatttttattttaaaagaaaatatacctatgagaagcatttggaactcatcatttctaaaattcagaagcaaaggaaattaattatgaacaaataaagaaggtctctgccatttaagcatggctgaatttgaagtccaaatgatgctattacatgaaatgacacaaatactgaagggtaagggtgctcaggcattcactgcagggtgatggctgactgaaaggggagtcactatgtataagccaccatcaactgtactgcaacctcaaggtgctccaagtgctccatggtggtattcccaatccctctctgaaatcccacagtgactcctgtacccgcttgtctttagacactgacccttcgtgtattcactcactcacgtgacagactcagtgagtacactctgccaggctcccagacatggtgtgggcacaatctctgcattccctgagcctagggacaacagattatctaataatcacctaatgcacccaaactgcaccttggaaccctgggacagggaaaatcaggctcatgtcacgttccctgtgcatccctgaaaggtgggattaatgtcaaattcggttttgctcttcaccacctgccacatgggccacgtaacctgctgtgcagagtccaggggacgtgccagctatagcgcagcggccagcacatcgtgggccctcgcagcgcagcccatggagtgtcttggaactgaacagaaatgcacggagattggtccatctacctggcatccctaaggatgaagtttctctatttatcctttctgtattattgccacttaacttcttccaatgtcaaggccgtgtgctcatttggccatttttacatcttttttcctcgctagagcataaagctctaacttttaggaagtcacaacacacctgcaatgcactaacacagtggctgggttcttctgggcccatcaggcaacactcctgtcccggatatttacctctttaaagctccccaacatcccctagtctcaccaccccttctgatgttgctgaagaaggagcctatgacctatgaacaaaaggccaagttttatagcaggctctttctcggactcacctgccactcttcatgcacaaacaatgttccactaagaggccgggtacggccaagtgtaactgggtgcagtggctcatgcctgtaatcccagcactttgggaggccgaggcaggtggatcacttgaggtcaggagttcgagaccagcctggctaataacatggtgaaaccccatctctattaaaaatacaaaaattagctgagtgtggtggtgcgtgcctgtcatctcagctacttgggaggctgaggcaggagaaccgcttgaacctaggaggtagaagttgcagtgagctgagatcgcgccactacactccagcctgggcaacagagagactctgtctcaaaaaacaaaagaaaaaaggaatgttccactaagaggttttctgtacagtctatgttgctgatgcaaagaactcagttactcagacaacttaagcccctaatcatcctcaataaaactgaactccatttggaaattcagtgaaaacggacatgaatcaaatctccaaactttgtgagggtagggggagacagaccatgaagcagagcagtagttgctacagctgatgcttcaccagcacgagagtgagccacggggtcacccaacgcaggccagaaacacagtgcttgcgggaggcgaaacttgtgtatggggaaggccagctgtagggcttgagtccacctggttttggtatacctggggtgtcctggaaccaaattcccaaggataccaagacacttagatttctactaaaaaagcaatgctagaatttattcaggtggctcacgcctgtaatcccagcactttgggagtatgagggtggggagatcacctgaggtcaggagttcaagaccagcctggacaacatggtgaaaccccatctctgctaaaaatacataaagtagccaggcatggtggcatgtgcctgtaatcccagctactcgggaggctgaggcaggaatcacttgaactagggagacggaggttgcggtgaactaagatcgcgccactgcactctagcctgggcgacagagtgagacttcgtctcaaaaaaaaaaaaaaaagaatttattcagacctgcagccatctctacaaagttgctggtggcaccaccgtaccttgcgggcattgtgtgggccaggacctacttcctacctggcaccttcctatgcactgcgtggggcaccacagtgaagagaagcactgaggggaacccaggcactgccaggctggagactcagcctcctatcaggcacggccacaagccctcaagcaaaaggctttcttcagaagccaagtgacactggcgcagtgacactgctccttgctagcaaggagaaaagctgttcagatgaaacacatcacccacgaccctttggtgcttaagtcagggtcaatcaagcccaccattctctctacagccttcagattctgctccttgctgtcccccatcccactacagtctgtcaaaagaggtgaaaatctctgaagggccctcaagtgaacaaagggcctgctccacacacactcactgggcacctgatgggctattcgatgagtggcagttcaaaggacggagatcttgactccatataaaaaaaggaggtttttttttttgttttgttttggttttttgttttgttttgttttgtttgagacgtagtcttgctctgtcgcccaggctggagtgcagtggtgcgatcttggctcactgcaacctctgcctcccgggttcatcaagtcattctcctgcctcagcctcccacctcaggataccgagtagctgggactacaggcgcatgctgccatgcccagctaattatttgtattttagtagagacggggtttcactgtgttgctcaggctggtgttgaacatgagctcaggcaacccgcctgtctcactcagcctcccaaagtgcaaggattacagacgttagccactgcgtccggccaaaaggaggtgttttaaacaatctgaggcacctacagatggaacatgttgccaggtgaagcagtgggagctacactcatggagatgccgggcagcagctggggccatggctgacgcagccgggacagtgcgtgcattaggctggctctggggccgaccctgcacacttgcttcaacagtccctgggggactctaggttggaaaacccctggtctctctctcagagaatgactcaaaccctctcaccagcactggcccagatacctggtcttccaaggcatccagagcagtgcatctcagattttaatgtgcacactaatcacccaggatttttataaaaatgcaggttttaatataagaggtctcaaatgggggcccaatttctttattgcttacaacctgggagcacctctatggcttccctgaggcctacactttgagcagcaagaacttcacaagtgaggcagcataagccccaagaggggaacctgctcacgggtcccaaagcccagtcaaccatgccactctgtgcactgaatttactggaggtcagatgccaggactgacataagatacttatcttggcaagtcctaattattcaaaaaaaattgaatattgctataagggatggttaactcgagatcagtgattacagaatctttaaaaaacaattcaaggaaaaatcgaatgaggccaggcgcggtggctcacgcctctaatcccaggacttttgggaggtcaaggtgggaagatcacttgagctcaggagttcgagacaagcctgagcaacatggtgaaaccccatctctacaaaaaatacaaaaattagccaggtatggtggcagatgcctgcagtcccaggtactcaggaggctgaagtggaatgactgcttgagcccgagaggttgaggctgcagtgagacttggctatgccactgcatgccagtctgggtgacagagcaagactccgtctcaaaacaaaccaaccaaccaaacaaaactcaacacaggccaaaaaggtaatcaatggtctgggcttcatttcaaagaacctcagattagcgccacaggtgattctggaaggttctctcagtagagacattaatcacagaagttaagagagtggagcatgtgctgaccaaggaagtgtgcatcaggtaagaccagcgctggcctgtgggaaacactgcctaaaaagcagagtcccggggcccctaaggcagtctccacagagcgagcacaggtgggtctcggcagagtccctgaggcttccaggagctcatcacagtccacctttctgttcacctcgtttgcacaggaaccccagtccagtcaaatgcatgccctcacaagctgtgcactgtgcagacactgtccccactgtctgaaatgttcttcctttgttattctgtttgcactgggctccaccaagtcccacctttctctacaaagtagtcaggtgcgctccaattctcctcgaaaagaatgctgattgcactgacttgtctctacctcggtcctttgagggaggtcacccttacgttatttttaacatatatattgtcttcaaaacccaaccttaagccaacgtagggtcagattcacattttcctctctgggttcctaactcaagagttcacacacgataagcataatttgctttgggagaagagaaaaaacaataaaatttacaaaaaggatattgctgaaaccttgtcaatcatacttttgtaaaaaaaaactaccaaaaccttgcagcaagttaatctaaatcttccttgtgactttataaaatcatcctggtaatatcttacattctgactagtagaaaacctgtggtttaccacttgagagagcatgcacagaatcaattttcacaacactcaggccgttataaggatggtttaaaaaaaaaaaaccacatacgcttcttttttcttttaaaacaaaaaccacataagtgtttcttaaaaagagaaatcaccaaagtttacaactgtcatggtagtatgtactaaaaacaaaagatcctcaaaaagccacacccccaaattaaagttaagaataaaattctagctcattattcatagaatattgtataactacaaacttgacaatgaatattttggcacttaaagagcctattactgaaatgtgccctaaaacacaagaaatttagccatcacaatatactaaagaaaaaacttttacagtaatgtgggaggaaaaacagactgtattccattagaactactgtcccaaatatctggttctagaagacccaggattccagaatgtcactttatataagaaatgtccagggaaattgtttattaattcaaattttagtcaatcaaagaataatttaactgacttttaggaaactggctttttttttttttttttttttttttgagacggagtttcgcccttgttgcccaggctggagtgcactggcgtgatctcggctcaccgcaacctccacctcccaggtttaagtgattctcctgcctcagcctcccaagtagctggaattacaggcatgcgccaccacgcccggctaattttgtgtttttagtagagactggtctccaactcccaacctcaggtgatctgcccgcctcggcctcccaaagtgttgggattacaggcgtgagccattgcgcctggccaggaaactggcttttaaaggaaactcgttgtggttcttctgtagggaggcagataacaggccccattaccctggcatttctcttctctatgacagggacaccctgctttaaaggaagcagggtcagcgtcagctcgctgcctactccctcgccgccagagggaggtgggctggactcagtaaaaggaaaaccacgggggctgtcactggcacgccactccacagtactcttaggaacaaagcactttttccatctttccctgggccactcagaaacaaccagaaagaaaagcagcacatgttctccaggcagctgcggggtcttgaggaaggatgatcaagaagaatgagaggaatgaacacgtaatacacaaaacaggggagggtggcaagatggcacagacgagatggaggaagatgaggaagactgtgctgtgctggaagggtcgctaagggtacagctccagccagaggggacaggagactgaagggcacttcctagctgtccgaaactgaatgacacacccaaagaccacagttttacctctaaaatgacaggaagatggttgaaaaacgggagggaggttcatccttcttactgcctgaagcctacaaatggcagggagccccagagccccaggcggacctcccaacaagcagggatcgctgcgtaaccagccgtgccgagggctacagacaacctagacaacggcaaaacgactggggtgatcaggatgcagcagccctagggcagaggctctcactgtgaagcagagtgaacgtttagttatacaaagagttctggggaccatagctccacgtagagggaaaccttcataaatgtctgtgtgggattttatactgacccagactgactgacagagccttcaaaatttacttcaggataagggctttccaattccaaaagaagtatcccctctatccccctccctaagacgtcactgccattatagcgacatggaatttaaattctcacgtatggagtaactgtcaggaaataccatgtcttcgtgttggctcagtgaacaaagtgactctgctgttccatgctgcttcaagtgcatgtatgcagggggcagggagagggagaggcagtgagtgagtcagggtccaacattatcacagccgttcctgacacggagagcccgcctgccctctgagcttggctgtaccttgggctgctgtccgccctacctcaccctgcactccatggctcataacccctgcccactccctacctactctctgaattttctttagaaacaacttctattctcatctccaagcttctctgcccccgtgctcacttactttgttggtttcgcttgtcactggcatttttcaaagggaggcaaacaggacagtcatgtcgtgtgcagttcttccaatgagagatgatttgtcgtgaagatgcacaatgggcaactatgaccagaaaaacaacgagatgttatttttctatccaaatcgtcacactttcaattatacctaaattataatgccagattccataagaaaatggtaacaagtgtaaccataacacagtataggcagtcctcaacttacaaacaggctgttttccaaaaagtttgtaagttgactgttgagaaatccaaacaaaacttcccctagaagcaatgttatgaaggatgggtgataaagggcagcccacaaaacaaaacaaaaactattcaacctggaatagcgaacaactgcaatgaaaggtagaacaaataatagttctgtgatgtcactatttaaaataaaaatgttcaattatgtttcaagatgaaaccacctaaatactacagtgaagaaatacagatagagaagcaaatgagaagtctgtagagattctgaaagggactctgggcacttggtgaagaagtactcgagaggctaactgaccctggttattccgtcttcatcttctaaaggtctaaccttacccttctctgcttctctgttacaacagggttactctggggactcacaaatgtcacaacgggagacggggagaccagggggagattcccctaagtttatgagcataagcagagaaggaaagagaataaagattaaaggaaagtacagctgttaataagaaacacttccttcggtagaaatgaggtgtctgcggtaaaaggggagacagagggcacgtgaagtgcctagttcaccaccccccctgggatgatacagtgcatagttccccatgtcactgccagtcacccaggacaacttcgctgtcatccgcacttgcctcaagacacaggacagaggagcaaggccgcaggccaccaagacagatgttgggatgcaggaagggcgtgtgcctgcacgtgcctgtgctatgttcattgccccaaaagaaaaccacaatctagacattcacaacaaagacagtgctcaagaagtgaccaatgtcttccgtgacagaggaaggaggaaaagaacaaatacggggcacagcttcaagcagcagaagttcacagagtatcagaaaaccaaatcgcctttctcttcagcagataagacttcctggagcacctgactgtcgtcgcgtggggaacgtgagcgcaacatgtcttgccacacccaatggaaggcagcactcaggctgccggagccttatgaaccagagagctgctgtaagaacaataaaggcaaattcttcctgacctctaccactaggagttccaaaaacagcacttaccttggcaggctttcccagcctgacaatgcgtcatgtgattcaaaacgtttttcatggttcgacaatgcgggagcgagcaggcccgaacctctccgtttgcttgctctcgtctctgacacttatgagcatgaagcagtagaaccagctgctgctgtatcagtttgcgtttttcaggatctgcagtggggcctgttgcaattgcttgtgtgggtacaattcccactgatgtttgcatctgagactaaaataaagcaaaataataaaaatactttaacctctcagagttccaagtcatattcattaattatttctcaaacaaaagcaaaagctgatggataataccgaccacagagagaaggctggtgtagttctctaacccactgatgactttaagaagatccagcagcacagaaatcaacccaactcagcagcaaggctgattcaagttcacttgtatacaattatcatccaagcaagacaatggctggctcttcactgtagcaaccaaaatccaactcactctacaatatacacaactacaggaaaagctgtgtactataccagctggaccatatgaaactgctgtttctgtaggtcccaaatggccaaacactggcaatttcatagggtacaacctaattaaaaagattgccaaggcctggccgagcgcgttggctcacgcctgtaatctcagcactctgggaggccgaggcaggcggatcacgaggtcaggagatcgggaccaccctggctaacacgatgagacctcatctctactaaaaaacagaaaaaattaggactataggcgtggtggcgggtgcctgtagtcccacctactcgggaggctgaggcaggagaatggtgtgaacccgggaggcggagcttgcagtgagctgagatggcgccaccgcactccagcctgggcgacagatcgagactccgtctcaaaaaaaaaaaaaaaaaaaaaaaaaaaaaaaaaagatttgccaaggcctgaccaattgcaatgtactacaaacatttgatgtagcaaaaagaatcagagccaccttttggatttcattatcacatgactagaaggacaatgcgtgcagcttgatttcacagcaaccattacctctcctaaaagaataatgacagttagccttaatacaaccacccagtgcaatgggaaatgcattcttgtcctatgctttgtttttcattacaatttccactcagacagctgacaatttttaaagatttggtgatctgctaaaaatacagaaagggtttgctttcagttgcctgaaataacaagccagaccaaacaaaccttttaacagcaaggcaaatggaaaaggggacccatagagtcttcttctttacaaactataagcattcttcagataaacttactgaaaaagacttaggcagtaagagaagtgttcctaatgtgcaacagtatcatccacagttccgggatttccaattttctctagtactctgatatttccagcttgcttccacgaccctcattacctcccctaaagtacgccactcggattttttaaaaatgtatgaatcaaaactgtatattcacaaagaggagagaaaactatacaaataatttttaatgaatcaaagctcacttttaaaagtttatagagttttctgttttgattttacctttatgagaactagaaaataagtacgtagaaaagctgggtggctgggcttgggagcaaaactcttggaagtctgagaaggacccaaagcaattctgagaaggacccaaagcaaaatcagcatcctagctgagaagcagaacaccatgaatgcagggctcaactcctaagagaaaatagcctcttatgtttattttttcctgattataaaagtatatatatacactgcaggaaatttggaaagctagagaactactacagaaataattaacaacaattaaaatcccattatccaggagtccactactaaagcgttgataggtttttttcccttcttttttctatataaatgtttacgtatgaaccataatcaatagagcctcgtatctcccctgcaacacacatgttttgcttagtgttttttccatgttctgccccataccactaaactgtctcagatagtgggctggaatgacttgtaatgaacagcatgttactcttttaactttatactcatttaactagttcttgttatggggcataaactggaatccctggcccctcctttattttttataactgtaaataaagcttcagtaagcaaacaggccttgagctgcccctgcaagcatgcagtactggtgttaagtccactgctcaactggcttatccctgtggattggaaggtccatcgagaaatcaacaggaatggagatatggaggaatgggagaaacacaaaatgagcctcatttaggactctttcttttacgtttatgaaaatttcaaacatacagaaaaatggaaaggaaaggatatcatccttacacctaagaaaaagaaccatccttcttgggcatcagctaatactgagtcatatcccaatttctctggttgtccaaaacatgtcttttagagctggtgttcacaaatcaggaccccaagaaggcccacatcctgtatttggttgtttttaaggttcttaatctattgtatcttccctttttttactcctgacactaccttgttgaagagaccacacagttgtcctctcactgtgtcttaaagtacagaaatatcacataccaaaaaaattatataaaaattaggcaaaaaatttagctctacaagtaaattataaccagactgttcttaattcaccaacaattaacacactgatttcatttgggacttaaaaatattctttttttaaaatttcagagacaaggtcttgctatgttgcccaggctggcctcctgggctcaactgatcttcccacctcagcctcccatgtagctgggatcacagatgtgtggtgccacctaactggcttgtacttttttttttttttttgagacgggagtctcactctatcgcctaagctggagtgcagtggcgccacctcagcttactgcaacctctgcctcctgggttcaagcgattctcctgcctcagcctcccaagtagctgggattacagatgcccaccaccacgcctggctactttttgtatttttagtagagatggggtttcaccatgttggccaagctggtcttgaactcctgacctaaagagaccggcacacctcagcctcccaaagtgctgagattacaggcatgagccaccacgcccagcctggcatgtatttttaatagtgtcttttgcactacacctgaccatatgtcaaaacaggatggttggaaactatatggcaaatttaaaatttgttctgttatttgtctacctctggatggaggacaaatgcacagtttaatgagctctacatattgtttacaacatgcatctcaaaagccattctgagggtgaatcaacagtggaatggaaaatgtcttatgtccctgtctctgtctttccccatggaattctgtatatttgtctgggactagcttagttttgcaaagtacttacaaatacaggggcacacttaatttcctcctctcccaggctggtgttcaatgagccatgagagttagatgtgaactgcaggtggcccccaaatctgtcagaagcatccttcagactttcccaacctccctgcccagttcccactggcaggcaggcactgaggatggagggagagtacttcggaacctccctttaaagcacagaacaaagccatcgtggtggaagctgccccaaaagtaatctacgttttgtgtgattttgtttttctaagagccaagaaaattttgaaaaacagtaaaaataaaggggcaatctatattgccagatactgaaacatactataaagctaatttctttacttaagtccagaaacagacataggtgtatatcaaattagcatatagaagtccccccttatcctcagagttcaggttccaactcccagtggatgcctgaaacttcagatagtactgaatcctatatatactgtattatttcctatacacacacctatgataaagtttaatttataaattaggtatagtaagagattaacattaactaataatgaaatagaaccattactaacaatacactgtaataaaagctacatgaatgtggtctctctctctctctctctaaacaccttattgtactgcactcacttattttgtgattgctggtaagtgaaaccccagaaagtgaaaccccagataagagaggacgattgtctcctaaaggtggtgctttacattcaagagtggtgaggcatctttgatccttatcttcccttttatttaaaaaaaaaaaaattcacatgaactaaagtgaataaaaatggcttaaaatggagaaaaaaatttaaaaacttttaggacatgaggatgagaaagccttcttaacataaacacataatggagtttaaaaagtgaaaaactgcgagcaaattggttgatcttttatgcaaatgctctcaggaaagaaaggatactatcccactaaaaaattgggcaaagaaaatgcagacacctcacaaaacacaaagaaacgacaaatacaaaaatgttctacaccttggtgctgaggcaacacaagggagggagggatcgtttctcaatgacaatgaggaggagcacaggcactggacagcccaggcagaaggatgcaggcagcctcctctctacctcccactcaaaaatgaactcaaggtggagcaaacacttcaacgtaagagtgacaatcgtaccattcacagaagaaaaccgagaataaatcttcacgaccttggattaggcagtttcttactacgtcaccaaaagtgcaagtgataaaagaaaaataaactgatttcataaaaaattaaacttttatgcttcaaaggataccattacaaaataatgaactgtgaaagtggaaagtgaaagagaaaatatttgcaaatcataggtctgataaagcacttgcatctagaacatattttaaaaactcttacaactcagtaataaaaagactaatagcccaattaaaaaataagtgaaagctctgaacagttatttatgcaaagaagatacacgaatggccaataagcacatgaaaagatgttgaaccttattagccattagggaaatgcaagttaagaccacagtgagataccacttcacacccaccacatggctataataaaaagtcaaatgctaaccaatagcaacagggtggccaggacgtggagaacctggaatcctcatacattggtgtgggaatgtagaaggcagcagccactctggaaaacagtctggcaattcctcaaaaggtcaaacataaaattaccacatgacctctgcaattcctattttaggtatacaaccaaaagaactgaaaatgcacgttcacacgaaaactgtaaaaaatgttcacaacagccttttacaaatagccaaaaagtggatacaattcaaatgcccatcaagtgatgaagggaaaaacaaaacacggtgtataaccaaaacggaatattattcaaccgtaaaaagggaagtaaccacacatactacaacatgaactccgaaaacatgcttcgtaaaagaagccagtcacaaaagaccacatattctgtgattcaatttctaggaaatgcccagaatagatacatccatgggggtagaaagactagcggttggctggagatgggggttcaggggaaatggggaataactgctaatggtactaggtttctctttggagtggtgaaaatgtttcagaattgactgtggtgatggttacacaatatactaaataccactcaactgtacacttgaagcaaggactatatggtacatgaattatatcttaaaaagctgtttttaaaaagttcttactaatcactaaaggaatagaaataaaacaatgaggcatgtttaatctatctatatggccaagatttaaaaaatgctaattggtattgatgaggatataaagaaatggcaattctcaagtactctggcaattcggtgtaattttggaaagcaacatgtatcaaaaagaaaaacatgcatttcttttgacagtaactccacttctcatgattcattgttaaggaagtaattggacaagtatgttaaaatatgtgtgcaaagataatgcatcacattctgattaaatattgaaaactggaaaaaattctaaatgtctattaaaggtggactaattaaacatcctatggctacagacttataatgaaacaagaggcacccatgaaaaataaggcagacctcaaataacccctgtcaaagccatgtggagcaggggaatgggccagccaagccctgtctgaatttgtgggagaaaacatccaatgactgttatttaaggcaacgaattactaacaacaataaggcagacctttatgctttaacaaaaagctgtttaagtgactactattttaataccaaaaagcattccattttggggggaaattcccgagaaaacaaaatcagacgaatcagtaagaaaatgatgaggaactaaatataaaaaattaaattgtaaaagtatgggaaggtaattaaggtgggtactttgttacgtaaaggcagtaaaggctttagtcacagaacataaagcagtgttcctcactattaccagtaaaaattctttttatttttggagacagggtctcactgctacccaggctgaagtgaagtagtgcaatcatggctcacacagtctcaccctcctgggctcaagcgatcctctcacctcagcttcctgagtagctgagatgacaagtgtgcatcacgacgcccagctaagttttaaaattttttgtagagacagagtcttgccatgttgttcgagctggtcttgaactcctgggcagaagcaattatctcgccttggcctcccaaagtgctgggattatagctatgagccattgcacccggccttccagtaaaaattcttaaaatacagatcctctcatttttcccctaagagacgagcctgctttgtttttttaatttagacttttcccaatttttccaaaattaacatatatgtgcctttacaatgagaataaagacatttaagaagccaggagtggtggtacacctgtagtcccagctactcaggaggcaaaggtgggagaactgctggagcccaggagatcaatgctatagtctcccacgactgtgcttgtgaattgccactgtaccccagcctgggcaacatagcaagaccctgttgctaaaaaaagacaaaaacaaaatcaaaaacattgagaaaagagaaaaaagaacaaaagccccatgggcgactccaatgcaggagaagactgtacaattaaataggtgtgagaggctagattacataaagactggcattctttctatgactaaaatcactaggaacaagtgtaagggccatttatgaactaggaaaaattaaatctgaaagacacaagacaaaacaaatcatgatggagctattattttttctcctcccagtccatctttattcctcactctgtgccaggctctgtgttcagggtccaaggtacagcagttcattgaagacacacacatccccgagggaagagtactctggggactagccacacacgacaggtgaagtaactgaggccccaaggaaagggccttgcctgggtgatgagccaaccaactagcagcaaagccccaatcctgcagctctctgtgcccctcctccacagagggctgaccaccttgcattataaagtgttctaagagaatctgacaggaaaactggtgaacaacaggaccaaagcaactcaaataaatgcctatgtctctaaacataagcactttaaatcttactcatgagagaaatgctcatcaaagtaagatgacatcattttctcctattaaaggacagggtgggctgggtgcagcagctcacacctgtaatccagccctttgggaggccgaggtgggcagatcacttgaggtcagcagtttgagaccagcctaactaacatggtgaaaccccatttctactaaaaatataaaaaattagctgggtgtggtggcgcacacctgtaatcccagctactcgggaggctgaggcaaaagaatcgcttgaacccaggaagtggaggcgtcagtgagcagagattgcgccactgcactccagcttgtgcaacaagagcaacattctgtctaaaaaaaaacagaagaacggggtaacagtccctagccttgggaagatggtgtgatgctggtaatcgggtacatggcttttgatggaaagcactataatggtatctgtcagaagccttaaaatatatgcaatatgtgtttctggagcgaggatcatttcacatgcaatttgtaatgtggaaggaggaggtgagtatggtgtgagagccatactggtttaaaccttagtctcccctgcctgttactattttgagccactgagtaaagggaggttaacacaaagctcactgagcccactcaccccacccatcatcttcactcggtttagccacaggctctttgcatgtgttgcttattacataattggcagcctcaaccactgtgtatactccactgtcaaactacctttaaaagcaaactctttatatttactctggtattccttaatttttttttttttttttttttttttttttttttttgtgacagagtctcgctctgtcacccaggctggagtgcaatagcatgatctcggctcactgcaacctctgcctcccagattcaagcaattctcctgtctcaccctcccaagtagctggacttacagacgtgtgccaccacacctgactaatttttgtatttttagtagagacggggctttaccgtgttagccagactggtctcaaactcctgacttcaagtgatccacccgccttggcctcccaaagtgctgggattacaggagtgagccaccgcgcccagcctattccttaaattttaaaagaatctaacatgcatttttattaggactgttattgctacataggttttgggtaatttagccccaatgccatttttcctatagtgcctgtattctatgctaaggacataacagagatgtgcatacagaatgtggataataacgcttatcctcacattcctcacaaaaaaataagtcattttttactgtgtgtccaagagtaggttatcatgtcttcaaaggaccctgtgttccaaacagcaagagactgaccaagaaagaacaaggaaggacagtgtcacccctctgtgcagccaatgccccggatccacaccaggctgggattcttgctgctcgtcctcaaccttccacatcgcaacagggtccaaacctatgctcctcggatactcccccacccacctggaaacctgactcctccacaacctccacctagaatcagaaaacgataccaaagcgaacatcaggcagaacaagggctggctctgcaataaccacttgctcaggttccctcataaggacctacaacagctgggtatgcaaagctgtggcgccataaaacaaagaaaatgctcattaaatgtacacagctgccaacctgggaagaagcgataatcacctcagaggtgataaactggtaagaaacacaacatagctattttcatagaggaaatgtttcttgtgttttcttctttttgctttgtgtttattgattttttttaaaaaaataagattatcttaaaatttaagatctaaattcaggccgggcaaggtggctcacgcctgtaatcccagcactttgggaggctgacggcggggagggggggggggggggtggatcacgaggtcaggagttcaagaccagcctggccaacatgccgaaaccctgtctccactaaaaatacaaaaattagccaggtgcggtggcgggcgcctgtaatcccaactactcggaaggctgaggcaggagaatagcttgaacctgggaggcagaggtggcagtgagccaagatcgcgccactgcactctagcctgggcgacagatcgagactctctctcaacaacaacaacaacaaaaaaaacaaaacatctaaattcaatagggaaataatccagaatgatttataagtaatcttaaagctgtgatttaaagtagaaagcaaatggctaaggggagcaggaaagcctgagcccaaggccaaggctcagggtaagaaatgtggccaagggcgagggacttgccactccctccccactctcttcctggacccacagccacagccttcagaacccagcattctacctagaaggggtgggagttacttgttacagcacaaagaaaacctataaggtggccgggagaggtggctcacacctgtgatgctagcactttgggaggcccaggtgggtggatctcctgagctcaggagtttgagaccagcctcagcaacatggcgaaacctgtctctaccaaaaaaaatacaaaaaatttgctgtgcatggtggcacgtgcctgtggtccaagctactcgggggctgaagtgggaggatcgcttgagcctgggaggaagaggatgcagtgagctgaagactacaccactgcactccaaatggggtgacagtgagaccccagcttaaaaaaaaaaaatcacccgaccaaccaaccaaagaaacaacaaaaaagacaacctgcaagatagaagatagaaggcaccagatctattcctacggtcaaagtgactgctggaccagaccaggagtcgaatgaccaagttcaagagaattaccaatttactaaaaacttaaagtttttagaatactcttcttgaatactgttgatatatacatatgtattcttcaagaatacttacgacatttacaggttctaaggattagagggaaaaaaaggaacataaacaaaaatttacacaattttttgataacttggcaaattagttactggacagactgtctttttggtgacgtgaacctcagggccatctcaaagggttgtggaaaaggtaaaaggaagttagggtgatttgggctgtgcagagactgatgtagctcacaccgctccagaggaagtgaagtattatattcgcattactgctagctacgactgacctcacccagacccatgacctgtgctgtttactgagttgttgcttcttgcaggactactgcggtgtatttactcggttcttctaaaagtcacttcatttctcagaaatgcctgctatcctcattatacacttccagcaggcaggcagaggctgcaatgctggctgttagtaagtatgcagcacatcttgtgtagacaaaaaacaaaacaaaaaaaaccttctggctaggcctccactttacatgagtatctttgagatgatttatgcttccacctaggaggttttgctgaagaaaggattatactaatcagactctagaaaagatactgctggttaatgggaaacccatactggaaagtaagttaaatgaccttgactgaggccttgtaatatgtggggctacccctaataccaaaggactcgctactttctctcaatttatagtttcttctcatttgcaacacatcacgtatcattattttgtgcttaaattatgtttcccagctgatacttattgccaaaaccaacggggataagtttgaatagaagatttatacttagcggcatttgaaggccctgcatacatgttttctcagtgatcttcaagatacagatggagtcaatagatgtaaactcttaagaatacacaaacacttaaatcactaataattatagacaagggcttacttccaaaccttccccacgttttccagttcaattagtgagacacaattcataatcatagtgtaatttttctatagacactgttatggtaaagagatgacatgactattcacctgccgtctccacagaactctgtaaggactctctttagtcctaggatagagggaggtattagacaagcagtgattttacaatttctacttgtgcagtgaaaggagcttgtgtataatgttagggaacacaggcatttgtgcaaggaaaccaaaactaagaggagctcatcaaagacgacaacagagagagatcctggcgttcacgaagcttaaccctatgcagccagtttaagtcttgctccctcaatgatcacaatctagacaggggacagaaaattatgaaaatatgacaaacaaggttggggagtgggggaagattagtgaagccttctgaagtactaaagtggacatgaagaccaacaaagtaagtccactccacagtgggacagctggtcacaatgccaatggctcatggtgtcagtggacagtggctttcatgatctttattccacatcagaatcactagaccagctcatgtaaaaccacgagttccagcagaacacaaagaaccgcaagcccatgtatttaagaattatctgagttataattagagggaattaggtggaattgggaaattgagaaagaaaaaagctgaagtttcacaagttaagagtgactacaagacacagattctgcaccttcgtcctaagagattgtgaatcgggaggactgggtgaggcccaggaactgccagtcactcggatgcaggtggggccatggacaggtgctgagacacagcaatggaatgaacccctggacacagggggccctggagggcatcctagcacatggcttgccgctcaggtgctaccagtgtcactgccgcagctgtgatattctggcaggacacagaagaccactctcccatcctcccgtctacacagtcttccagccacaccacccttccattcagagacgtagatcagcagctgccgtgggccctgtccacaacctccactccaaaattctgaaactcagtcacaacaaatcgtaacatcactcatgagcaattttaaataagcagcactactgatgaatctcctgcatctcaactttaatggtgaagtctccataacgcagttcttaaaaaaaaaaaaaaatcacacctacgaactccacattagaaataactcttgcaggagaccacgtgggagaacctgaagatgaggcccctctggtcactgaatgttctcagtctaagacgtatcccacttctacacggcattttgtgaaaatgtcagaaagcccaatccaaagcttaagcaagacgtcaccaagaatcaggtgggttccacttccagaaggatcgcccttgaacttctcctcctcactcagctaaagtggcttcaacttcctgcatcacaccccaccctgtaagccgatggcccatcttccctccaaggccccctgaaatggttcctgctcaacccccaacttccactcacgccctgctcccttccctcatggtggcctttctggacttctaccagttcctacgcaagccagtgctgtcccaataccctggggtctctgtggcttcttctcaactttccaatcttgcctttaaatctccttcctcaatgtggccttctctgatggctccatctaaagaggtccctatgacaatctgaaccgctgagtgctacgcagacctcttggagcagtttgtaacgatttgttttccgtggccactacaccttccatttcacaaaagtggagtgagctctgtgtcactcccagttgccttctggggagccgactccagcacctgagcccacaaaaggctttcaacacatgtgacaaattaattgaatgatcatatccttcccttcctcaatgctacccagtgttggactcctatagaaactaggaggggagaggaacaagagctccctggcccaagaccacgtggctaaatcactccaggaaagagctgcagagggcaccaggtgatttggcactggagtcctgactgggattgtttgggacaccaaatttagttgggtaccccctaaagcatgacaataaatgcaaatatgtttgacacctcattttttcagtaaatagacctagatttctttgtaagtgtttgccctcagtatgcaaaagtctgtgggttttgaggccagatataattttcaaaattcaaaaagactacaaaacacatctgaggaactgcagacaaactgtgtaagcacgggctggtgaagcattcccggcaggctcagggctgcaaaaacatgacctcagaacataactgaagagtttcaggctttgcaaacaggaagctacatagctttgaacaacccaaactcctcagagtctcaacttgctcagctgtaaaatgggacctggaatgatgtctctcaagaggctattgcaggaatatgttaaaaattacctagaaagatgttggggagaccatgtgtgctggtaccccactttcccaccagcccctctggttcctaccactatgtggagcactgaaggctgttcctgggtcaggctgcctcacaaaggcacacgtgggcacagccccatctgatctgtgccctccagggtcagtggtgtcattcagtttacccccaacaggcatttgtggatctgtctcaaagtccacaggggttcttgtgagacagtggccaccaggcaaccaatgcagttcccatggacaaaaatgctttctcagtttaccctgagaagatcagagacagaccaagaaacaggaagagagggagagagaaagagagggggtggggagagaaggggagagggagggatgaaagaaggggggggcagcgggggagagagagaggcagagaggaaaagaagtggttctacttttgtcagatgtctggaagacaagcaaaaggatgagatgctgttgctactgcttctcctaattactctccagttctccagagcaggagtttttaactaggggcgactatgccctggagaacatatgttggtgccttgagccatttttgattatcatggcttagaggagaaggctgtaagcacccagtgggtagggccagggatgctgcccaacatcctctggggcacaaccggctcacagcagagaactgccatcagtgcagaggcagaggggagcctgccccagaccaaacggctccagccctgctgcaggtgaagggaatgagcagcctctttgcagtcccgggcagaaactgcccttgacaagcataccacatctgccaagttcagccctctggagcagcagtggaggcagcagaggggcccggagcacagattctgtcactaagttgtagataaaggagaggggatggggaagtggggctggagaatattttaaaagagaaaagggagcaaaatgttaggtcagggtttccctgactgtaaaacacaagaagtcttggaaaaagcaaatgctttcactatgaagccaaaatgtgctcctggttactgagcaggcataatcgatgacagctaaccccagagtccacactactgtcctttcggtgaggactggaaaaggaagcacaggagagaacgggatctgtgtggtgccagagcccagcattatgcaggtcagtaccgttccctgaacttgaggggctgacctagggtcctctgggctctgtttcaggttctggacctgcactatcaggaacaggacaatcctggcaacaaaaagttattggaaagaaagaagcatatcaaggaaagttacaaggggattatcagaagaaataaagaagtcctaagaactttaggttgttttcacagttttgagagcaagttttgttacttgtacatacccaaccaccttttttttttttgagacagagtcttgctctgccacccaggctagagtgcagtggcgcgatctccgctcactgcaacctccacctcccaggttcaagcgattctcttgcctcagcctcctgagtagctggaattacaggtgcccgccaccatgcccggctaatttttgtatttttagcagagacggggtttcatcatcttggccagcctggcctcgaactcctgacctagtgatccacccgcctcagcctcccaaagtgctggcattacaggtgtgagccaccacgcccggcctcaaccacctttttaaatggaggtaccatacagcagggagccagcacctgacaggacacctcattattcccatttcctgattttatcaaacaagtaaataaagagatctggctctctctgcttcccagcaacctcaaaacttctaagcactgtaagcaatgttaattacttagttttgagaaaagaccaaggttatgtaagatgcatcagaggaagctggatgaggtgaaagatatataggaattctctgtgctatctttacaacaaatacttcaaaataaaaagcataaaaaaccgaaagacaaaaagcaactttttctgaacataatcctctcactttcttgtgatcttcccaaatcactatggcagctgggaaggtcaggctctcagcaacaagcacagtggggagagatggctgcttgtggtcctcacccaccaccaagagcacaccagacatgcagcactgggggtgaacaagagaggctggacaaaagaacgcactacccctcagtgttttgaaataaaagagattctattatttggtggtgcaaaaggagatattttcccattaatatcttgattcatcaggttgagaagtgataaggataattcccattttatagatttcccatctataaaatcccttcaaacctcagggaggatgaagacacgtggaatcatctattgtgttggacgtaatatgcatctcatcaacagagtattgtctttggaagataaatgtccatcatctgacggtaatacaaatcaatgggcttctactgacatcatcaagccactaacaaacaggaagtgtaagaaaagccagtgtctctggttctcatgattctggagagaaaggtaaagtgattcgtgcacgtgaattctctccatcaacaaaaggagcctgggaagagcggctgaatcatcctcacctatctctcctgttgctagctcatcacagaaaatgttaaactcatttagagagctactcatgagaaatctgggttctcttcctatcacctactgacacacttttagttatagactttcactgtgagaatggtaaaaatccacagaccacagcacccaccggagagccataacactgagggccaagggtaacttaccatatttggcacgttggtgactgaagtattcttgatatctgtagggaaggtgggcaaactgttgaccatgctctgtttgctggctaactgggggttcactccagtggctcccattggctgccctccagcttgactaaagggctgtccaaatggacttgtgttcccagttattcccatctgaaacaaaaaagaggtaacatcagctgtggtgacgcagtcaatataaaaggaagggcctgggaaatgctcacacagtttcctatgaaatactcattgcaatgataaattcaaggttcattatcaggttcacatgctccaagcagaaggctcatgaagcagctcctagcagccactctctcctcaccctaaaccccatcccgcaagtagacgagctgtttccccccaccctcagccactctcctcactcaatccctcctgccccaacaatggcaccaacacccgaagaaagtcatttggaaaacaaaaccttccaaagctgctacccaaggggaattctttcagtttaatccttaattactctataggtatctagtttctgttaggttccccatcagatttgaactaagtttccattagttcaaaacacacagtggaaatattgcaatgaaatgatacaacacctgggatctcctttaaaatacacctgacccatgaccaacatgggtttgaactgcatgggtctacatatatggaaatatttttcaatctctcctgctcctcttcaaactcctcagcctctgccaaccaagagatcaagaccagcacctcctcatcctcctcaacgtgaagacaatgaggatgaagaccttgatgatgacccactttcacttaatgaatggtacatatattttcttttccttatggttttatttatttattttaatagagacagcatcttgctctgtcgcctaggctggagtgcagtggagctgtctcggctcactgccaacctctaccgcctgggttcaagcgattctcttgcctcagcctcctgagtagctggtactacaggcacgtgccaccaggtccggctaatttttttgtatttttagtagagacacggtttcatcatgctggccaggctgttctcaaactcctgacctcaggtgatccatccaccttggcctcccaaagtgctcggattacaggcatgagccaccgtgcccggccccttacggttttcctaataacgttttcttttctctagcttacttcactgtaaagatacagtatataacacataaaacatgaaatttgtgttaagcaaatgtgtatgctattggtaaggcttctgatcaacagcaggggattagtagtagttaaacttttatggagtcaaaaggttacaagcagattttcgactggcagggtcagcacccttaacccctgagttgcttaagggtcacctctaatccactgggcaggaggaggtggcaggaaaagggcatagatggagagagcctggtaaggtactgataatcactaaccaagcagtaggcgatgggtacagagaggttatagtatcctctctaccactgtacaggtgtaaaatttatgtatttatttatattttttgagagtgtgtcactctgtcacccaggctggagtgcagtggcgtgatctcggctcactgaaacctccctctcccaggttcaagcaattctcctgcctcagcctcctgagtagctgggattatgggctcgtgccatcacacccagctaatttttgtatttttagtagagacaaagtttcatcatgttggccaagctggtcttgaactcctgacctcaggtgatccgcccaccttggcctcccaatgtactgggattacaggtgtgagccactgcgcccggcctaaaattttccataataaagttttttataaaattaaagtgcactgaaatcaaatatatactagataaaggcaggaatgggaaagaggaaccctcagctatgcttccgtgagggcctgcaaccaactggaattccttccatcaacagatgtgggccaagttccctgatgacccccagctccagcctccacaggtcaattcaggaattgccatggcaatatcccagtgcttatctttctccctgtggagaaacaacgactaattaagaaactggatgcttgggctgcctgtctttgcttttttgcaaagctctaatattccaccttctgtctattgtgtgttctgtatttctggagtagtggtcagtttgatggactgggaaggtccccgcatagggaaaacctcccaggggtgagtttccagttaagaaatcatagctcagttctctccatcagcctcacctggtgactgccacgccagcatgtccactctgggtaacttaacattccttctatggacttcaaactcctcgcctgtaagatgagtgtcttgaacaagatggatcgtattatttctttcagctctaaaagtctaggctacaaacaaatcaacactcaacacaactggccctttctgctgaaatgcctgtacagaaacacaaataaaaaccaaaggagtataaccagaaagttctagctctgtgcatttcatacgcaggtgatttccttccccatgtagtcctcctaggtgacatttctcaccttttggaaagcaatcacattcttgtcaccactaggtgctctacttaagtgaactgagacactaattcttctgcaagtccacaaaccagactcaatttcgagttcaaatgacttaatctaggcaagatggtagctcgataaatattaagcacatttctgatttgcaagaagcttccttcaactgtcatctgaaacttaattgaagcaggaatttatattttcagaaaccactatactaaattaattccatggaacacttactactctcagaatttgtcttattacatataaccaaaccgctgaaacattgttcttagaagcctagaatttgaatacaacaacacgaacaacaacaaaaaatatagttttttttcccccagttcctaaatttctgacttcggacaaaatatgacagaacacccacactcattttccctcgatcaattcatcctcgaagtcaactggtattcaccaagtgcctggtatgagccaagcccagttctgaggctgcgtagatgcatttcccacttgtcacggagctcacaccttatgtcaaccaatttgacaaacaaacaaacaaaaaatcaacgtcttttggaagtttctaattaattaggcccagcattgacaaaccaaagtgggtgacagctgaaggggtggggaagggaacaggtaaccatcttccttccacaccaaatgcccaggcaccctggctccagagaagaggggacctaagtaccaagaggccagtgtgctctgtggacctcaaagttcacctgacttgcttcagaaagtttatttccaaaacttcccagatattttgacaattttcctaagatagccctgccagggtgagtatgagtgtgtgatcagatgggtaatacttgcctggcctggggcccttttctaactggtcaatgttgtttagtgtgtgtgtgtgtgtgtgtgtgtgtgtgtgtttgagacagagtctcgttctgtgtgtgtgtgtgtgtgtgtgtgtgtgtgtgtgtgtgtgtgtgtgtgtgtgtgtttgagacagagtctcgttctgttgcctaggctggaatgcagtggcatgatttcagctccctgcaacctccgcctcccagattcaagcaattctcgtgtctcagcctcccaagtagttgagttcacaggcatgcaccaccacacccagcaaatttttgtattttttagtagagacagggttttaccatgttggccacgctggcctcaaactcctggcctcaagtgatccatacacctcaagcctccccaggtgttgggattacaggtataagccaccacgcctggccataactggtcaatttcaaagggtaacccagtgtttggaagcgctctgacagatttcatcaaaaacgtgtttgtaccttttcttcttggccatcagataagagagtgaaggaaacagtctcaacaagtttttaccttgattctcacaaggtaaaaaagatggcaagtcaaagatcatgaacggtatgtaaggaacgtccagctcatagggatctacacaattctcaaaaataggggaaaaaattcccgtctttagcctatgataaaaacaaaacccaggctacatgcaggaggttagggttcaaatctctggcaccagggccagccccagcctctccttatcagagaaagttaataaccaggctaaagaggtcagctctctcacagggtatcactgctcattgcccaggcaaggctacctcctggtgccaaaccacctcctggcagaactcaagagccatgcactggtcctagcctgcagttatgaataaaaaccatttgcttctagagattctagatttctgaattcctagtatatatctattctccattaatcaaactgagcactgtggtcccccaccctaggctaacatatacttcttaggaccaatgcccaaaatgaaatactaaaatcaagatgtctaacgctaattaatgaaaatctacatttctttaaacgtcccaacaggtacttgataatagtttggtaggctgggtgctcatgcctgtaattccagcactttgggaggctaaggcaggcggatcacttaaggtcagcagttcgagaccagcctggccaacatggtgaaactccatctctactaaaaatacaaaaattagctaggcatggtggtgcgtgcgtataatcccacgatgagccagaataaactgcttgaacccgggaggcagaaaatgcagtgagctgagatcttgccactgcactccagcctggatgacagaggggagactccatctcaaaaaaaaaaaaaaaaaaaatttttttttttttttgtaaagctggctttattttcaatggaggttcatcaggatttggtttaatgctgctagagaacctctatataatcttttaaaaagttttttcatttttaattttgggaggtacatagtaggtatatatatttatgggttacatgagttttttttacaggcatgcactgtgtaataatcacacccaggttaaatggggtgtccgtcacctcaagcatttatcctttgtgttataaacaatccaattacagtctttcagttatttaaaaatgtagaattaaattatttttgaatagtcaccctgttgtgctagcaaatacaaagtcttattcattctttttttttgtattccatacactcttttaaataaaattaaaaaagcagaacagagaataggcaactgttcagttaatagtaaaatttatatattaacaaattaaaacccataaagtatttatattctgcctcattcaacaacagcccatacatattagaagtttcttttactctgttcttcctaacagaactcctttaagcatttaattcaagtttaatctcagaaaataggaaaagttaactatagtaagtacccaaaaaaagaacaagagcttccataatgaaactaaattaaacaatgcctcacagctctcccaggtttcccattaaaaagcattgtgaccaagcgtatcaatcaattaactgtttgagaacctacttctgttttctatcacttcactcagagagtaaaaatatgtaatgcatagtccctgtgtatgataagaaaaatattgaagccagatcctgaggtttccccaactccaaccactgcccccaagaaagaatgggggtgaaactggattagccttaacatgactgcagtgtgagctctgatgaggaaattcctctttaagttcagctcaaaacccaagaacaatacaaagaggcacctgcagcaaatcctggtgctgagcctagcccatccattaaatcctgtggctgcgggtctgaactgtctggcaagtaggtgagtgaccatgatcaacaaagaggagggaaaaggcagactgtgactgtccatctactccagcagacatgggtaccacggaaagtacaaagtaccacacggctctagaggattatctgtcacataaatgtttgtaataatctatcctgaacctgttttggtcacaaaactaggataaaacttctcaccttcctggaacattctctgcatcccctgcaacataccagggatgcagcggaaggacccaaatgaatgaacacgccaaagcaccaccatgccacgcagcccctaggaatagagccaggaaggaggtggtcaaagaaccacgaacaagtgaccaaagtcaaggcacaaagagggtcagcaatggctggagggggcatcggaagaggcagcaggaacagtgccctttctatcttcaaaacttccaaacaaggatctcagctaccagttggagtggacaggagtggacagctactttcccatgctgaaaagtcgggcagaacgagaacaggccttcggagttggttttcagaatggtgaaacgggtgtgtgtgatcacagcagatacacaagtccagtctggctataaaatgggtcctctgtgctacatctttgggccaggaaaaccctgactttggtacaaggccccactcatgcccttacccagagctttccacttgcacacagaattactgacccatcagcctccatggtcacttctggctgccaacagcctcctctgtttacctcagtgtgtgggacaaatactatcattttctacttgtaatgatatgacagctatcaaaacattagtaagaaaacaagctccaggctcagaaagaccagaaagattctctccactcactaaccaggagaatctctctactactcacctaactcccccttctctcaagtgagatctagtctcgtaaaaaagttagtaaatggaaatccaaaaactaattaagggtttaaggagagagaaaagtcaagtcaagtccttcaatatcatcagaaaaactcctgatattgaaaaggggtttagactgaaaggttatagaagaaatcatcaaaatagaagtatttccccagaacaggtttctacaatagtagcaagccaagcatccattttctggctcttctgtcgaaaaggtcagagaaacacgttctttgcaggccaaactccactggggggaggcaatgggccaggcagtccatgggggcaggggagggagcatttgggtgggcaccagttcacaattttgtgtgatgttcatttctgagggtcactctaagatctcctaaagattaagaatacctgtccttggaggaaggaaacttcctccatgcccctcattttcagggaagggcaagctggttcctcatctcacacaaccctgagccatgtatgggagcctttgcaaatagtccacttccagagacatcaaccactcataagaacaaccactccgacaaacaaactcccccagttttcatctccaaacgtcattttgaagtgcacactcacaagaaggggttgaccataaccacttatgagtatgcacctgagggggccaccatgtgaccaatggggggccggggaggaggacggccagaaatggcactgcgacgcagaacttgacctagagtcggccaggccatcagaaactctcagtgcaacaagtgccgagtttgatgtttaggttttcttttctttttttttttttttttttttgagatggagtctcactcttgttgcccaggctggagtgtagtggcaccgtcccagctcactgcaacctctgcctccctggttcaagcgattctcccgtctcagcctcctgagtagctgggactacaggcgcgtgccaccacgcctggctaatttttgtatttttagtagagatggggtttccccatctttactaaagaccacgttggccaggctggtctcaaactcctaacctcaagtgatccgcctgccttggcctcccaaagggctgggattacaggcgtgagccaccgcacctggccttaaggtggttccgaggagcccactaagtccatttttgcagcagctgactacttcagcagttttcctcacacctcaagacacgcctcaagccacaatacacagcagaccactcagaggaagtgggctttggggggtgtcactgatgctggtcaaaaacacacaaaaaggaaccaaaatatgatgttcagtaataagctttgcaaagacaagtggagaaataagactagctaaaacctaccactttataggtgaggaaggggccccccggaaagggcagggacacactaaatcagcctgagaactcagcagacgctccccacagcccccactagaggcttcacccttgcacgggggctcatcacctccccgcttaacgcaactctgtctccttcaagttcaccggcctcacgccagtagccgggacagagacaggatctgtctatgaaaacagggtggcaaagtgcggcctgtgggccaaaggcagcccaatgcctctttctgaaaaaaccaaatttttcttattggaacacagccacaaatacaatttcatccatagaggcaacatgccattgcggtcaactatgtgggctctggggatatctgaatggcgactccaccacttgctagggatttacttaaacctctctgcaccttggttttatcatctgtaaaatggagatcacagcacctcctctaagggttgcgtgagaactaaacaagttcctatatgcgaagcactaagatgagcagctgcgacagtgagtactaggggtgaggaggtgagagacagctttgggagcaatcattctacactacatatgatttctttcctgaccatgcttaaacagtaatgaaataaaggaatgctttacagagaacgtgtaatggtggagagtggttccaacatgtaggacgatagggagaggccggctgggattactggcatttggattatgggacattttcagaaaaacactgtgacaacaacaatcttgtgcatttgctatttgtagaaatactctgaaaaggccattattttctaattgtcctggtaaatcataagcgtttccagttttcattctacattgttttttagctttaagaacaataaactcagggtgtttatttcaaacttaaatcataagcaataatgacatatgattaaaataccctagcctaacattcttgggttaaaatttaaaccaaaacatagaagaactgaacatgaaagaacactcccacgaaaaaagaaatggatgcaactaccactcataagccagccacgacacagcaacaaacttccatttgatgtggcttcagcctaacctgacatatttttcaagctggagtttttttagcatctttctccacaagttggtatacatgtaaaaccacaaattcatataaggtgtaaaaaaacaacacagttcagtacatcaagagcaaaagtttgctaaataattgaatagccagaaatatttatcattttcaatgacataaagaaccagaaccaccccagactacggccagatcatttgtaaagccaaaagcattttctcttggcaacctaccattgttggaagaaagccaagaaaagcagttttcatggaaagacatgactgcattcagttgtctgctatcactcgcttgctcttggaatccttccagtatatcaacttggtaaatatagagtaaggagaaatacgccactgattacagtgccacagacagcacttggctgtccagggtgcacctggggcaggagagttgggctaaagcacctgggcaggtgaacagcccaccttccccctcaattgaagtcttatgtgctgccaacctggaatgcattcaggaaaatgtgcggcccccaggtctgaacatttgccctggaaggataagtcctaactggaagactagtaacaaagtatttagcaactctcactgtatttcatttggataatgtctttcaagaagcattccttgtcttcttgggttaagatcctcccaggcacgaggattgcttgaggccaggagtttgagaccaacctgggcaacgtagcaaaacccccttctctacaaaaaataattagccaggtgtgacggcgtgtgcttgtagtcccagctatttcggaggctgaggtgggaggactgctcgaacccaagaggttgaggatgtagtgatccataattgagccactgtgtacacacacacacagccacgaccagaatgtgacttagaagaagagtggaaatgcaggcctgtatcctcactgttagtcacccaactgctccagaaacttctagcagtgaaaccggcaccctaatactattggtacaccttggcaggtccctacagttagagacgctggttccccaaggtgcagtctgcattaatgcataagcaaaaacgacgggtcaaggtcactggagaaactatttctaatcctgtttctgcccctcatcagccatgtaactgggacaaacctcttggtccctcagttttccttatctataaaataggaagcatttagattatcattaggtgatctttaaagttctttctgattctaaaaatctgatgacattttttatttcaaaccatcagtgcttgattcacataaaggctacactcctgggagatgttgctactcgcagtgagtgacaactgagggttctgagtctgcagacttaactgtcaacccctggactgggaggccctcaccatggcaatcctccctgtggggcccagagtggatggccagcagcctttccaggagactggggagttcgtggagcaaggtcttccatccccactgcccagtgactgggattccatagccccgcaccctggacaccacttcccagagtattttacacaaagaacagctaatctgaggcaaaatgatccaagaaaagggagataaaatttgaaggcactgtttctcctaattcttttaagtcctaatatttttttttaggtagaagagtagactctcttcaggattaagtgcccctttcatgccaatccaagccaacttcacacgggcaatggaaaaagaggaaaaaagaagaaaaggtgataaaaaatgtgagaaaaattttattctataaagactgaatcttggctgggcgtggtggctcacgcctgtaatcccagcactttgaaaggccaaggcgggtggatcacctgaggtcaggagttggagacccgcctggccaatatggtgaaaccctgtctctactaaaaatacaaaaattagccaggcatggtggcacacacctgtagccccagctacaggtttaggcaggagaatcgcttaaggagaggcttaggcaggagaatcacttgaaccctgggagtaggaggttgcagtgagccaagattgcaccactgcactccagcctgggtaacacagcaagactctgtcacacacacacacaaaagagtgaatctttgtaaagacgaaattaatttacactgcaatccaactatggcccagcgggacagagggcctcaataagtcacctgacaaagccacccgatgttttccccagaccttccacatagagcgctcatgcaaggcagagaagcacctttttccacggatctacactccactcactcataaaaagggacgtcaagaacgcacagtaaaggaggcggcaataaaggaaggcgtgaatgtgtataggtaacgcaacggttcagagaaaaggagaaataaagatcggacagaactcacaaggctttaagacagacagccactgactatttctagtaaaatttaaaggagaaagaaagatgacatttcagaggactgtgttcctcctctactttggggcaggaaaacagaactaattcttgaactgggcaggccgtcagctctactgtgggagcaggaagaacagctcgtgggatgagccctgggaggtgacgtgaggctgcctgagggttctgtgtcatctcctcatggcgaatctcctggacctcagtggcaagaggaggactgcagcagccaaagaagatcttgcccagcttattaaatgccataaatctaaaagtgtaaagcacactcaaagatatattgttatcaaaaatatgtggctctacctcttaacaaaagctgaggtgtacagagtcctaacaaaaacataattagcaaagtaaagtgctcttaaatacagtcgtccctcctgactggtgatgtcagcgaggagacaaaacagggaagggtgctgagggagccaggagctggctcagtccgctgcagtctctgtgccttgtttcgagagaatacacaggaagcgcctagaaaagggagaggggtgaggtcaacataaggaaccgctggtaccacaaaggtgactctgattactgacagagaaaacgttccttctaagttacaaaattaaaaagaaaaaaaggacacaaatgtataatccccataaaacacacacctatacacagcaaggaggacagaacaccaaaatatttcatagtgatttctctggatggcttgtaagcaaatgttctttcttaatactttctattatgactcatattctctatacaaagcattattttaaggaggaaaagttgtttcttaaagtcgttctctactcaaacattctgagtgcccaaaatggcaagacgaccctgttaggctgcacaactctacttaaaacattaaactgtcattaaacactgaataaaactaggtagatcaaactgttggtgacagagattgccgctgagtggtaactgaaatcaaatttgccctggtcacaacgtggccgcgtaacctgtcaagctttgctcgaatgccttatacctgtggctagaagacatttcaaggagcctcagcacaggcccaccactctctgcagggagggcgggaggaaagaaaatagaaacaaacaaggtcgacacctactcaggacacaaaaagccaggcgtggctctaacagcttctgctttttctcctcagacatcccacgtttggctcttggtaccacaaaggtacaatgatccctgctgtttgaactctggttcaaagtttaggcagcaagggatgccccttcatcctgatctatctggcctgagcttcagggagcagcaagcaagagactggagcatgagggatggacctgaatgcatttagttcccaagtttccatggcaaggcacacttctagtcagacagttcctatcgagcagcagaccttcccagcaaggagaccactaggcagctatcacgttgccacccgcccctagctctcttcagcagtgatgctcttatctttaggacactggaagttgaaaaggctgtggcaacacacacacacacacacacacacacacacacacactcatctaggaacatgaagtgtgttaaagtctttcaggagggaggtactgtgcagtggtgacacacacagggccacgttctcccaagccaaaggtaagagacacaagccacaaggaaatcagacatgtgcggttaacaggtgccaccaacatcgactgctaaatggagtttcaaaagggagaggggtcctgactgggaggcaaacaagggggtcaagagctgggcctgcaaaggcgagctaaatggtaacagacacagttgaccgaggctacgcctctgcaacctcatcataaacaggaatggggaaaaacacctctgggatgggcctggatagccatgaatcttgcagtttcaaagtctatctctaatcaaataatctaaatgtccacaaaaaagtggtaggatgtgcagccacctggctgggggttaactgacagagctaaagtgttaattaaaatgaacacggaaactggaaagctcaggagagagctggttattcatactgatggttagtcacagaaggcaagcactgtctcagaagagcatcactcataacatcgacagacaggaacaaacgctgctctgatctctgcattcaaatcctgatggactcaagtcaagagtgatggcctcccacctctggccactcccatccccacacgcctttgcctcaccgagcccacacgcggcggcagcagcacgcctaggctgaaccatacccggtcaacttggagactacaactgccaagcaggccggtgcttcccgttctactgtaactctctaagcaaaatgtgccaggtttttaggggagaaaacacactcagtcccctccttgcactgtccccaatctctacgcctcaatcactccctgtgcctcaacagtgtgcccactcatcgctgatatatacactcctgtttgccattcacgcagggccgctctaacttgtggtttctggtttaaatgggatagcacatgggaaaatgctctgaaaactacaaagcactgtgcaatcttgaggtggctctaagatctctttgcaaaaatagagcacagaaaatctctaacatgagacaggattctataaaatgaacagactttctacagtacttaaaacaggcatgcatccttactacaataatttaaagtcaataactgcaagacaatgtctaaagttggcatttctcagtattatctatctcttgctttgttctaggaagagtttcaggtggcttgttttccagttcattcttcattacttggtagaaaaacatgaaatgaataatatgactcactgctaagggcattaagtttttacttagtaaataaaaatgcaatccctgcaatcacactacttcagaccatgcgccattttttgaaagccacaaaccacagtgccacattcttatccaaaaatatgtaataattacacagatgtatatctatggaagtatggccttggaattgcaattagttgataagcatttatacttgctggcaagaaaatgtcactgacattcagttcccagctctaagtggagggctctggacactttgcctcagtagagcactcagaaaaggggttcagtcctcttctgacaaaaaaaaaagaaaatgagatctacatcacagttagaaggcattttttatcaagtaatcaaagatgattaaagatgctggggggaaacctaatttgtgagtaactttgcctttattttaaaaattactaagacaaaatctcttgtttctgagattcagccacaccatttgaacctcttataagagacaaagttttcattaaaatgtcattgtgtatcttcaaaagcatagagaaaactgtaacggaaaaaaatacaaggaagaattcataatcatatgaacaggttagaataaatgaatcaaatctttatgtatgaattttaatactgttcttaaaaaagcaagatgaggccaggcatggtggctcatgcctgtaatcccagcactttgggagcctgaggcaggtggattgcttgagctcaggagtttgagactggcctaggccacatggcaaatctccatctctacaaaaaacagccgggtgcagtggcatgagcctgtagtcccagctcctcaggaggctggggtaggaggactgcttgtgccccagaggcaaaggctgcagtgagccaagataacatcactgcactccagcctgggtgacagagccagacccagtctcggcgggcggggagcaagatgaatacatatcatgtaaaagacactttcatttatcctgttaaaattgatttcatttagtaaaaaactatgaagagacagatctcccacactgaagaagtctaaataaattatgtagacactttgcctaaagaaggtagaatataaaccccctatccttaaacatagtgagtccttccaaagaggatggcatggaggagggaagcggagcattacagtggagaaacctgagaggcacgacctcaaccaggtggctgtgggcagcatcaaccatagtggtaaagtcaccatgacacaacgcaccctcaaagtgacgtggtaaaaatggcccttggctgctgagatcttcctttcaaaagcccataagcccagtcttaccatgagaaaaacatcagacaaatctgtacagaggggcatcctataatacacctgactcgttctcctcaaaactgtcaaggtcattaaaaaccaaggaaaggctgagaaaacgtcacaatcaagaggcgcctaaggagacaggacgattaaaagtaatggggtatcatggatggtattccacaacagaaggacattagggaaaattaaaggaaatttgattaaagtatggacttcagttaatcacaagtatcagtattggttcattacttatgacaaacacaacacaggaaaggtaagaggctaacaataggaagtgcgtggatggtggggaggagataaagaaccctgttgtactatcttttaatttttctgtaaatctaaaactgttctcaacatagagtctactcagtcagttgcaccgcctgtagtttcatctactgagaaagttgaggcttgaggatcgcttaaacccaggaattcaaggctgtagtacactataattgagcctgtgaacggccactgcttgggcaacataatagcaagatctatctctctaaaaaaaatttaagtctacttaaaaaatgaaaagaaaaaaaaaaactatgaaggaaatgtgataagtatcaacaggcattaattctaatgaaaacacagatgttggttatactatcctttgttcttgtgttgaaaatttaaaaaactcagaacataaaaatcaaacctttccttgctaccataatgtaagaaaaatatttttcaaaaagtgatcttgcttactttttattttattgattgattgactgagacagagtctcactctgttgcccaggctggagtgcagtgacgcaatctcggctcactgcaacctcccccttccaggttcacgagattcttctgcctcagactcccgagtagctgggactacaggcgcccgccaccacgcccggctaattttttatatttttagtggagacggggtttcacctagttagctaggatagtctcgatctcctgacctcgtgatccacccacctcagcctcccaaagtgctgggattacaggcataagccaccatgcctggctacttactttttatttttttagagacagggtctctctgtagcccaagctggagtacagtgatacaacaatggctgactacagccccggcctcctgagctcaagtgatcttcctacctcagcctcctgagtagctgggactataggcacgtgccaccacacccagctaatttttaaaatgttttgtagagatggagtctcactgtgttgcccacactggtctcaacctccttggctcaagcaatcctcctgcctcaacctcccaaagtgttgggattgcaggtgtgaaccactgcacctggccaagatcactttaaaaaataatgtttaagaaaattaattatgctggcctcttgcacataggccaaggcacatttttctagccagaaaagctgacttcttttttttttgttttgtttttgagacagagtctctcgctctgtcacccaggctagagtgcagtggcgcaacctcggctcaccgcaacctctgcctcctgggttcaagctactctcctgcctcagcctcccgagtagctgagattacaggcatgtgccaccatgcccagctaattttgtattttgagtagagatgaggtttctccatgttggtcaggctggtctcgaactcacgacgtcaggtgatccacccgcctcggcctcccaaagtactgggattacaagcgtgagccaccatgcccgtcgaaagctgacttctttatgggtcttacaaaaattgcttggctgaattagtatttcagattaagagccataacccaatcagaccacaggcaaagcttacagcatacaagggtatgtttctaaaaaggaataagcagtaaattctttcatttgacaaaaatactcctgggaaattagactcactctccaggttacctgttctataaatttcgtgcatgggggaaaacctgacccacacacagaaaataaggtcttatgtatttcaccatcatagtttgaatacagctgtattacagacaaaatgatgcagtcgaaaaaaatacaggcttggagtcaatcacaggtggattttaagtaaaattctaccactttcaaacatgtgtcgtcttgaataattttctgcataggcaggaaagtggttcagaatattttactccttgttataaaagacatatggcacccacctcacaggattattaaaaatgagaaaaagcaagatcatgtttgcaaagcacccagcacagtgcccagtacaataggcatgtccttttctgctcttcctcttactgttattcaggaagaataaatatagtaattgttatccttgctcatacctggatcacactgaaattttatgctatagtcatatacataattttgaaaaatgcaaaaaaaaaaaaattacatggtaatcaacataaaaacccttagatattttaacttggtgacagatggacagcaaattactgtctatggtaatttgtataaatataactctttttaaaatatagcaaaaatattttggaaaagttggtccttgaagttatgatttggacccatttacattaagaatgttagatgtggcacttcccaagtttctacagtgaacttaatcctcagacgattcagaagatgagagataacgtttaaagtgtgaaatacacagtcactacgggacaaccattatatatcataatgttacgttcacaccattaaaatggagagtatctcccagtgcgaccacacacaacaatcacatcaccaacacctcctagggcttactggagctgtaactaagtgtgcaggactacgaaggaattgtgaattgaacagattccagaggtggcacagtgctagagacatagaagttctgatcagtcggagtttcaagatcttgctgaacatcccaggaattaaactgagaccccaaggccatgtctaaggaacagggcttcaagacctgccctaagttaagtttaaaaacaagctttgagagaatcaaactgatctgagtaattaagagcctgccagaacaaaacaaactaataaaggacaataaaacccatattcaacaacattatcatccaccatttccactacacagtctaaaagtactggacatgccaaggagcaggaagatgtgacccataaccaggaattctatatttaaacaaacaagactgtaaatgaaacagatacagagatgacagagatgttggaatttgcctctacaagaagagcaggaagggagaaaaaaaggaacaaaacacagaagcagcaaacagaaaacaaataagatgagaaacctaaacccaacaattatcaacattaaatataaataaactaaacactacaattaaaagactaaggttatcagaataaattaaataagatctaatgctacgctgcttacaagagacatacttaagagacaaagttaagagtgggctgggtgtggtgactcatgcctgtaatcccagcactttgggaggtcgaggtgggcagatcgcttgagctcaggagtttgagaccagcctgggaaacatggtgaaaccctgtctctactaaaaatacaaaaaaatagccagacgtggtagtgtgtgcctgtggttccagctactcaggaggctgaggtgggaggatcacctcacccggggtggggggcagaggttgcagggagcccagactgcgccactggactgcagcttaggtgagagtgacatcctgtatcaaaacaaaacaaaacaaaaagagtgaaaaaaaaatgtgaatgctaatcataaggagtctacattaaatatgagaaaaaggagataaagacaaagaatattaacaaaaacaaatatttcataatgataaaaggctaaatttaccagaggcattacaatccaaaatacatattaacctaataaaacagtttcaaaacacatgaaacaagtacttacattttgttctgactaaatgaaaaaccagacaaacctaaaattgtaattgtagattttaataatcctctcttagtaaccaatagaacaaaaaaatcataaggatttgaacaccatcaaccaacttattctaatagacaattatgaaacatcacatcccacaactgtaggatacacattctatttttatgagacagagtcttgctccgtacccaggctgaagtgcagtggcgcgatctcagctcactgtaacctctacctcctggggtgaagcgatttttgtatctcagccccctcaagcagctgcaactacagaagcgcaccaccaagcctggctattaattttttttgtacctttagtagagacaggtttcaccacgttggccaggctggtctaaaactcaagtgatctgtccgccttggcctcccaaagtgctgggattacaggcatgagacactgcgcctgatcattcttttcaagtatagatagaatatttgtcaagaaaaaccatttgctgggccgtaagacaagtcttcaatttcaaaggacaaccaccatacaaagcatgttttctgaacacagtggagttaaaaaccaacaataaaatatctgcaaaattcctaaatatttaaaagctaaacacacttcagcataatccatgggtcaaagaataaatcacatgtaaaatataaacatattttaaactaatttaaaaaatgtattaaaatttgagatgcaattaacaacagtatttggggtacttttttatgtttatggatttaaaggattcaaagaaatggggaaataaaaaagatgcatagggtttaaggagaaatttattgcccaaatgttaatattggaaaagtctaaataaccagtgatacaaacttctaccccaaagaaaagccaacataagcagaagaaaataaagacagaaataaatgacatagaaaacaaacaagaaaaggctgacaacaacaaaagctggctgtttgaaaatattaataaaatggacaaaccccaacctagatcaatgagagaaaaacaagagagcacaccagacattattataaattctatccaaattaagaaaagagtacagaggccgggcatggtggctcacacctataatcccagcactttgggaggctgaggcaggcggatcacttgaggtcaggagttcgacaccagcctggccaacatggcaaaacccctcctctactaaaaatacgaaacttagccaggcatggtggtgtgcgcctgtaagcacagctacttgggaggctgacgtgggagaactgtttgaacccaggacgtggaggctgcagtgaactgagatgatgccactgtactccagcctgggcaacggagtgagactctgactcagttaaaaaaaaaagaaagaaaaaaaagaaaagagtagagaaatgttatgaacaccttcatgccaaatcaattcaagaacttaaaatggatatattactcaaaaatacaaattaccaaaattagcacaagaagcagaaaatttgaatagctaatacctattagctattcaaatttaaagtaactgaatcataattttaaaaccttcccacaaggaaaactccagacctggatcgcttcactggtgaattttatcaaacatttaatgaataaataatactaatcttaaatgaactttcagaacaaagggaacaattcccaggtaacttcatgaagccagtatattattgttatcaaaaacaaataagaacactccaaaaaaacagaaagttatagacccatatcactcatgaatataccaatcatgcttcgcccaaagacaaggacatcttctgagaaaagtgtcattaggtgattctggtcactgtgggaacttacactttgggtgtacttaaacaaacctagatggtgtagcctactacacacctaggctgtatggtatagcccactgcttccaggctacaaacctgtacagcttgttactgtgctgaatactggaggcaactgtaacaaaattgtaagtatttgtgtatctaaacatagaaaaggcacagtaaaaatatattatagtcttaaggggccactgttgtatatgtagtctgctgctgaccaaaattcgttatgtagcacattactgtggaagcataaatcctgaacaatattttaataaatctgatccagtaacatataaaaaagataacactccacaatcaagtggggttatctcacaggaatgcaaggctggttcaacactcagaaagacgtaattcacattcaaagaaaaaaaaaacaccctatgattcatctcaataaatgaaaaaagatgtggcaaaattcagtaatcgcttatgatcaaaagactcagcaaactagaaacagaattcctcatcctaatgaatgatacctaaagcctacaactaacattatacttaacgaaaggctgaatgcttttttcccacagatcatgaataagacaagggaagaacactgtcattggttttattaaacattgtgctggccaggcacggtggctcacacctataatcccagcactttgggaggctgagatgggcggaccacctgaggtgaggagttcgagaccagcctgaccaacatggtgaaaccccgtatctactaaaaatacaaaattagctgggtgtggtggcgcaagcctgtagtcccagttactcaggaggctgaggcacgagaatcgcttgagccccagaggtggaggttgcagtgaggcgagatagcaccactgcacttcagcttgggctacagagtgagagtccatctcaaaagaaacccaaaacaaacaaacaaaacattgtactagaggtcctaggcagaacattaaagccagaaaaatgaataaaatgcatacagatgaaaaaggaagaagcaagctatttttattctcagacaacatgtcccagaaaattctaagacatcttatagaattaataagtgagtttagcagggttacaagatacaacattaatacagaaacatttattatacttctccatactagcaacaaataatggtgtaaaacctaggaattaaacagaaatgaaaacgagaaactaagcaacctgactttaatacttactgtaaagctaaagtacaactatgaaagtttcatctatgaaacttttgtgattgataaaattgacttcattaaaattaaaactgccccttcaaagataatgtcaagagaatgagaagacaatccacagactgggagaaaatatgtgcaagaaacacatctgataaagatctatttacaaaaatatataaagaactctcaaaactcaacaataacaacctgtttaaaaaatgggccaaagaccttaacatacacctcatcaaagaagacacacagatggcaaataagcgtatgaaaagatgacccacatcttatcacagaaatgcaaatgacaacaatgggataccactatttgcctattagaacagccaaatccagaacactgtcaacacgaaatgctggcgaggatgtagtgcaacaggaactctcattcatcactggtgggaatgtaaaatgatatagacactttggaagacatttttgcagtttctcacaaaactaagcatactcttaccatatgatccagcaattgtgctcactggtatttacccaaaacaggtaaaaacttaaacctgcacatggatgtatatggcagctttattcataattgccaaaacttggaagcaaccatgaagtctttcagtaggtaaagggataattgccatgaaaagacccagaggaaccttaaatacatattattaaatgaatgaggccaatgagaaaaggctacacactgtgtgactgtaactttacaaaaaggcaaaactatggagacaatcagtggttgccagggttttgggaaggagagagggatgaagaggtgaaacacagacggcttttagggcagtgaaaatactctgcatgacactacaatgatgcacatcattatacatttgtccaagtccacagaatgtacaacaccaagagtgaaccctagtgtaaactacagacttcggattatgatgtatcaatataggtttattgattgtgacaaactgtaccattctagacagcggagttggggaggatgttgaaaatggaggagactatgaactaggagaacagggaatagatggaaaatctctgtaccttcatttcattgtgaagctcaaactactctaaaaaaacccaaaatctttaaaagcttttcttgggccaggcgcagtggctcacgcctgtaatcccagcactttgggaggccgaggcgggcggatcacgaggtcacgagatcgagaccatcctggctaacacggtgaaaccccgtctctagtaaaaatacaaaaaattggccgggcatggtggcaggcgcctgtagttccagctactaagggaggctgaggcaggagaatggcatgaacccgggaggtggaggttgcagtgagccgagaccacgccactgcactccggcctgggcaaaagagcgagactccttctccaaaacaaaacaaaacaaacaaacaaaaaagcttttcttaaaaaacaaactaaatgaatagaaaaatagatcaatagaacagactagaacaaaggtacagggattttttttttctatgaagggccagttaataaataatttagtctttgcagatgacctgcggtttccatcccagattgttttctttttaaacaatccttaaaaaatataaaacccatccttacgtggcaagccatataaaaacaggtcatggggctggatgtggttcatgggctatagtttgcccttagactacagagtccagaaacagacacctccttgtacagtgaatttcgttgctagttatttatctaagagaaatgaaaacttctatgcccacaaaaaaagctgtacaaaaatgctcacagaagatttcttctttttttttttttttttttttgagacggagtcttgctctgtcgcctaggctggagtgcagtagtgggatctcgggtcactgcaagctccgcctcccaggttcacgccattctcctgcctcagcctcccgagtagctgggactacaggcgcctggcaccacacctggctgattttttgtatttttagtagagatgggggtttcaccacgttagccaggatggtctcgatctcctgaccttgtgatccacccgccttggcctcccaaagtgctgggattacaggtgtgagccaccgcgcccggcagaagatttattcttaatagcttcaaactggaaacaaccccaatgtccattaatgggagaacggacaagcaaattatgctctagtcacaaaacagaataccatttagcaataaaaaagaactagttcatgccaacaacgtggatgaatctcagaaaacaagttgtgagcaaaagaagccttataaaaaagcacatactataagtcatcacactacatgattccattacgtgaggtctgagaacaggcaaagcaattcatggttacagaaattagcagctgggcgcggtggctcacacctgtaatcccaacactttgggaggctgaggtgggcggatcactaggtcaggagtttgagaccagcctggccaacatggtgaaaccctatctctaccaaaaagaaaaaagccagctgggcatggtggtgcacacctgtagtcccagctactcgggaggctgaggtaggagaatcgcttgaacccatgaggtggaggttgcagtgagccgagattgcgccagtacactccagcctgggtgacagagcgagactgtgtctcaaaaaaaaaaaaaaaagaaaaaaaagaaaaaaaagaaattagcagtaattgtcgggggatgagtggggacagaaaaagggaggcatacaaaggaactttctgggctaagagaaatgtcctgaatcttgataggggtgtgggttacatgggtaaagggttttgacaaatataagatctgtgcatttcatgctatataaattacaactccaaaaataatcaaagtaaaataataaaaatattttaaaaatataggtaggtctttaactccaaatcttaatagctacctttagttgataaagcaacgaagataatggtttttcgtacaagaacagtcatgtgttgcataacaacatttcagtaaactacagacctcatacacagtggtcccagaagattaccatggaactgaaaaattccaatggcctagtgacgtagtagctgttgaaactgtcatagcataaggcattactcaggtgtctgtgatgctgctggtgtaaacaaatcaatgcactaccagctgtataaaagcatggctcaattatgtatagtacataatagccgataatgataataaatgactatgttactggtttatgtatttactacacttattagagtataatccttctactttttcttaagttaactgtaaaacagcctcaaggcaggtccttcaggcggtattccagaaggcagcattgtcattataggagatgacagtctcccatacatgttactgcttctgaagacctttcagtgggacaagatgtggaggagaaaaacagtgatattcatgatcctgaccctgtacaggcttaggctagtgtgtgtgtgtctgtgtgtatgtgtgtacatttatgttttagcttttaacaaaaaagtttaaaaaattaaagaactggccgggcgcggtggctcacacctgtaatcccagcacttcgggaggccgaggcgggcagactgcctgagctcaagagtttacgaccagcctgggcaacatggtaaaacctcgtctctactgaaatacagaaaatcaggtgggcgtggcggcatgcacctgtagtcccagctactcgggaggctgaggcaggagaattgcttgaacccgggaggcggaggttgcagtgagcagagattgcaccactgcactccagcctgggatacacagcaagactgtctcaaaaaaaataataataataataaataaataaataataaaaaattttaaaatagaaaaagcttatagaataagtacaaatacgtttgtacacctgtacaatgtgtttagtgttttaagctaagtgttaatacaaaagaataaaaaagtttttaaaaaactgaagtttataaagtgaaaagttacagtaagctaatttattactgaaatttaaaaataaataaatttagcatggcctaagtatatagtgtttataaagtctatagcagtgtacagcaacgttctcagctgtcacattcactcaccactcattcactcatccacagcaacttccagtcctgcaaacaccattcatagtaaatgccttatacaggtgtgttttacacacacacccgcccacccctgccacacacaccaggatctatgctgcccaggctgttctccaactcacaggctcaagtgatcctccggcctcaccctcctaaagtgctgggattgcaggcatgggactgagtgtctggtcaggtgtactattttaaatcttttatacagtattttctactataccatttctatgtatagaaatgtttaggtttataaacacttagcattgtggcaccgtgttacaactgcccaagtatgcattacagtaacatgatgtacagatttatagtccaggagcaacagggtacactatatagcctaggtgtgtaacaggctatgccatctaggtttgcataactactctatgatgttcctagcataacataatcacttaatgatgcatttcacccccatcaagtgacacatgcctaagttactcttcaagatggtcccctgggagacatgtcaaatgaaaatcttcattgttgttattatgctaaacattcattccgtttgtgttacagaaaataatcagccaaaaagttaactggaaatactactccaactttgactttaaaaaagatacataattatagataaaagactggtagagaaaacatcaggagtatgttttctttagcgctaagtatgactggatgataggcttacaggcaagattttcttttctagacatttctgtgctaattttgtataacaaacatcaactttttaaaagttgatataggattttgatctgttgcccgggctggtgtcaaattcctggcctaaagcaatcctcccacctccgcctcccaagtagctgggatcacaagaatgagccaccaagctcaacagctactttcactaccaaaaaatgttttcggaaaacattagaaaagcagtctcattatcacttcaaatgttgtgtggctatctcaaatattttatgtggcacagcacctcgctagttcactactcaatattctctggaaggttttcagtaaacctatgcatatactaagaatgttacatacaccatctcatttaattggcatgcgattctgtaagatagagattattatccatttttaattgatagaacaattctcaatggcagctactattatcctcatttaaaagccaaaaaaactaaaacccagagagattaaataagtttcccatagctaataattagtgaaccctggatgtgaactgagtcagcttattccagagcccacgccaggcttgaaagcaattagccactacatctgcagaaggcagtctgagctgccgctattactactgctgctgcagtaagtacactaactactatgtgcgtgtcaatccatttaatatacatatgcaatctcattaaattaaaaagtttaaaaaagaaattcataaggctgggtgaggtggctcatgtctgtaatcccagcactttgggaggctgaggcaggcggatcacctgaggtcaggagttcaacactagcctggccaacatggtgaaaccctgtctctactgaaaatacaaaaaattagctgggcatgctggcgcatgcctgtaatcccagctactcaggaggctgaggcaggaaaattgctggaacccaagaggcagaggttgcagtgagccgagatcacgccattgcactcccacctagacaacaagagtgaaactatggggaaagaaagaaagaaaaaggaaggaagggaaggggaggggagggggagggggagggaagggagggaaggaaaggaagggaggaaagggaaggaagggaaggaaggaaggaaaaggaaaggaatggaaaagaaagaaaggaaagaaagaaagagaaggaaagagagagaggaagagtgagagaaagaaagagaaaagaaaagaaaagaaaaaagaaattcatgattaattatcatgggaaggtaggtacatcctgaatcatacattctataggacacctatgatcatctctcattagagtcataataagatccctgagccagtcctaggctacttaacatgtctactaaacagctgtgcccacaggaattatatacatcccacattaccctgtattaattcatggcactacatagtttcattctacaaactatttttgttgtgatcttttaagaggccaaattaagatatgcttaatataaaattcccttatttctttgtgttaagaatcagatgacttcacgtgaaaaagtgaaaagcaacagacaaatgtacagtattatttctcttgctattaaatattagaaattccagccaggcatgatagtttcacacttgtaatcccagcactttgggcagccaagacggcagtcggcttgagttcagttcaagaccagcccaggcaacatagcaacaccatgtctgcattaaaaaggaaagaaaaagatggttggagttcgggttttcaggctctttctggtctaccttgtggcaatttgagagtccagcaacagtttctgctgggtttcaaagatccaggagaagctcagtgttgtgttgagacacaatggacccatcacaaaagtttaatccaaccctggtcccagtcttcaaaaatgctcactgaagaaaattcccaggacgattcaggggcctctcaaaacttctgctctgagatgttgataaagaaccttagtaacttgactatcaaccctagtaccaaattctcttcccctctaccagaaggctcaccccaacaacagtatacgggagcaatgatcctcagggaaatcagagatgacttgctttacaggagaagatttaagaacactcctgtctatgcagaaagaaaggatggcaaaattgagatacctgttactcggcagagttcctagacttgaacgagaactaacaaacactgggcttaagggagttcagaatgaatcaagaagtggacatttcagatgctgctgcagtttctgcatgtgtaacagatggggtacttttgagagtgctagaatagggaattacaacactgagccacttcagccataaaccttattcttgtacttttttttcttgctggtaattttatgtagcaggttgagaaagctaccttatgctacaatagactatatatcaaaaattttgataatgagttctaggatgtatttttcttgtatcttttcctttctaccatgatactagtgatgtataaggggtctgtgtagtttgaacgtatctgaataacttcagtatacttcagctctactgcttaatttgactcgaagccaagaggacataagcatccccatgtgttttagaagcccaaagccagtgagatgaaacccaacaccgagaatttgaagcaaagtcacttgtgggtaaagaaagcattgggtagtttggctacagcgtaataataagaaaaatttgggttgcaataagaggaaactttgtgctctttttacaatttttagtacaaataaaggtgtatataagagaatcaattttttaaaaaaaatcaaaaaaattagccaggcatgatggtgcacacctatagtaccagctacttaggaggctgagactggagcactgcttgagcccaggagttcgaggctgcagggagccatgataacgccactgtactctagcctgggtgacagagtgaggccttgtctcaaaataaataaataatattagagatttccaataatctacccaaaatagagaaggtagattagtcatttcttagccaacttggttctattaattctttactgactatattctgctaatccattcctttagagcacagattctcagagtgtggtccctgaccaccacaattacggtcaccggtgagctggttagaaatgtaaattctcaggtcccaaccaaaatctgctgaatcagaaacttggtaagttggaggcagaaatctgtcttgacaagcctgcagtgactctgctgaatattcaagtttgggaatcactgctttatagtatctgaccaaaatgatggctgactgagtactgggagctgatctaatttaaaacttttactccaggaacacctccagtcaaaaatcaaccccggggttttctgaccactttctaaaaaagacgaatattccaaaaactttattcaaaaaataagccctaatctgaccccctatgaagatggattaccatacaaactattttggtcacgtttcagatttgttagttaaaagaaagtacttaaaagatttctaaggtcacaaaaacaaattcttatcaaccttaaaatcagaatgcctccggaccccttgacccgaaattacaccttcctctttctaccagcttctggcttccttctgtcatctctgtgtcaagcaacatctctcaacacccgtagccaggaaagagagtgtctgtacggcttctaaatcctacctaaattggtcttttttgctttctttctagaggacaagtgtatgagttattttcagtagaaaacaagaacatgctcccctcataagacgaaatgttaagttttgctactgttgaaataaagaaattgttttttctttaaaaaactcttatcatgccttctatcacaaaagtaaacaaaagaaaaaaatagtaatatcatgtattgttaatattgccatgttgtcaacaagggtcatgtttttcctactgtaaatattttcagagtcacataaaattagaaatgagatggcagtgcacggtggctcatgcctgtaacctcagcactttgggaggctgaggtgggcagatcacctgaggtcaggagttcaaaaccagcctggccaacatggtgaaaccccgtctctactaaaaatacaaaaaattagccgggcgtggtggcgggcgcctgtaatcccagatactcaggaggctgaggcaggagaatcgcttgaacctgggaggcaggggttgcagtgagctgagatcatgccactgcattccagcctaggcaaaaagagcgaaactcccatctcaaaaaaaaaaaaaaaaaaaaaaaaaaaattaggaatgagaagagaaataatcacaaacatcaaaaatgacaaagaactgcacacatttttgcacagctttaagttaacaaattttaaagattagatgaaaagaattttctactaaaacagaaactgtaaaacttacgaaagaacaggctgcattgcattagtgttaacaggcctctggccagaccgtgtggatgcaagcctggttctgccactcactggcagcctccacttcttaatctgtaacatgtgacttgcctacctcctatcctttttttaaacaaagattaaaagttaagtatcttttagtttttctcaaaatcaaagcaaatttagactttactaaataaaaacgatactgacctaagagactactaaaagcctaaaagagccaatatttatagaaaatagcaataaagttgtcaaagattttttttttttttttgagtcagaatctcactctgttggtatgcttgattgtagtggtgtgatcatggctcactgcaactttgcactcctgggctcaagcaatccacctgcttcagcctcctgagtagctgagaccacagacatgtgccaccatgaccagctaattcttaaattttttttaaagatagggtctccctatgttcacaggctggtcttgaactcctgggctcaagcaatcctcccacctcagcctcctaaagtgttggaattacaggtgtgagccaccacgcccggcactattgtcaaagatcttcagtcacttcctagggaaaaaaaggcttcaggcccacatcactgtaagggtgaagtctctcaattcttcatgtaatagataattccaaatcgatttaaactgtttcacagaataaatatgaaagactttcggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaagactttcaaactctttttgaccaagttaacgtaacactgatataaaaattgacaaagcacaaaaagagctatggatcaatttcatcactgataaatgagaaacaaaattctaaatgaagcactagcaattaaaactcagcattaacttttgattttacaattacagagatggttcaatttgatattataaaacctacacagataatctgtcacataaataaatggaaagtgaaaaatcacaggttaatcaacataggtaggtatcaaaaagaaatttgataaaacctaacatttagatattatcatttattttatgacgaacagattatgccccaattttaaaagaaatatactactgactacaaaccaaagctcacattattcttaataacagaacactaaatacacttccatttaagtaggatacgagacagggatgcctaagagcataaacactggcaaaaaatattggcaaggagaaaataaaagtatcaataatgcaaaagatgactatctccttggaaaactcaagagaatctcctgaaaacgtattagaataattaagataaccccataaagcagccagattaccagagtagcgtatacataacatctttcctatattaaaatagccagttagataatgaaatataactcatcaccaacagcaacaaaaaccacgtaatacctccagaaataaacttagtaagaaagatttattacacagataaagaaaaccatactatgcttccaagcaacataagacccccagaaaagataatttatatgtataagaagactcaggaagtcacaaaactgttaaaatgtcacatccctcctaaaatgacttataaagttgtagtgaatcttataaatccaaaatcccaaagattttttgtttttaaaatttgaaaaaaagtcctaaatttatctaacacagtggggttctcaaccctggctgccatgaaagtcatctgaggaactacacactatacgaatgtttctaccatatcccccagattctaactcaattgctctgtagtggggttcaggcatcatatttttaaaaattctccagataaatctgataaagtgtagacagagttgagaaccacctgtgtgagaaataactagtgaggtcatatactaaaagtcatcacacagctaggttaataggtttctggcacaggaacaagcaaaggtcaatggaactaaagaaaaagagttcagaaattagacccaaatcctatatgtttgaaaagagaataaagtgtataccaaaaacagcatatcgtatcagtgggagaaaagatggattaccaatactaaataaatggtactaagatgattataacaagaaaaaatatatactgctggatctctgtgtctcactccttatgccaaaataaattgagttaaagattcaaggaggccagacacggtggctcacgcctgcaatcccagcagtttgggaggctgaggtgggtggatcgcttgagctcaggagttcaggaccagcctgggcaacatggcaaaaccccgtctccacaaaaaaatacaaaaattagtcagttgtggtgatgcgcgcctgtagtcccagctactggggaggctgaggcaggcggatcacctgagaccaggaggcagaggttgcagtgagctgagatcatgctactgcactctagcctgggcaacaaactgagaccctatctcaaaaaaaaaaaaaaaaaaaaaagtcatgtaataaggagaaaaatacaggaaaatatttcttaattttttaataggaaaagcacttctaaaatgtgacataaaacctaaaagccataaaggaaataaatggataaatgtgtttctatacaaactgaaaacatatacttggtaaaaacatattgtaaacctatgtgaccatattcctggtgaaacagactatggcaaataacaaaggggaaaaacatgttttaagagacttaagaatataaattaatgagaaaaaatgacaaacaattcaagagacaaatggacaaagattatgaacaatcagtaaaatacaactgcctatgaccttatgaaaagacacacttaacaaagaagacaacttgcttaacagaatgtcaagtaagtaaaaggatggtaatattcagtgttggtcaagatttggacagaggctcaatcactcttgatgaaggtgtaatttgcacaatatttctgaagagtatctgagattatctatgctgatttaaaatctcagtatcttttaattcagaaattgcatgtccaataaattatctagcagatatggtcactcagctgtacaaagatatatgtacaatgtgttcaaagcaaaactgtgaaaacagcaaaatactgggaataacctaaatgctcagcctacatggcacaagtccttaaattacgatatacccaaatcaggaattcctattgtacctatgaagaatgactgacagctacgcggagcatggaagaatttccaacttgtattgttaagtggtgggtggggaggggaacatctacactcacaagaaaacgctgtgtaatgctactctttatgtctggggagatagcacacacatacccacacccctctctctacgcctctatacgcatacatcatcactggcaggacagataagaaataatagttgcctttggtgagaatttgggagaaccaaaattcaagaattaagaattaactctctggttcttactcttaagagtatttttatggttgtttgtcgttaaaccatgtgcatgtttactttctaaaaacaaactttaaacaagtctgtgacccattaattctccttttcagaatctaatccatgacacatgtgtacaggcattgctgcactagcaaaaagtcagaaacaatccaaatgttcatcctcagaggatgagatcaataaattatgatgtatcatataatggaatactttgctatcagtaagaaaaaaaaatctctgtgcagtgtcacagaggccatctaaggtacactgccaagtaaaacagtaaggtgcttatgtagtctggtttcattatgtattttaaatctttatctgtaaggaggatgttgctcttttcctactattttaattatttcataggatatacttcctgtgtaatcgttcttaaaacaaaattatcttaaaaaaagcgccttttccctgtgcatcttaaaatctagttggctctgctatcgtaaggttctagagagggaatggtttaaaatggacttgtctctccctcttactttctgcccaccactacttggtctttcattccacccaaaggcaacgacacatctttaaaaaaatgcactctatccacctctagtgggctgctttgagatacctataggaaacaagagacaactgtccccagcacgctaacgaggctcactttccagtgacatccacgagttgctgttggaaagaaagaccactctgtataaaggaaccccaggatggaatgaaaagcctgggtggacagagaagcatgaagtgttacaggtgtaatcagcaaagtccaacttctggaagacactctccaggataaatagcagacaacaaccaaaacatgtttcttcagtaaattgtaaggatcccacagaccaacagagaacagattcttaagaggcatatcaactaactgaaatgtagattttgagtaaaaatctataaaaactacttataggccgggcgtggtggctcacgcctgtaatcccagcattttgggaggcagaggcaggtggctcgcttgaggtcaggagttcgagaccagcttggccaacatggtgaaactccgtctctaataaaaatataaaaagttagccgggagcagtggcacgcgcctgtaatcccagctactcaggaggctgaggcaggacaatcacttgaacccaggaggcggaggttgcagtgagcccagatggtgccactgcactccagacactgggcaacagtgaaactccatctcagaaaaaaaaaaaaaaaattacaacatatgagaccactggaaacgtgactattctgtggatactggctgacatgaagttactgttaaatctgttaacatgtgataatggctttgtgtttaggtgtacaaagtctaacttctacatacatgttatcaaaagctcttgaagtgcagtccagggtcccagacctttcagggggaccatgatgtcaaaactatttccataaaatcctaagatatgatttgccttttccctctgattctctcccaagaacacagtagatctagttttctagttactttgtgatgtgtgattccactgcactggacggatgatgaaatgtgtttcaatattctgttttactatttaatatagtaaatattgagaggtatactgcacatgttaaagaaatctctttggggtcctcagtaattgttaagattattcaggagtcttgagattaaaaaaaagtttgggaatcattgctttatactattatgtcgacttcatatgatttaaactctccagaatagacagagttttaaaagtaaggagtagagtgatgaatgaactgggaaaaggaacaaggatcaatctctccaggaaccataaacccatgagaaattccttctcaattgacacactcatacagactcttcttaaaatgccaggtacaagtaaaacttaagttcacgttcctctctactaacatttcaaaaaagacaaatgcaatttaaacattgagcattacttcatcttcatttcttaagttaaaaaaaaatcctctcgtttccgacattcacagggttttgcatccgtcacccaacgctctcatcaaccttctggggaaactgtgttctactcttattctccctcacccctacttgggactaaacaaatccaaagaacagcccaaactgattttctgttctgggatgtgctgaattccactgcctgaagacgtgcctggtggctgctgttgagaagcctctggccgcagagcatccacagtgtttgtcacttcagtgggaataggctgcccttccttctctgtgctcctgtcagtcctgggcttttccagctgtctcacatctatccaggcatctgccttcccccttctccaagtccagttcctactctagaaggcagctgcaaggctggtggctgcaaatcccagtccaggcctttccctagcagagctcttggccgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgatgtgcgtgaccttggagccacctggaggctgctgctttttttttttttttttttttttttccaagagacagggtttcgccacattgcccaggctggtctcaaactcctagagttgagctatccacccaccttggcctcccaaagtgctgggatcacaggcgtgagtcactgtgtccagcacccatctggaggcttcttaaagcccaggccccacgccgagcttctgagtcaataaagaagtctgcatttctaacaagcttctaggggatgctgctgctgctgctggtccaggggaccccacttgaagaaccactgcactggtgtttcctctgggacccgaatgcctgtgcttctccccggctctgccacctcttccttgttaacatagcagggagtgagctgacaaccctggaacacagctttctcattcagtgaaatggatactgtgccaacagatacttcactggatggccacagaggagcatacagaccagtgatcacctcctcagtgggcagtacacaggcagaaagcaacctctaccaggttcacggacacattaggccctgtactttccaactgcctgacctgcaagctgtcctacttctttaagaattctcattttaaagacagaaatggggcagagatctttatcctagaaagaaatctgtctcttccaagcatgagtggcacgtggagagcccaagaggaaaaacaggagtgggccacgtggtcccattttacgcattactcggagggaaagcccgcggttaggtaggaagtattgaaagtgcttcagttcacttaccttggccatgcctcctgcctgtgcggtgttcagtcccgcgtgaccagtcatttgcggggaaacctgcgttagggtctcagccagcacgctgctcgaggcgccctgcatggctggagtagggtacggcattccagctccccttcctctgccagcagccccaagagatccattcatgacttgcgcctgcccttgtgaagcctgattaattaagctatggccagagttactattgaggaggcctgggtgggtctggttaaagttagcattcatgcagataccaggtccagtctgtgacgtggcagggctgctagtcgccagccccacttgcttttgtgcttgcggattcagtgcttgggaggcagcgggggtgggcccagaggtgctggctgcctgtttaggcaggctgggggctgaagaatctccctggctcagagggctcttgcccatggcactgaggctggccatgttagcactgttcggctgcccttgagcctggccacccaggccctgctgcacggggctgctggcgctcacatttcctattcctgggttgatactagagccgctgcctcctcgtagaagctccgacagttgtttatgtttggaagcagcatctggaacaaggttcccactgtttaaaaggcctaattctcctccattgggtatcagctcatcaggaagatcattttccaagtcaaacaatgatccaaaatctagaaattaaacagaaatggaaatgagaaactaagcaacctttacagctctccaactgccacgtttctatgatcttaacctaatggggcattcagcacgaacactagcatgtcttaagagtcatgtcattagctgggtgtggtagcgcatgcctgtaatcccagctactcgggaggctaaggcaggagaatagcttgaacccgggaggtggaggatgcggtgagccaagatcacgccattgcactccagcctgggcaacaagaccgaaacaccgtctcaaaaaaaaaaaaaaaattaaaaaaaaaaaaaaaaaaagagtaatgtcaaaatgatttacaagtttgtttgggaaaataaagaaaaaatacccttcaaattctgaagacagaaaagttaaacagagatgagaaggacagccctactatatttatcatattctaaaacaataattaaatagtgtggtgttgagggcaaactcagatatacaaattaaaagaaaacaatgggaagactccaaattcactgaattataattttaaaatgcttttaagaatgtatgtgtggccgggcatggtggctcaagcctgtaatcccagcactttgggaggctgaggcaggcggatcacgaggtcaggagagcgagaccatcctggctaacacggtgaaaccccgtctctagtaaaaagacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccgacctgggcgacagagcgagactccgtctcaaaaaaaaaaaaaaaaaaagacaaaacattagccgggcatggtggcgggcgcctgtaatcccagctactcaggaggcttaggcaggagaatggcgtgaacctgggaggcggagcttgcagtgagctgagatcgtgccactgcactccaacctgggcaacagcgagactccatctcaaaaaaaaaaaaaaaaaaaaaaaaaaaaaaaaaaaaaaaagaatgtatgtgtgtaacaaagtaactgggcattgacttagatgaacagcaatttgaggacagtaaagccaatcttaaatttgtttttttttttttttttttttttttgagacagagtctcgctctgcggcccaggctggatggagtgcagtggcgtgatctcggctcactgcaaggtccgcctcccgggttcacgccactgtcctgcctcagcctcccaagtagctgggattataggcgcccaccaccatgcccggctaattttttgtatttttagtagagacggggtttcaccgtattagccaggatggtctcgatctcctgacctcatgatccatgggaggcctcagcctcccaaagtgctgggattacaggtgtgagccaccgtgcccggccgattacattatttaaaagttaaaatacaagaagtaaactagctttaacgcaaaatgaaatcagtgatttcttaaaagtgttgaagctgcagcaaatgataataaagacatacacagaaactacaaagagttaaaaataagagcctaaaagtatttgtagtatatgaaaggggtaaatgtcaatcatacaggaagatgagaagcacagtgactcccgactataaatggacaaaagacataagcaggtcttcaccccaaagggaaataaaacactaaacaaaataatccgtctttcctgataaggaaacaaatgggaactaaaacaaccctttttctggtccctttcaaagtaacttttctctgaagcgtggtctacacatgtcatctctaccctctcatttcccacgcactctaacccacaacggccaggctattcatgtatgtgcaaggaagaagtatgtagaaatatgttcatcttagtattatctgtagcatccaaaaaaaaaaaaaaagcacaaaaaatacccagaggcagtttttcctagtggttacagactctatactggggctgcccacactggacaccagctctgcctccagctccctattcattagtgatgtgaccttggtaggttactcagcctttctttgcctcagtttcctcatctggaaactaggggtaacaatggcccctacacctcataacgctgttgtgaggaccaaatgaataagtaagtgtaaaacacgactgagaacaaacagtgcctatgggtggtaaatgctaagtactgtctattattattactgctatccataacaggaggtttaataagcggctgtataatactttaaaacatcaggccgggtgcggtggctcacgcctgtaatcccagcactttgggaggccaaggtaggcggatcacgaggtcaggagattgagaccatcctggctaacacggtgaaaccctgtctctactaaaaatataaaaaatcagccaggtgtggtggcaggcacctgtagtcccagctactctggaggctgaggcaggagaatggcgtgaacccaggaggcagagcttgcagtgagccaagattgcgccactgcactccagcctggatgacagcctgggaaacagagtgagactccatctcaaaaaaacaaacaaacaaaaaacaccatacatcggccaggcacggtagctcatgcctgtaatcccagcactttgggaggccaaggcaggcagacgatctgaggtcaggagttcaagaccagcctggctaatatggcgaagccctatctctactaaaaacacaaaaatgagctgggcgtggtggcaggcgcctgtaattgcagctactcgagaggctgaggcaggagagtcgcttgaacctgggaggtggaagttgcagtgaactgagatatcgccattgcactccagcctgggcaacaagagcgaaactccgtctcaaaaacaaacaaacaaacaaacaaacacacacacacacacacacacgaaaaagaaaagaaaattaaaaccttttttctgcatggtggcagaccctaatgtctgctcacccaatacccctggccccatgctgctggcaacacccacatgatctgaagtggctgcctgggaggttcctctgaggaacgttccctggccacaggagggagagtaaccagataagcccaccaccacgatcacgttcccctttgcaagtgacacaatctcagctaagggaatctgaaggtacactgaaccaggaccattgtggaaaaggtgttccttcctcacagcaatggatgctcagaaagaaatctccctcctcttcttcaccagatctcgtcatgggcaggtgacaatcaccctgtagccaggagagcagacaccacttgcatgctaaggatggctgtagccaaaaacataaacacctggggtggggagatcatctctgaactgctgagtgatgcaaccctagtacttccccaccttcaaacttcatgttatgtgagaaaatacacttactatcacttaagccattttagctggagtttaacctcaccctaaccctaacagacccatcatgtctatggaagaagttcaaacaccttctcatggcacgtgaggctatcttcttggccttcctttacaggacaacaccagatgccccctactttccagccacaacactgagagctggcacaggcattgggaatctttcttcttgaatctctcattctaaaactcacctcagttcccactcagattaaacacagcaactatgaagactttctttgggctgcccctgcagaacagaccagtccctcttgtcagtctagaaaaccacgtctaacacacacttgttatcttcccacctgtctgtaaggaatgagatgtgatttaggagtgtgtacatgcatgtaacagtttttgaagaaaaaccgagactgagagtaagttgcagacgaaataacactgttctcctaagtacttcagtacgtatctcctaacaacatcctcttacataatcacagtatgcatgtgcaactcaggaaatgtaacactgatacaatactgaatatactgcccttactcaaattttgctggttgtcccaataatgatctttatcacacatctgtctcttcaaaatgacatgtcctatagccatgagattacaagatccaagatctaattcaggatcatggtgcatttaattgtcatgtctttgtcaccttgtttaatcgaaaaaggatcaaaggttccctggcctttgtctttcgtaagtgacattttattcttatttgtttattagacagagtcttgctctgttgcccacgctagatggagtgcagtggcacgatccaggctcactgcaacctttgcctcccgggttcaagcaattctccaacctcagccagaatagctgggattacaggcgtgcaccaccgcacccggctaacgtttgtatttttagtagagacggggtttcgccacgttggccaggctggtttcgaacttctgacctcaggtgatccgcccgcctaagcctcccaaagtgctaggattacaggcgtgagccattgcacccggccataactgacatttttgaagaatagaggccagttgttattgtagaaggtccttcaatttggggtacctcctcatggttacagggcatgtcattttgaagagaaaggaatctgatcccggatacagcagacagttccatgagggcacagggcctgtacctggtgaaataggtctcaacatgcttctgagggttccaatccatagtttttacgctattttgctatcctaaatttggagattcactgaggtgtccagacacaaactgtacaatatttattaaatatgtattaaaaagtcctctctatcataactactgttttgtttgttgccctccaggctttgtccacctgcacacacaaatttactcggtactccttaataaatatttttgtccaacccaaatgataaacgtttgaggtggtagatatcctaattactatgatttgctcattatgcattgcatgcatgttacaaaatattctgtaaccccttaatatatacaatcacatgtcaactacaaataaaaggaaaaaagaaaatatgtacccccccaaataacaacattttattttttattttatgttttagagatagggtcttgctctgtcacctctgtgcaatggcacaatcacagctcactgtatcctcaaactcctggactcaaccaattctcccgcttcagccccctatagctgggaccacaggtgtgccccaccacaaacagctcattttttattttatttttaattaatgaattaattaaataattattttgacagggtcttgctccggcacccaggctggagtgcagtgaagttgcaggctcaatgcagcttccgccctgcaccaaaacacccacctgatttttgtactgttttggagagacagggtttcgccatgtttcccaggcttgccagctaattaaaaaaatttttttttgtagagatggggtcttgctatgttgcccaggctggtctcaaactcctggcctcaagaaatactcctacttcagtctcccaaagcactgggattacaggcatgagccactgcagcccaaaataactacttttaaaaatgcagtgttccttaactgatgagcatgaaaatgaaacttcatctaaaccaggaactggagccattaccattagagatcagctctccttcctttctgtccagggcgaggatgaagagaccgtgtcaagcactgtaacccagaagcaaacaagggccaaatattttatatttaagtttggaaaaatctgcaaaaggcgacctaactggctattttgaacatccctaagcactcttcctaggagagggaggccaggccacagaagagcagataaactcagagagtacttagtgaaacccagggcagggctggcctcagtgtagaacaatgggaacagaacagctggaagctgagcacaggagttgaaatcctgcatccttaggcaaactgcttcatctctgcatcttcataccctcacctgtaaaacaagggtaccaacgccccagagttaaaaacttcacccatcatcctgccactctcagagctatcagttttcatttatggtttattctagttcttatcaaattcacaggcaagtttcaaagttgtaagcagggcttatgtcctgggctagtgtttttgtttttcactggtctgctacactctgaccaccgtgaccactttttcatcctatttcagtccaaatacatataccagctgtttgggtgaaggcagagttagacaaattcttcttctgtaattcaccatatgaatatgtgtaaaaccaaatatacaggtgtggctttttaaaaggcaagatagggcgcacacgtagtcgtaccatcacccttctgtttaccactgtcaccacatttccatattccctagttcagcaaaactgacaaaggggagtgaaggaggcaggccaggatattgcaacacaacacagctttgctttctacacaccaaagtgtcccaacacatgggttaagcaagagcaatctgtatcatcggaagttcctaaggttcacgattgacagcgatccagtcccaggtaagccctcttctctctgaccgttaccagggggcccgggagaatgcaaagaaaaggagactgtgggcaccctgcacccagagcatttgcacctcaaggaaacttcaccagccgatatcaaatagcgaacactgcctgtcatacttccatagctagggaaaggaattttcccttttgcagcttcctggctgccaaccaggaggctacccctttcattaagctgaaatgagagaaaagagaggctacacatttccccatttctatcacactcatacgaggctgggaagacccagtgaggaatgaggaaaatagtagggacttaggaaggagaaagttacagccaaactcagccagcctcaggaaaggcaactgtttaccaagcaaggtacagaggacattcacttctatactaggaaacccaagccggtggtctgcatgcagactgttaggtggggatcactcctaaacactgaaagacaaatggtacctacatctgttccaggatccattcttaataatgatgatcagaaatcagcatttcaccttaagcaaggaatgaactactagaatcaaacaccaggtgggtggctaaatcaatctgtgcagccaataacatttgaaaacagcctcatctgaaaaaaatttcaaagccatcagccaaagtatccacaaaacacacctttcttcaggttttctacagcctcctcttccataataccttattttcttctttgaattccacttggagccccagattatttgtactgacaggactggtctatcacaccttctcctggaaataagaactcttttatgctcctacagacacaatgcgttaaaattatgctaacaatttcacgttataacgtgcgtggggctgtaagctccctgaaagcagggatcctgtcttgcttatctactcagtgcctagcataaaatgcttcgtatgtactaggcactcaataaacccacgtgctgaatgagtgctcacattatagaggatacacagtatcaacaagctgcttgtctagtcaaagatataaagcagtaatcttaatgtttactactactttctgaaaacagaaacaataacgaattctctagaaatattacactgggtcatctttctctttaagactttttcctattgccctctttaccttttaggggaccacccaagtatatttcactctttggctacaaactcagcatcaatgaaccccaaccctagaattgatacacagattaaatggcataatgtaggatgagcaacagtagtgtaagaaataagcatgtaagagttcagatgctgttttgtgatgtgttcatacttctctgctttccctcccacacatattttctcttcctcacccactcctaatttctctctcacatccctatttcctgtgaaaaaggtctcctttctttagatttttttttcatggtttctttagattgtcttttgcattacttttgtaatactgtgactatgtatttggtcttccaccctgtctcctggcatacaactcctaaaatccttggaatctccaaaatagaatttttattttttatttttttatttttatttttttttggctctgtcgcctaggctagagtgcagtggcacgatcttggctcactgcagcctctacttcccggattcaaacaattcttctgcctcagcctcccaagtagctgggattacaggcgcataccaccacacccggctaattttttgtattttcagcagagacggggtttcaccatgttggccagaatggtctagaactcccaacctcaggtgatccatccgcctcggcctcacaaattgctgggattataggtgtgagccaccacacccaaccagtaatgtcttttcgtatgctcacgaattgactgatggctggcagctcctaggtagcttcggacaggagctggtcaccaggaagaccaaggcatgactgattagaggactgggactttcagcccatccttaatttccagggaagggagagatactaaagcttaagttgatcaccaacggccaatggtttaatcaatcatgcctatgtaatgaagcctccataaaaactcacaagtacagggttcagagagcttccagatagctgaacacatggaggttcctgaagagtggcacacctggacggggcaaaaaggctacatggccctctcacacgccttgccctatcacctgatattcagtggtatccttcataatatcctttacaataaaaaaccagtaaacatgtttccttgagctctgtcaaccgctctagtaaattaattgaacccaaggaggggcttgtgggaaccccatttatagccagtcagaagcacaggtaaaacaacttggggcttgcaaatggtggggggcgggggcagtcttgaggactgagccctcaaccgtgggatctgacaccatctgcctgtcagctggcgtctgctgcagcaccgagtgcctactcggtgtgtgtgtgtggctgggggcatctccacaaatctggtcccagaggtgttctgtgtcgactgttgacactgagtataggaataaaggagtataggagaaacctgatttttccctacatcctcagacttgtactatagccctgactactcaaatgcttctattaaatctttcaaaagctaaacatttttattcacctatttacctaccctcgaaaaacttccaaaaggaattttttttaagagatggggtctgtgttgcccaggctggagtgcagtggccattcacaagtgtgatcatggctcactgtagcctcaaactcctaaactcctggactcaagcaatcctcctgcctcagcctcccaagtagccaagactgctggcatgtgccactgtggctccaaaaagaatttttaatttctaagttaacggacacaggaagaggtaatgcacatgttaattggctcaatttagccaatccacaatgtatagatatttcaaaacatcatgttgtatatgataaatacatacaatttttatttgttaattaaaacaaaatttgaaggaaaaaaactacatacaaaaaacttgatccagcaagggcaaagcatcctggaaaagttcactcctagagatgaggaatctagagagtggtggaaggattcacagtgttgttattattattgttaaatgacctggaggccacactacgctctcggtgtgtttactgatctattactaattagacactacggacacaggaagtgcagtctggtgtagtgagaagagtactcaaccaagccctggttcagatcacagctgtcaccacagctactgcctccctgtgtacccctccttagctctaaaatggaaggacagctgggtgcagtggctcatgcctgtaatcccagcactttgggaggcagacaggtgggtcacctatggtcaggagttcgaaaccagcctagccaacatggtgaaaccctgtctctactaaaaatactgaaaattacaaaaaattagctgggcgtggtggcaggtgcctataaccccagctactcgggaagctgaggcaggagaatcactgggaggttgcagtgagccgagatcgcgccattgcactccagcctgggcaacaagggcaaaactctgtcccaaaaaaataaataaataaaataaaataaaggacagtagcacctgcttcgcaggatcgttgatgaaagaattaaaccatacagcatttagcactgagcttggcatgcagtaaggactcaaaaaatattagtcattactatcactgtcccaatcccatctcccaaggcacctatgagggctgaaccagccaaagcctttaagaacctggcactccagggttggtacagagcaggcgctcaacagccgccacttatcaatggtagtgacttgctaataaactcatccctgctgatctgtggcaattctagtagaattaaaggttactttgctttgaaagttcttggggattatgcaaataaatataatggaacaactctctataccaaaaaaaaaaaaaaaaaagaaagagaaaagctgttttattaatatttatgccatcgtaagtaatttttatctaggcatttaaacaagttcccaaaagacatctaacttttttttttttttttacaatgactattaggaaataattaaagcaacctccttctaaaatcttccgtaattcaggcttcttttatgcagacacaccaatccctaattagaacagaacaatgaggttgtacttcattctgaacagtgatcttatcttgagtaagtcttgcccctcctcagaatcactgatctgctgaagagccagagagctcggccggcagcccccaccctctcctccccaggagaaggaagcgagtcactgctcaggggccctcactcggtgcaggaccggctgggtttgagatagaatagaagtcggcctccccagaggactgtactctaattgaggaagacagccaatggacaccaagccacaaacttaaattaacacgtatgtcatattttacagccaagtggaataaggcagtgaacaaaagtaggaaaggcttcaaataagaggctctgagcagaagtttagaggaaaaggacactgacaactccaaagaggcagggacagaagacagcaagacaggcaggcagagatggctgctctgctgtggggaacttcaagggaaaagctccaagatggcaggagccccagggtaggtacaagttccatacggtgggaagggcctcactacggtaggcaggcttgctctgtcgcccaggctggagtgcagtgacacaatctcgggttattaaatttgggtttaataaaccgaattgtcttaaaaccctcaacacagcacttacatttatactagagcttagaatttgggttttcttgttttcctgtcatatgctgtgttttgtatgatgaacgatatttaagtggacattaacaacgaccttccccaagaagtccattcttcatatacgacattctagtggggttcttcctactgtatcagatccacatacctaccaaagtgacgcccttcccactgtatcgaattcgtacctaccgaggggctcctgccatcttgaagtttttcccttgaagctccccacggcagagcagccagctttgcctgcctgccttgctgtcttccgtccctgcctctttggaactgtcttttctcagtgtcctttccctctgaagttctgctcagagtttgcctcttatttgaaagctaaattacaggacaaatattcttcatgtcacagaagggtccatccagggggactcttttacacggaaatgtgcttagtaagttcatttaacatggaaacatgatgaacttcaaagtttgaattaaggggaaataaatcaagctatggtatcaggttaaactaactgcaataaaaattacagaaccttagaaactgtaatgtgaatcagaagggaaatactgatttatcaaaatgcacttaatacaatattcaagagtgctacctggaaaaggtaaaatctacttttgcataattgattataaaattttagcttttttattcattctcaaatgcacttgatggctgtactctgtatcaggtatcaaaaaacatcctgcttcgctgaatgattactatttaccttccatttaaaaaacccaagcaagacagggccaggcacagtagctcatgcctgtaattccagtattttaggaagcccaggcaggaagatcacctgaggtcaggagatcaagacccgtctggccaacatggtgaaacctcatctctactaaaaatacaaaaattagctgagcgtggtggtgggtgcctgtaatcctagctacctaggagggtgacaccggagaattgctgaactcgggaggcagaggctaccgtgagccgagatcgcgccactgcactccagcctgggtgacagagcaagattctgtctcaaaacaaaaacaaaaacaaaaaaccctagacagtccttattcaaagttctttgtcacctgggaccctaaactgtcctggaaatgcagccaagtctatttttatttggtgcacttagcagtcacagggaagtgccattcccagacagccaagacaacgttagtttcctcaacatggtttgcgtgctgcttccctcagccctgaagggtggggacaagggtggaatggaaggtgcctgtcatagcagccagctgccaccagaacacagtaatgacccagcagcccctgcacgttagcccaatcatctgggacaggggagcaaaaacgggttgtttaccaccaccacagctgagaggggcaccagaccccggagaggtgctacagtcagctgcctatccaccctgcttacagggagaggattctccagccaagaacagtcctggaggaagaagaatgtgggggctgagctaggagctagcctttgcagaagcagccccagaccccagattcccagccacctcagattccccagccatattgtaagaacaagcaaacagacatccagagaccaggtcctttgccccaaatgctgtgagatgtagctggcaggcggcaacaagaagtcaagaaagggggaaagagcatattccagacgtgaaagcagacttggaagtgccagtccatgtacaacgcgtggaggcgtgtgggctatttgagagccacaaacagaaaatgaatgccttaagtccaaaaagtatgccagtaccaggtatgttggctcacacctataatcctggcactttgggaagccgaggcagggggactgcttgggtccagtagttcaagaccagcctgggcaacatagcgaaacccggtctctacaaaaaaaagtacaaaaattagccaggcatggtggcacatgcccatagtcctagctgctcaggaggctgaggtgggaggactgcttgagcccaggagatggaggctacagtgagtcaagatcacgtcactgcactccatcctgggtgacagagtgagaccctgactcaaaataataataaaaaggtacaccataaaatgagagaattcagaaacaactgagaagcacaacatgatggagaatcacaagctgaagaacaaccttagtgttactcatcatagactatgctgataaagaatatccgtggctgggcatggtggttcacacctgtaatcccagcactgtgggaggccaaggcaggcaggtcacctgaggtcaggcgttcgaggccagcctggccaacatggcaaaacccctcctttactaaaaatacaaaaattagcggggcatggtagtgcatgcctgtaatcccaggaggctgaggcaccagaatcacttgaatctgagaggtggaggctgcagtgagccaagatcgtgccaatgcactccagcctgggcgacaaagcaagactctgtctcaaaaaaaaaaagaatatctgcaacacatctagcaatgtatacctggagaatatatgtgctgcctttcacattttaagactctaccaacacacaggctcttgaaggaaaatttgctatgatcaaaactataaatgcatatgccttttaaccactaattctatttctatgaatctgttccatagatttgcctgtccgcataactttacaaggctattcattaaagcactgtttgtgagaagacaagactggaaataacctaaatgtccaccagtggggagaggattaaagcaattatggcacaggtcacataatggaatggtagacaactgtaagaagacaataaacgtatgcagctgtgtgtacactatgctacctcagttaagaagaaaaaggcaggaagggggaagagagaactaagagtcaacagcgtctgcctgaatacagataaaccctggaagacagcactacttccagtggttacctgggaggagctaggtggagggaggctctctctacaggttttgtcctctgagttttctgagccatgtgaatgaactactagtttaagtaattaaaggaactaattttttttttttttgagatggagtcttgatctgtcgcccaggctggaatgtagtggcgcgacctcagctcactgcaacctccaccttctgggttcaagcaattctcctgcctcagcctcctgagtggctgggactacaggtgcacgccatcacacccggctaatttttgtattttagtagagacggggtttcaccatgttggccaggacggtctcgatatcctgacctcatgatccatcaactcagccttccaaagtgcagggattacaggcgtgagcccaccgcgcccggccaagaaactgatttttttttaaggcacccccactggggatatactggcccaggtgattaacttcagcaccaggtggtaacacctggaatggttcccagtgctccagtttccagttagggtccttatgatttgaggataaaatgtgaaatgggttcactattagttcaaaatatatttagtgtacaaataagcttaaaaggctagaaaagaaaagggcactttaaagaagaacttttcgaaagtatttttttctaaagggatgtgacaatcgacatgtaacattttgtacccaacgctcacacagggaaatctgacattatttcaaaatactcaaaaattagttggctgtcatgtcttgtggcttctagcaaatcaatgaagaaacctctaatataaagatgatgttaaaaatggagcttgtgacaaagcaagtgatgatcagacgccacactaaaacacaatccattttcctatctctggatggcgcctcttaggggtaatttgtactttgttcaaataattctcattagaggtctaaaggttttgcaacaggaattaactaaaactttgcttctcaccatttaacagattctcttaatcacaaatataaaaataaaacaatacaaaaacatatatacccccaaaatgttttgttttgaatttttttaactagtttttcttttttcactatgaaagtaaatacatttatggttttttgctttgtttgaaaaaaaaccctcagaatataaaatgaaaaacagcccccaaaacatctctagctcaaccccgaaaaacaatttctagagattcccttctagaaatttcctacatacaccattagcatatctttctacccctaaaagagatctaattatcatttttgctctccatcctttgtttattgattctcagtcttttctcccctcctaagtacccatcactctccctcaactggatctgcaatgccagggaactcagctactcttctgaaggaacttcactgattttaccctttcttttctaaaggatttctgagtcatactcagtgttttacaatctctacattaattaactaaattaacgaaaaggtctggagttaatgaaaatgttcttagaagtcctacccatcaagaaactttatctgcttggtgttgaagtaggttgctaacctacagatatttctatttcaactattaaggtgggtaataaaaaccagaagttttaagaatctattccaggaattgagaaacaataaacacaacttctgtgtgagctggctgcatgacatgcattttgatgacagtagcaaaacctctaatattctttgagatgacatggaattaattttaaaaaaactttaagcctaggcaacatagcaagaccctgtctctacaaaaataataaaaaattatctgggcatggtggtgcgtgcctgtagtccaagctactgcggaggctgaagtgggaggatggcttgagcccaggagtttgaggctagagtgagctataatctcaccactgcacttcagcttaagtgacagagcaagactccgtctcaaacaaaaaacaagaaaacttcaattattcctatttatataacatagagaaaacattaaaattgttttgtgttatttatctaaatgcagcaccaaaacattttaccgttaaaaaagaagacttaattaattaaaagaaagcctgggccgagcatagtggctcacatctgtaatccctaaactttgggaggctgaggttgaaggactgcttgagcccaggagctcaagaccagcctaggcaacataggaagaccccgtatctctactaaaaaaaaaaaaaaaaaaaaaattagccaggcatagtggcatgcacctgtcatcctagctacttgggaggctgaggtgggattgcttgagcccagaaggtggacattgcagtgagctgtgatcaaataaatgcacaccagcctggcggacagagtgagaccctgtctcaaaataaataaaaataaatttaaaaaaatagaacaaagcctgcatttctaatactaacatttccaacagctctgagatatgtatcagtctgaaaggcactgatagtagagttacataaaatgggctacttagggcaaaaagagtaagaagagaccatatttgcctggctacgcacagtccatctctagaatacgtaagaaacagctaacactggttgcctatggggaggggaatgaccagtgaccccagaaacagacaggaggaagagttttcaccaattactctgcttttttggaattctgaaccatatgaatatattatctactcacaagaacttaaaaaaacttttaaaagaaaattgtttgtacaaaaatttactaacatcttaaataagaacactagttccagttcttaagctgcttttcatggggcccttttcctgccaaaaacggggctcaggaggggaaagcattgtctactctccctacagacctgaacttggatgaaaaaacacaccttgaaaaagctaatctagacttctggaaaataaatcacaggagctcccccaatcactctggacacgggttttttaaagcttaattttgttttataagccctaaaaaaaaataataacctggactcctaggtctgacattcaaggcccttggtgatgttatctcgccttcagatgcccaagctgatgctctactcaccctcaatgagctctggtgtccttcctccaacaagcctccctgaccacccagcctgaggcatccacttccttccagtcagacatcgagctgagtgtgaaatgctataggccacggtgggcaccacgggactgctcacccaccacaccacacaactcagagttccatgaggacagaagcagcttctgccactactgtcatcaccacagcccagcagggtgccccacacgtaaaatgtgcttaaatatttgctgaataaaagaatgaagtggtaggagtcaagactggatcccgggccgaccaacccccgcagggcagaaccacacctttagtctccaccatctcagaagcaaaaccatgaggcctcctaaattctggtagcccagtgaacataacccaaaaactgtcacaagagccagacctccaccctgctatgagtgctgttccctctgcctggaacagtactatctgccatctcctattcaccctcaggtgtcagtgctaacgtcacagcccccggggacttccaatacccttcaaaacaggctcagtccccatctggtgcctcagtcaatgcacagtatgtcccctccaaggtcacacctgactgcagttacctgtccagtatccatcaccacccatgagggcagagatggggcctgtcacatccccactggatcgccagggcctacatcacagcataacaaatattttctaaattagtgaataatcctgaacagtgtgacctaagccgtgaatatttttgaaggagtctttcatcatttttaatttggagtcttgcatctttaaaagatgatcgttttaaaggaactttgtcataaatatctaggtgatacgtatcttaaagaaaactctagacaaagaggataagtaaatgtacttacagttgtgctgtccaataccgtagtgactaactacatgtggctatcttcatttactcaaaccaggtaacatttaaaatttagttcctaagtcacactaatcacaattcaagtactcaacagccacacgtggctcgtggttccagtactgtgtcatatagacacagcgtagagccgccctcccaataacgaccactggacagcgctggcttggagggcatcccgagaacacaggcatccccaaacaaggaaacatctcaattcaccctcttcctcctgggaaagaatccgttctcccctaaagtttcagtgactgagaaagccatcagtgaaagcaaaacacttgattctcttgccatcattcaaatgattccctcagagacttctcaacagaagttcaactacgggcaggtgtgctcttcaaacaaaaaccgattcccacagtagtagaggaacaaccacaatgacacagaaaacctatcaatatgttatgtctttttgttattttcaataaaggtgacgttctgaatatgtaaatcagatttaagtaaagatatccacaaatcggggaaaaattttgtccaccacggggtaacttttacttataaaaaaaaaaaatcacaccaaatctaggagaacagaaaaacagtaatctccattaaaagaatttcctactatagaatctgcaggaggagaaaagtcacacagtacagcacagagctgaatctgttcctttcaagatctgtgtagctgagcccgagaggcaattgagtttcactggtattcctttcaaccaacctgactaaactggacagtgatcccaaggccattttcttcccaactctgttttcaataaaatactatatttataatttctctgcatttacttttcccttttctctaagtcctaatctaaatcaagcccttgttctgaagcaataactagaaacagagttccatttaattaagagttcaattttccaataaaaaacagttgaactgcaaacacagacggagtaaaatgagtcaaacgattacccattttgtaagattctcgaatcttagttcgttttcttacaaactggttcccaaactgcactagagctggcactgaaagccaaacaggcaggggcagaagcttcccatgtattcagtgagaagcctcctgattccgggtcaggctacatcatcttagtcctcactggcccaagaagtaggtgatggctaatattttcccatacaattaaacaataaaaacagctgcctcaacctgctatatgccaggcaccctagtagccccatgtaccaagataatcaaagtaagcagaagtagagccaggcacagtggctccatctcacacctgtaattccagctactcaggaggccgaggcaggattgctgaaggatgggagttcaagaccagcttgggcaagcaagaccccattggaaagaagaaaagtaatgtaaagaaggggaggggaaggggaaggggaaggaaggaaaagaaagaaagagaaaaaaagaaggaaggaaggaaggaaaagagaaagaaagaaagaaaaaagaaagaaagaagagagaagagaaagaaaagaaacaaatggaatactgcagggtaaaaagccccttttagagatctctctctctctctctctctcactcacacacacacacacacacacacacacacacacaccccaccctgcaaaactcaaatgtgatgtcaccagcccaagtcacagcgctgccgagctgggagctgggactcacagtctactctgagcaggagccagggctccctcctcagcaccacactgaccgcctccccgtataaaaagctgacatttccttcaactgtgactcacagttagaaggttctacttttaatcaggtgacaaatactcaaaatattttaatccaaagcaactgggtcaaactcgtagagtctataattgtctaagcaaaccctaattacctgataaatttctatagctcctgaatgtcctcattcagtttgtaatcaaatacccaaatctccttatttaaatgttgtacaagccttctctacatgttatcatacagaacagtgacttatttttctatttcactggttattttaaccataaagttaaaacatgtttaggtggtgcagttttaataagaaaaatccaaactagggggaggagaagcagcttgtgaattataaaaagatttgctttacaacagaattgtacaactccactacacaactactttttctccttaccacagattatgcaaattcgaaaggttgaattaggtgcaactggaaaatatacctactgtatacaatatagtacaggcatattagaaaggcaaattaagacattttcaaacaatagcagacagtacaactagaaatgggaaagtaaagtcagatttaatcatgtagaattattttccccattagattttactattcttagcaatggttcaactaaacagtcttttgattaatggaaatgaaacaccggggaaaatgtcacacgggataatatccaaatctttcttaagggtaagttttaaaaggaattcaacttttagagacagagctcaaaaatagccttgcttcctaaatttagaaccagaaaacaccctaaaggcagtattttaaatacagccacagtcaccgcctatattgtctaggaacttaataaaaaaaactttaaaaagagaggggccacttttgtttacttccatgcctttcacacagccttgcccaatttgatttgtgtgcccttgctcaaatctcttcaagtcacagctcaaatggcaaagacctgaccactccaggacgccccggggactctgctcgtggcctattgtagcacccctgtcagcagagcacggccccagggaaaggagaacaggcaaaagcccccacaggcactgctcccaaggcttacacttctgcatcaaagactcatgcaataggagaattttgccgaaagccaagtttgagcctgactgagaagagcagcatccttttccagttaaagcaaggagtgtatccggagggatgcactgcaaggaaaagacctcagagaggactaaagggaacgctgagcgcatgtgctaaaaagcagacggcacggccaggagcttcagagcctaggagagacgggacaaccagaagaggactcagatgtgagcaagccatgggcctacaacgataccccaggaaacaaactgtcatggtcagggtgcttttcccaacaaccaggaatgcatggaaaacaggcaggcttccccaactcctggctctgtgctggctcagcagaagagctgtcacaggagcccaaggctcctcaaccatcccagggcctgcctcccactggggcatgcggccctggacttctgcacacggggacactcaggaaacaggggagggagtaaatgaagccttattcagatcaccctttctggttccagagtttttgcacttgactgcatttctgtaccctttccttaagttttgcctcgaggtttcatcttctcaagatggttctaagtactcacaggcatctatcagaatcctgtgtacactgctaatgcttaacaggtacctcaagataaattatacacagtaaacaaacagaatcacatacttgtctgctgcttaaacagtccatgaaatatgcttcaaaattatcaataattttcagtgtacatcctgatttgatttaaaagaaaaaataattcagaacacacaccatttaagttttcgtaattttaagctttcatggccatcacgttcctatttttaaaaatacaataaaaaatggagacagagtcaatggtatagatgacagaattcccggctatgtatctgctgaggtgctacactatcacacgcgtgcctgcacactggtttctgtggatacgagcacacatggcttctgtcctttccagaactgctgagaaacaggtcttgctccaatcagactagcactcccagtaagtcctaggacttacaaggtacgacaacgtccctggttaacgctagtgtcagttcccattgggcggatatgccagacacacatcatctcaggctaccctcataaccaccctgagatgggaattgttattatctccatgttacagatgaggaaactctgagctcagagagctgatgtaacttgccccaaacatgctctggcctcagcactcctaaggccagctggtttggtggccgggtgggagcccatgggtacggaactcggaagcaaataacagacccaattagaagataggtggcaatctgcttgaaagtaaaaccttaacaagaaaatgataagaactttaagggacaaatactatataattctttcactaattccctcaaatatttcctgagggcctactatgtgtcaggcactgcccctggggagggaagtgctgggaagagggccgtggaaaggctctggagttcttactgacgctcaccttctggtgtcacaggaaggggagcaagcctagagcctgagatgacaaagacggacgagaaatgccatgtgggccactggggtcaacaaaaagcaaaagaacaaagaaaaatgcaaccggtcaccaggctttctgataaattcgtctgattttaaatcaagtcatccatataactgttacagaggaacaaaaaagacagagagagagggccctgctaagctctgaagtgctccaagacaggagacccaagctagcctgctgctcacctgggctctcccgggctccacatcatgcagctcagaaaacttgccctgctgctgttttccttaaagctgtctgtgcagccgtggtaggccagtgctccccaacgggtgctcagagaatgaagtcccacgttatatcagtcaccaaattgcagcccatgggcgaagtcctcagatgccagtctttacaactagagttttactggaacacagccaggcccactcgcctatggctactttcttgctgaaatggcagccttgagtagttgcaacaagagaccatatggctcagaaagccaaatgcgtgctctctggccctttgcagaggaagtctgcggacccataataggctaaaaagagttctagcgtcaaacaggattgagagtggtccaactgtagcccctctctcacagtgcccaatcaggacaccaaggctctgggaaagtctgcagtcaaattcctcagctacaagcaacagcatctgagcacaaaccatttgttgagaaatacctcttagcatgccctctagtttcttggaatacatgtgaagagctggtttgagtaaggtaaagaggggtgccctcactaatgggaccccaaaaactaaactgacaagcttttgcaatcttcagaaactcacaataaggtacatttcatcttaactaaggtaagacacactttggcaaaatcattttcctaactgttttcaaatacatcaagtaaaaacacaagtcagcaattatggaccccccaggtaatcacatactttgccacacaattacaacacactacttagaagctgtgaaaacacaggcgactaatctaagcatcaacttccaactgcaggactcagtctctttgtaagttatgttcaattctgtttacagaatcaaatctgaatgttcagccaggagcgactttccatcttctgaaggccctctaaggcgccctgcacatgacttgtccttgcctaccttcatccctgacgacctttgaatggggccaccgctctcacccctctcagttattcaaaaacgaagcacggtcatgaaatgtcctagtcctaaaagtctctatgacaacttttattcctacttagccagaactcactgatggggtaacataaccgtttctcattctccctgaggtaaacaggaacacgagcccacacacgtcacgctgaggataacaccagaaccagagggaaaagggggacgccctaacccaggaggaagaatacactcctggctgcccccaccacaggtggttacaaacctcccccttagtgatctcattcatgtgcgggaaggccgctactgaaactcactaagcttggcaggttcctgggtcgattcaagtaaatgcattgtttacagatagagacttagaaaataaatatatagagctacggactttaacaatctagtttggatctggttttgaccctgtatcacctctcaagtccagttcctcacctagaaaatagcagtaacagcatcttcccttcctcacaggacgctgtaaggatcaaactgaggtgacgtggagaaaagcactctgatacataaagtaccagacatacataacagaccatttggttgacaaccatattcgccaccagctttctttaaataagcttccctattgcatttaaaaggattcacgtcataaaatgtaatcacaactgcttagagccacttatacagcacaggatgaaacacagctatgttcaatcttcagaatgtagtttttcttttcctttttcccccagagacagggtctcactctgtcacccaggccagagtgcagtggcatgatcacagctcactgcagcctcgacctcctgggctcaagcgatcctcctgccacagcctcctgaatagctgggattacaggattgtactattacacccaactaattaaaaaaattttttgtttagatggggtctcactatgttgtccaggctggtctccaactgctggcctcaagcaatcctcctgtctcagtctccctaagcactgggattataggcatgagccaccaccctggcctgcaatttcaaaaaactttataaacagtctgttgtgtgcaaattttgcaataaagctgaccaaaaaaaaaaaaaaaaaaaaaaaaaaacaacccagaaaacaaaaaacaaaagtctactgcttgcctggatatttgtcttatactgttaaatcatgaatctctgatgttgaaagacacaatatgctattttaacttggacatattaaataaagaagtttccaaaacacccaactaactatataccggtaatataaagtccccacttattgtaagggtgccaagtaaaggaagacctcatgtatgagaaagtgtaaaggcttctacataatacaagaaaatgctactttaacatctgaggccatcaaattctgtgcctctccagggctgctgcttcagtggggtgaaaggtaccgtttctctcttgctaccctcattcgcagcacattccgtatttctgcatcatctctgcataagcttcccaggcttcggcaacttgtttgtcatcagtggcagtgacattcatcactctgaggtgctgcatgaccttcgggagtgctgtttgcaacatccatgcccccagatgagcagcaccctggctgagcagctccccaatgtcgggtgcatttttctctcagctcactgccacccttcacagacacatctaagtgacactggtggccccacaggccagtctctacagacatgcactgcagtccaagtagatcctgtttctcaggctgccaagggctcctcctcctttcaacccctcagctcctagacagaggtcccctccctcaaatttgatcacatgcaccgggcacacaccctgctccactaggcccaattttcccctgggagcctcagagacacatcccgtcactaaaataagattgagttcctcaagaatgttattctcaggtctgtcccacctaaccaaatgccttcagtttttgaatgtatttaatgtaaaaactcaagccatttatttgtttaaaatacatccctaagatctctgtccatctcattactcaatttcttagtggagcagttacaacagacaaagtgtccctcgtttcttttggagacagcgtctcactccattacccaggctggagtgcagtggcgcgatcttggctcactgcaacctctgcctcccgagttcaagcaattgtcatgcctcagcctctcaagtagctggaattacaggtgcatgtcaccatgcctggctatgtttttgtattttgagtacagatggggtttccccatgttggccaggctggtcttgaactcctgacctgaagttgatccaccagcctccgcctcccaaagtgctgggattacaggcatgagccatggcgcccagcagccccttgtttaatgtgcttgataatgagcccttccttggtcccccatactaacagaccctttcacaatagtgtgatggtgatgaatgtgtaacacatgacccaacttaagtatgatgttgactttctactttggattaaatcggagccatttaaagctgacttttggtcccacgaaagagcccctgtgccttacaaggatcaaaattgtaaaggaagggggaaaaggtggttaagtgtggaaaatcctttctgatcaacttattaagcatctgatcatccaataatggacactactatggaaaaagctaacctttgggctccatcttggaaacagctggatgtacatataaggacatgcctttttgttaagtcttgtgttactaattgtccccctttttaagacaaaatctacaacaaattcattcaacaacagcaaagctacaaagccatccaggttaccagtttcagaagacaagcttcaaagctgaactcgccacgtatgacctacgtctcacagaactgaagactactcaaacacagcaagattaatgaagcaacggagatctgttttgcagtacaacggcatttaaactactgtttccaaatttctcacttcaataagttcattttataagattaacgtcaaactcaacttttatcagctaaaaagaaaagcattagtgatttttatataccatgagcatcatttactcctccccactgtttaacaaattttaactagataagaatctccttatgattgatctttaaaaatcgcttttcacttctacattaatattaaacgtcgcttatcataacttgattccaggaattgtattcaaacttaagccacaaaattcaggttttgtttcaacagcaatagcagttttttttaatatgctagtggtcggtcacagaactatttccacaagttgaacagctgtgtctagtgcaaatctgaaggcagcgatgtaattcaatttggactcattcattagaaactgattttcagatgctaccactgcaagactactggagaaatgcaagctgcgctggagatggaattgttcgcagcggcacacaagtttttgcggcaaaggagagagctctaaaagaggaaatacaactagttcatgttaccatgaaccagcgcagtgggacccagaattactgaattaatagaaaactaaatacttctcttaagcagctatgataacttaagaaagtttccagggaagccgtttaatgaaaggaaacaaacaaaaagatgatttattcagtatcctgctccatttttttgaaaaattggaattcctacattccttaattctttgtacatctacactgtgaaagcaacacaaactcaaatggagattgcagcccaaatgaacttaaacctgctgtttaactttcttttgaagttatacatggaaatgaaacacaccacagcaactttcatgacatcttgctaacgaagtttgggttttgaaaaatggaatgactagttgactaaaaacacacacgcgcgcacacacacacacacacacacacacacaaaacaaggagttttgaaaataagcactaagcatctttccaaggaactcactcattccaagaaacttcggttctaactcgcaagctggcggctgctgtgagtgtcctctgaatgcagcctggtcaatgtgtcgccaatccagaaaacacactgccctacctttggccgcgatcttgctttctctaagcatcaaaggtaccctccgctgtcattcctctggacggccacgcgtgtggacacggccgcggatggatgcgtaggacattaccaaacaaacccacacgctgcactttacttcttccctcctggagtgccactagggtccccgcgaggagggctgatcgggtgcggggaggccgagtgcaccgggcgtgtgctgaccaactcgggcccagtgacagtcctgcgacgaacttccaccctcccgcgcggggcgaggggaacgggctgcggggcctgctccgagctcccggctcgatcggtatccgcgaccacgacccccggacgctctctttcaggtgggggtgacagcgcgccccgggcccccgccgccccggaccccctcctcacctgtgctgtcattcgccgagaaaccgggcgagctgagtttggctcttttggggttgggcggtccgtccagcaagttctcagccattttcacctgctcgcgaaaacagccccgggcacgggcggccgggccggcgagggcccggacgggggtcgggggccctgccggctgcgagggagaggagcgagcgcgggccgcgagcgggcgggcgggcgccgagggagagggagggcgcaggccgggtgggggaggcggcggccaaatctcagccacagcaacagcgccccgcagcgctcaccgcccgcccccggccgccgccgccgccgccggccgcggccccctcatcccctgcccgcctcccgagcgcgacactccgcggtgggggcgccccggcggcccggccgcccccccgggcccggctggcagcgacggcgcccggccgggcggctcaggcagtccccgagaacatggtgccgccgccgccgccgcctcgctccccccccgcgccccacttaatgaattcgctcgcggcccgacgacgagggggctccgggctccgctcccggcccgcggcccgccgccgccgccgccgtgaggaaaaacaatgcgccgagcggggtcgccgccgccgccgcggcccccccaccccccgttccgccgccgccgccgccgctgccgccgccgccgccgccgggctccgggaggccgagccgagaggcgagcggggccgccggggcgggcgccgagggccgggcggagcgggccggccgggcggagcggggtgcgcgggcggttgtggggcccgggaccggcggggccgagtagatcgcgctcgaagccccggtcgggtccgcgacaagatggcggctgttgattcctcaattaaaaaaaaaagaaagttttttttcttctctttccagagcctgaacggggagggggtgggggcggggcacgccggtgcgtcacccccccgcggcgtcaccacgcacggcccccgccccgccccctccacctgcgccggccgtggcggaaagagccgagcgtgctcgggccgaagggctgaaggcgcggccgccaagcgtagggaagctggcggcccggcgcgggccaggcctgcggggcgcctgggctccgggctgagccacagcttttgttctgatggcgaccaggcgtagagggccggggctccgggccccagcgggctccgggagcggcggcctggccgcgggctgggctctcgggcgcggattcgacgccagcccgggcccgcccgtcccgctggggcggcgctgcgtgttcccagctcctcgcgtccccttccccagaccctcctaggtggcgtcggtcgggaacggtcggggcgaccccagcccaggccgcgccactagccttcgccgccggccagggaagtggaatggcctctgcaggttacagaccgcccttgggtcctgccgacgaggtgggcggatggggaaactgaggcggggggcgagcaactgctccaaagtggtcgaggcaggaagtggcagggccgggattcgggtcccgccctacctcgtgacactagggagtgagggggcctcacgcctgttcgcatcccaaggcggcagggcagacaccctcacctgtgagagcggggtggcgagggccggcctgggcggagaagggcccgcgcatcggggcttaagcctggacgctcaggccgcactccccgccccaggcaacttgcctggcgcctcgcaggtgccccagacaggggtgcgggcctggggagtcccccacgcgagaccacagcccgcgggacacttctacgaatacccgaggtgttcccatcccagttagttatctgcccctccaaacttgcccggcttcctcataaaggtatcagcagctccactgtttcctaagccagaaacccgtgagtcagcgcggactcctccctctcacccgccacgcgcccctctacccacggtctttacctgggagactgctcctcccgcactgtcccggtggctatggtggcagctactcacttaagtgttctttgctctccacgttgctccccacgcagcaccagagttaacatcccgaaaagagagggagaaaatctgtttaaaacaactccctggccaggcgcggtggcagatcacctgaggtcaggagttcaagaccagcctggccaacatggtgaaaccccatctctaccaaaaatacaaacattagctgggcgtggcggcgtgcgcctgtaatcccagctactcgggaggctgagatgcgagaatcacttgaactggggaggccagtaagccgggatctcgccattgcactccatcctgggcgacaagagtgaaactccgtctcaaaaacaaaacaaaacaaaacaaaatcccagacatagaaaaagaaaacactacatagtctttctttaaaaaagaacacgtatgaattctcttaaaaacataggtgtatgtacatatggtgactgtccttgagtgtcaagattgagtgatcgttctgcttttctctgtttacctgtactgctcaaaatcttgggccgtgataccgctcttgaatctgtctcttctactttacatggctcacttcaccatcatcatcctacacccacttggccagtaggcagttcacatcattcaggctttttttttttttttttcaaatgctggtccctgtgctgagaagacatgcctggcaaattctaactcatcctccagaacccagttcaaatgtcacctactccaggaagccctcctagcccactcctcggctcccatatcacttctgggctctgtgagagaacacataacacatcctgccccatcttccccgcctccactgcccccgaattagttcatgtttttacttatgcatcaaatagctcttgagaatcccaagggcattgagactgtgctaatccccttggccaaacataaagagatccccatatattcaaggagttaaaatagcacaccctggaagccataaatggaagtattcaagaagtcagtttgcacaggaatggcaagaagtgtatcagtggcacagggcaggccacaccctgtatctgaatgctctgggtgtccgtctcaccaagggtctgtgagctccttcggggcaaagatggtgtcttagtcacagaaacagtgctctgcaagaagaagtaggtttgtaaaactgaatgagtgatgagctgtgtcaggtgctctgagtcctagaggccttcaggccactgaaaagggtgggccccagcctgaggtggctccaggccactcttcaaacgggacaaggtgtccagccacctagaggtcttagggcctgccttggggcagtggagacaccatgcagccccccaggggtccattggtgagtggtttacacagaagtgggcacaggagcttgagccattccctgacaggtttccattttacagaggaaagcaagggaactcagtcgcaaggactcagaagtaaataacccggacatggcaagtctgggcctggaacccatgtcctcactctccaaagaccctagtcttcctgtctcaccatgttccaccctcaaaatataccggctctgcagtccctttttctgtctcattgttctcacctgtatcattttgatcaattctggtattcactgatacctgttttttctttcctttcgatttcttctcccttcagtctgactcaaagaaccctgagctcagacactgatgggggaatagcaaggagggaagcgtggctcctgcctgcactcacttagctggggatcaccttcaacaagtgagtgccttagggataccaggccgctctgccatgcctcccatggatagcacttcctacaatcctggaaggaaaaattgtcctcatttcacagatgaagaaataaggcacaaaggaggacaagccacccagccacgaaggggcttcactccggtgcacacctaaggcttcctgctctttccacaaacctcaccctctccagtctcagataccacattaaaaaacaatcaaaggactgggcatgatggctcatgcctgtaatcccggcactttaggaggccgaggtggaaggatctctagagcccaggagtttgagaccagcctgggcaacagtgagaccctcatctctacaacaaaatgttaaaaagtgaactgggcgtggtggcatgcacctgtagtcccagctgcctgggagaccaaggcaataggatcactggagctcaggaggttgaggctgcagtgagctatgatcaaaccactgcactccagtctgggcaacagtgagatactgtctaaaaaaaaagaaaagaaaagaaaagaaagagaaagaaatggaattggaattgttggctggatgcggcggctcacgcctgtaatcctagcactttgggaggctaaggtgagtggatcacttgaggtcaggagttcgagaccagcctggccaataaggtgaaaccctatctctactaaaagtacaaataaatggctgggcatggtgggggggcacctgtaatcccagctacttgggaggctgaggcagaattgcttgaacccgggaggcggaggttgcagtgagccaagatcgcactccagcctgggcaacaagaatgaaacttcgtctcacaaaaaaaaaaaaaaaaaaaaaaagaaatggaattgttgcaatttgatattgattgtccctttctaggcttaaatagattaaaagatagcatcaggtttggactttgccttcaagcgatgcagaacagcattggggagaaaaacacaaacaggacacacattgaaaagataagcagagaatccaagtcagaatagcacaaaatcataataactgatcccccaggggtgggagtcccggggttggggggcagaggcctgggggagtagtcccaggaaggcaggattccagccagttcctggtggacagaaggcagaatgtggtctggtggtgtggagggatccagacagagctaggttcaagtcccaaacctactgctttttcttagctgttttgaaaacaaatacctcggccaggtgtggtggctcacacctgtaatcccagcactttaggaggccaaggcgggcagatcacctgaggttgggagttcgagacctgcctgaccaacatggagaaactccatctctactaaaaatacaaaattagccggccttggaggtgcatgcctgtaatcccagctactcgggaggctgaggcaggataattgcctgaacccaggaggcggaggttgtggtgagccaagattgcaccattgcactctagcctcggtaacaggagcaaaactccatctcaaaaaaacaaaaaaagaaaaaaaaaaacaaatacctcctcacctgctgagacagttgaggtgcggtggagatgagatggagggtgcacagggtccctggcacaccaaggcaccatatagctgctatttggggcagtgggaagcaggcgctcaagggtgagaggcccctctcctctctctgccgtccacatgggaggctgcacccgcccctctcgtgggggacttgctgttgcttttttttttttttaattatactttaagtgttagggtacatgtgcacaatgtgcaggttagttacatatctatacatgtgccatgctggtgtgctgcacccatttactcgtcatttagcgttaggtatatctcctaatgctatccctcccccctcctcccaccccacaacagtccccagagtgtgatgttccccttcctgtgtccttgtgttctcattgttcaattcccacctatgagtgagaatatgcggcgtttggttttttgttcttgcgatagtttactgagaatgatgatttccaatttcatccatgtccctacaaaggacatgaactcatcattttttatggctgcatagtattccatggtgtatatgtgccacattttcttaatccagtgtatcattgttggacatttgggttggttccaagtctttgctgttgtgaataaagccgcagtaaacatatgtgtgcatgtgtctttatagcagcatgatttatagtcctttgggtgtatacccagtaatgggatggctgggtcaaatggtatttctagttctagatccctgaggaatggccacactgacttccacaatggttgaactagtttacagtcccaccaacagtgtaaaagcattcctatttctccacatcctctccagcgcctgttgtttcctgactttttaatgatcgccattctaactggtgtgagatggtatctcattgtggttttgatttgcatttctctgatggccggtgatggtgcgcatttttcatgtgttttttggctgcataaatgtcttcttttgagaagtgtctgttcatgtccttcgcccactttttgatggggttgtttgtttttttcttgtaaatttatttgagttcattgtagattctggatattagccctttgtcagatgagtaggttgcaaaaattttctcccattttgtaggttgcctgttcactgtgatggtagtttctttagaaaaccccattgtctcagcccaaaatctccttaagctaataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaacttacaagggatgtgaaggacctcttcaaggagaactacaaacaactgctcagtgaaataaaagatgatacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccacatcgccaagtcaatcctaagccaaaagaacaaagctggaggcatcacgctacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatccgttccttacaccttatacaaaaattaattcaagatggattaaagacttaaacgttagacctaaaaccataaaaatcctagaagaaaacctaggcattaccattcaggacataggcatgggcaaggacttcatgtctaaaacaccaaaagcaatggcaacaaaagccaaaattgacaattgggatctaattaaactaaagagcttctgctgttgctttttaccatcactgcccctgaatcttttctcccttacttaccccagtacctccttttccttaaacacattggcagtcagcttcagcttcagccctgattccaccctgtctcttccattcctagctaaggaaacttgaacagggtgtctacaaaggctgggctcatttcctcttctcccatgccctgtgtttatttttattttatgttattttatcattattattttgagacggagtctcactctgtccccctggctggagtgcagtggcacgatctcagttcgccacaacctctgcctcctgagttcaagtgattctcctgcctcagcctcccaaatagctgggactacaggcacccgccactatgcccagctaatttttgtatttttagtagagttgggggtttcaccatgttggccaggctggtctcgagctcctgaactcaggtgatctgcccgcctcggcctcccaaagtgctgggattacaggcgtgaaccatcgtgcccagcctatttttatttttgagacatggtcttgctctgtcacccaggctggagtgcagtggtacagtcatggctcaatgcagccttgacctctcctgctcaagtgatcctcctgcctcagcctcccaagtaactgagactacaggtgtgcaccaccatgcccagctaattttttttggagtcttgctgtattggccaggctgatcttgagttcctggcttcaagtgatcctcctacctcaacttcccaaagtgttgggtttacaggtatgagccaccgtgcccatagagaatttccttccttatgaacgatgaatattccatcgtatggatggaccacagtttgcttatccattcatctgttgacggatacggaactgcttccaccatgcagctatcatgattaatgctgtggtgaacgtggatgtatttcttttcttcccaaccctgctttcaattcttttttttgtttgtgtttagatggagtcttgctctgtcaccaggatggagtacagtgacgcgatctcagctcactgcaacctctgcttctggggttcaagcgattcccctgcctcagcctcccgagtagctgggactacaggtgcccgccatcatgcccggctaatttttgtattttagtagagatggggttttgccatgttacacaggctggtctcaaactcctgggctcaagtgatcctcccacctcagcctcccaaagtgctgggattacaggcgtgagccaccgcacccggcctgctttcagttcttttgggtatatacccagaagtgggataattgctgtctcatatggtaattctacttttgattctataaggaactcccatactgttttccatagcagctgcatcattttacattcctgccagcagtgtacaagggttccaatttctccacttcctcaccaacacttatgctgttttgttcttttcttttctgataatagtcatcccgatgagtgctatctttcagttcattccttttagccgctgtcttgtattctactgcaggaacaaagcacattttattgatctattctcctcctaagggactggtagattgtttccacttttttcctgttacaaacggggctgcaattaatgttcttgtacaggtttccttgtgcacctaagagcatcaccagatgaacactgagaagtggatttcctgggtttaaggttatagcaggcagagcccccgtagaatcagccagcttatggaaggtttcatagaggaactgcgtacacagttagggcgggttgcaaggaaaccataagggatagggcagcaacctagggcttgtagcagctgagctgttactgccacaaggcccaaagggacacagaagggaaagcttcccagacccggaaagaaaataattgtgtagagatggtcatcttgagaggggtgatcttttgcagagggactcagctgacttgaggtgaccaaataccgtgaccactctttctttttttctcccttccctttccctttcccttccttttcccttcccttccccttccttccttctctcctttcttcttctctttccttcccctcccctcccttccccctccccctcccctccctccctccctccctccctccctccctcccttccttccttccttccttccttccttccttccttccttccttcctttcgatggagtctcgttctgttgtccaggctggagtgcagtggcgtgatcttggctcactgtaacccccaccttttgggttcaagcgattcttctgtctcagcctcctgagtaactgacattacaagcacatgccgccatgcctggctaatttttgtatttttagtcgagacagggtttcaccatgttggccagactggtctcaaactcccggcctcaggtgatctgcccaacctcgcctcccaaagtgcagggattacaggtgtgagccaccgcacctggccagtttccttttttaaaatttttttaaaaatttttttgtagagataggtcatgctttgttgcccaggctgatcttgaactcctgggctcaagcaatccccttgcctctgcctcccaagatgttgggattacaggcgtgagtcccatgcctggctttccttcttccttctttcctgtctgtcttcctctctctctctctctctttctctttctctctctctttctttctaacagggtctcagggtggagtgcagtggcacgatcacagctccctgcagccttgaccacccaggctcaagcagttctcccacctcagcccaccgagtagctgggactacaggcatgtgccaccacaccggctatttttttttttttttttactttctgtagcgacagggtctcatgttgcccaggctggtctcaaactccggggctcgagcaatcctcccactgcagctgcccaaagtgcagagatgataggtgtgagccaatgcgcccagcctttccttccttctgatctcccgccagggtgcccactaggaacccaagcccaaggcatggtagcctgtccaagtcagcctcctgaggccagggcaacgtggaaaggggtgaagggatcgattcgagggctatccagaagatgtctggcacatagagtatagccatcctcaactgtagggggaatttccaatttgcatttatttaattatttatttagttagtgagtgagttagttagtttttgagacagagtcttgctttgtcgcccaggctggagtgcagtggcgcgatcttggctaactgcaagctctgcctcctgggttcacgccattctcttgcctcagcctcctgagtagctgggagtacaggcgcccgccaccacgcccggctaattttttgcatttttagtggagacagggtttcaccgtgttagccaggatggtctcgatctcctgacctcgtgatctgcccacctcggcctcccaaagtgctgggactacaggcatgagccactgcacccggcctatttattttttttgagacatagtctcattttgtcacccaggctagagcacaatggtgccatcttggctcactgcaacctctgcctgcctggtacaagtgattctcctgcctcagcctcccgagtagctgggattacaggcgtgcacccccatgcccagctaatttttttgtatttttagtagagatggagtttcgccatgttggccaggctgttcttgaactcctgacctcaggtgatccgccttcctcggcctctcaaagtgctggcattacaggcgtgagccaccgcgcccagcccaatttgctttccaaaatgattttatccatttacattcccactagcaacttatgctatctatatacccacatctttgccaacattagctgttatttaccagacttaattttcattaatttgagttttttcccagccttcggggatgaaatggtgcctcttaattttagtatgctcttccctaattactaatgaggctattttcacatacttatttgtttaggggaggttttatgtactatggattgccttatcctttgctcttttgctgttgggttttttatctttctcagattcattaatcactttctttttaaattttggatgctaatccttcataaataaattgtctaactgtttggtccggcgtggtggcccacccctgtaatcctggcattttgggaggccgaggcaggaggattgcttgagcccaggagtttcagatgcacttgggcaacacagtgagaccccatctctgcaaaaaaaaaaaaaaaaaaaaaaaagttaaaaattggctgggcataatggcacgcacctgtaggcccagcctctcaggaggcggaggtgggaggatctcttgagtccaggacctggaggctgcagtgagctataatggcaccactgcactccagtatgagcaacacagtgagaccccatctcaaaataaaaaacttgtagctattctttcctgtctgtgacttatcttttcccttgcagtattttttgttatacagaacttctatattttttttttgagacagggtcctgctttgttgcccaggctggagtgcagtggtgcgatcttggctcgctgcaatccccgtcccgggttcaagcgattttcgttcctcagcctcccaagtagctgggattataggtgcttgctaccacgcccaggtaatttttgtatttttagtagagatggggtttcaccatgttggccaggctggtcttgaactcctgacctcaggtgatccccctgccttggcctccttaagtgctggcattataggcttgagccaccacacctggctggatgtttacattttcatctcttcaaattgattactcttgcccttcatggtatgtatctgtggcttagatctccttccctactctgatgtcataaaaatggtttcccatgttttcttctagaaatttgagttttgctttttcacatttgggtgttcagagcattctgggactgtgcatgtgagcatacacatgtgtgtggtttgaggtagagatttacttctttttccttacagatagctggttccctttatgaaatactccatctttgtgctttgatttctaatgtcaactcttttattatactaagatcctctttcttgctctgtttttcctctttctttcctttttttttctttcccttctttccttccctccctccctcccttcctccctccttccttcctcccttccttccttctttccttccttgcttttttttcttctatttctccctcatctctccctcccttcctcatccttttcctttcccgttccatttccttttccctttcccttttctttctttcgaggcagggtcttgctctgttgcccaggctacagtacaatggcacaatcttgactcactgcaacctccgtttcctgtgttcaagcgatactcctgcttcagcctcctgagtagctcggattacaagcacgtgccaccacacccagctaatttttgtatttttagtagatataggatttcatcatgttggccaggatggtctcaaactcactcctgacttcaagtgatctgcctgcctcggcctccctaagtgctagaattacaggcgtcagaccccgagcctggccccaacatcctctttcttctgtcagttggcctatttgtatcccactgcaccaatattacaatgtttaaaatctttccaagtaagggtaactcctggtctctggagaggagagtttcccccacccctcttccctttcaaagttgtctttactactcttgactcttttggtcttccatgtgaatttcaatttttcaaggagtgtgaagaaaaagttgggcttttcattggaattgctttgaatttgtaaattaacttgaggaaaattgccatttaaaaaatcgtgtgtcttggccagctgtggtggctcacacctgtaatcccagcactttggaaggccaaggtgggtagatcactggaggtcaggagttcgaggctagcctggccaatatggtgaaaccccgtctctactaaaattacaaaaattagccaggtgtggcggtgggcgcctgtagtcccagctacttaggagactgaggcaggagaatcgcttgaacccgggaggcagagggtgcagtgtgccgagatcatggcactgcactgcagcctgggtgacagagtgagactccatctcaaaaaaaaaaaaattgaaataatgactgatatggaatgatactaagaagttaccattaattttttattttattttaatttttgtagagggtggggtcttgctatattgcccaggctggtcttgaactcctggactcaagcaatccgcctgccttggcctcccaaattgctgggattacaggtgtgcgccactgcccccagccagttatttaaagtgtgatggtaacattgtgattatgtattttaaaatagtccttaactttagagacataggctgaaatatttataatctataaacattacagtataacatatatagatgtatataaaatacagtatgataataggatgcctgggagtaggtgggataatagatgaaacaagattgggcaggaatagatagttattgaaactgagtgatgggtacctgagaattcattactttattctgcatacttttgtgtatttcaaaaattcctataataataaaagtttttaaaatatgagggccaggtggctcctgcctgtaatctcagcactttgggaggctggggtgggaggattgcttgaggctaggaagtcaaggccagcctgggcaacacagcaaaaccccatctcaacaaaaaatttaaaaattagccaggcatggtgatatgcacctgtagtctcagctacttgggaggctgaggcaggaggatcacttgagccaaggagtttgaggctgcagtgagctgtgattgtgccattttactccagcctgggcaacagagtgattattattaaacagtgtattattatacagtatattattatagtataatagtataatagattagccttatagtataacaatacaaatatggaaatattgagtctttccatccacagacatgatatagctattcttttatttacattttcttctgtcttgcaataaagttttatatttttctccataagggcctgcccatcttttagctgatccaacagatttgccagactcttctattagttccaatcatattaatatttttttctccagaatgtcttgtattttttgtgtaggcctttgaatcatatgttaaaaaataaaataaaggccggatgaggtggctcacccctataatcccagcactttgggaggctgaagcaggaggatcacttgaggtcaggagtccgagtccagcctggccaacgtggtaaaacccgtctctattaaaaataggaaaattagccaggtgtggtggtgggtgcctgtaatcccagctactcaggaggctgaggcacaagagtttcttgaactcagggggtggaggttgcagtgagccgagatcgtgtgacgacactctagcctgggtgacaaagcgagtctccatctcaaaaaaacaaaacaaaaccaaacaaaactgtagttttgtatgtttactgtaccttttctatgtttagacatgtttagatacataaatacttaccacggggttacaactgcccacagtactcagtgcagtaacaagctgcacaggtttgtagcccagggaacaatgggctgtaccatgtatcctgggtgtatggtaggctgtaccgtctaggactgtgtaagggcaccctgtgatgttcacacaatgatgattccattgcctaacgatgcatttctcagaacataactctgttgctaagtgacacttggctccattgctaagtgcagtgacaagtgtccgtataagaaggcagagggatatttgacacagaaagaggagacagacacacagagaagaaaatatgcagacagaggcagagatttaagtgatgcagccacaagccaaggaatgctggcagccaccaaaaaccagaggcaagtgacagattcctcctccagagtcttcaggttgagcatggatctgatgacaccttaatttcagacttccagcctccagaactgttagataatagacttttgttgtttggtttgtttgttgtttttgttgttgtttgagagtcttgctctgttgctcaggctggagtgcagtggcacacaatctcagctcactgtaatctctgcctcccaggttcaagcgattcttgtgcctcagcctcctgagtagctgggattacaggcatgcacccccatgcctggctcatttttgtatttttagtagagacagggtttcaccatgttggccaggccggtctcaaactcctgacatctagtgatccgcctgcctcggcctcccaaagtgctgggatcacaggcatgagccaccacacctggcctgatttttgttgtttgaagccaccaagtttgtggcaatttcttgcagcagcttcagctagcgaatacatgattaaactagaaaaatcttataatcatctcctgatgaaaaacacccatctgacaaaattcaacctattcataattttttaaaaagagataaagagaaaaaaaaactctcagtaaactaaaatagaaggggtcttctttgacctgataacaggcatctatagaaaacctacaacaaaagtgcaatacatttttaaaaattgatcacttggggccaggcgcggcggctcatgcctgtaatcccagcactttgggaggccaaggccggtggatcatgtgaggtcagaagttcgagatcagcctgactaatacggtgaaatcctgtctctactaaaaatacaaaaattagccaggtgtggtggtacatgcctgcaatcccagctacttgggaggctgaggcaggagaatcgcttgaacctaggagacggaagttgcagtgagccgacatcacgccactgcactccagcctgggcgacaagagcaaaactccatctcaaaaaaaaaaaaaaaaattgatcaattggacctcatcaaaatgcaaatcttctgttcttcaaaagataccatttaaggccgggcgtggtggctcacgcctgtaatcccagcactttgggaggccgaggcgggcagatcacgaggtcaggagatggagactgtcctggctaacactgtgaaaccctgtctctactaaaagtacaaaaattagccggcacagtggcaggcatctgtaattgcagttcctggggaggctgacgcacaagaattgcttgaacccaggaggcagaggttgcagtgagccaagattatgccactgcactccagcctgggtaacagaatgagactgtctcaaaaaaaaaaaaaaaaaaagggagaagaaaagaacctcaaaattattgatcatttatttggaaagtgcaatttgaaaccacaatgaggtaattttttttttttttttgagacggagtttcattcttgtcgcccaggctggagggcaatggcatgatctcggctcaccacaacctccgcctcctgggttcaagcgattctcctgcctcagcctcctgagtagctgggattacaggtggctgccaccacacccggctaatttttgtatttttagtagagacggggtttcaccatgttggccaggctggtctccaactcctgacctcaggtgatctgcccacattggcctcccaaagtgttgggattacaggcataagccaccacgcccagccgagataatatttaacaaccaccaggaatggctacaataaaaataaataaataaataaagtaattaattaaattaaaataacaagtgttggcgaggagaaacaaaatcactcatacattgctggtgggtgtgtaaaatggtgctcttcggaacaaatagtttagcaattctttaagaagtttaatgcggccgggcatggtggctcatgcctgtaatcctagcactttgggaggccgaggcgggcggatcacaaggtcaggagttcgagaccagcctgaccaacatggtgaagccctgtctctactaaaaatacaaaaattcactgggcgtggtggtgtgcacctgtaatctcagctacttgggaggctgaggcgggagcattgcttgaacccaggaggtggaggttgtggtgagctgagatcgtgccattgcactccagcctgggcaataagagtgaaattccatctcaaaaaaaaaaaaaaaaaaaaagtttaatgtacccaagtgcatgcctgaagcctcagttacttgggaggctaagtcaggaggatcccttgagcccaggagagcaagaccagcctagtcaacacagcaagacttcatctccataaataaataaataaatacatacatgtttaatatattcttaggtatgacaccagaagtacagggcaacaaaagaaaaaaaaagataaattgtgctgggcgctgtggcttacgcctgtaatcccagcactttgggagtccgaggctggtggaacacttgatgtcaggagttcgagaccagcctggccaacatggtgaaaccccgtctctactaaaaatacaaaaattagctgggcctggtggtacgtggctgtaatcccagctactcgggaggcagaagcaggagaatcacttgaacccaggaggcggaggttgcagtgagctgagatcgtgccaatgcactccagcctgggtgacagagtgagactctgtctcaaaaatacacacacacacaaaacccacagtgagataccacttcacacccaccaagatggctgttataaaaaaaccagaaaataacaaatgtacattgcaggtgggaacataaaacagcacagttgctgtagaaacaatatggtggttcctcaaacataacataaaattaccatatgattcagcaaccccatatcaaggcgaatgccttaaagaagtcaaagcagagatgtgttcacagcggcattattcacaatcgccaaaatgtggaagccacccaggtgttcttccatgggtgaatggagaaacaaactatggtccatccgtacaatgcgctatgattagccttcaacaggaatagccttcaacaggaagtgcgttctgacacttgccacaacgtggacgacatggctggaccttgaagacttgctaataagccaaatgcaaaagggccagtattgcatgattccacttacatgatgtacctcgtaccagtggaagagtcaaagggaataggtgaattcagaggccaggtgcggtggatcatgcctgtaatcccagcactttgggcggctaaggcgggtggatcacttgaggtcaggagtttgagaccagcctggccaacatggtgaagccccatctctaccaaaaaattaaaaaattagccgggcatggtggcacgtgcctgtagccccagctactcgagaggctgaagcaggagaatcacttgaacccgggaggcagaggttgcgagagccgagatcacaccgctgctctccagcctgggtgacagagcaatactctatctcaaaaaaaaaaaaaaaaaaaaaaaaaaaaaaaagttgagttcggatacaaaaacttgaatagtggttacagtagctgggaggaggggaaaatggcaagttcatgtttaatggggataataattattcagtttaggaagatgaaaaagttctggagaaaaatagctgtgatggtcacacaacagtgtgaatacggttaatgccactgaactgcatgcttaaagaatggttaagattggccaggcatggtgcctcacacctgtaatgtcaggactttgggaggccaaggtgggtggatcacttgaggtcaggagtttgagaccagcctggccaacatggtgaaaccccctctctaccaaaaaattaaaaaattagctggacgtggtggtgcgtacctgtagccccagctactcgggagggtgaggcaggagaatcacttgaacctgggaggtggaggttgcagtgagctgagattgcggcattgcattccagcctgggtgacagtcagactccgtctcaaacaaaaaccaaaaccaaaacccaaattttcagacgtaacaccaaaaacacaagcagcaaaaaataaataaataaataaaagaatttgacttcatcaaaatttaaaacttttgtatttcaaaggcactgtcaagaaagtgaaaataatggggaaaatatttgtaagtcatatgtctgtcagagaactgtatttagaatatataaataactcttacaagtcaataataaaaagacggccaggcgtggtggctcacgcctgtaaccccaacactttgggaaaccgaggcgggtggatcacctgagatcaacagttcgagaccagcctggccaacatggcaaaaccccatctctactgaaaatactaaaaatttgccaggcatggtagcgggcgcctgtaatcccagctactcgggaggctgaggcagaagaatttcttcaacctgggaggtggaggttgcagtgagccgagatcgcgccattgcactccagctgggcaacaagagcaaaactccgtttcaataataataataataataataagaagaagaagaagacaaataacccagttaaaaatgaacaaaagggccaggcgtggtggctcaagcctgtaatcccagcactttgggaggccaagacgggtacatcacctggggtccggagttcaaaaccagcatggccaaagaggtgaaaagaaaccccacctctactaaaaatacaaaagttagccgggcgtggtaccacgcgcctgtaatcccagctattcgagaggctgaggcaggagaatcgcttgagcccgggaggcagagggtgcagtgaactgagatcaggccactgcactccagcctgggtgacagagcgagactccgtctcaaaaacaaaaaaacagaaacaaaaacaaaaacaggacaaaatatctaaatgggcatttttctgaagaaagtatacaaatggtcaaaaagcccacaaaaacatataaacatcattagttaccagggaaaggcaaatcaaaaccacagtgagataccacttcacacccactagggtcactataattaaaaaaaaagaagagaaaaagtaataggtgtcggcaaggatgtagagaaattataacccttgtggactgctgatggaaatgtaaaatgctgtagcctctgttgaaaacggtctggcagttcctcaaaatattaaacatttgatccacaaattctactcctagatatataccgaagagaaataaaaacctatgtctacaaaaaacttgtacacaaacgttcttaccaatgtcagtcatgatggtcaaaaggcggaaacatatcacatgtccattaactaatgaatagatgaagaaaatgtgatctatccatgcagtgcagtattatccaaccatagaaaggaattgagtattgatacatactacaacatggaagaaccttgaaaacattctgttaggagaaaaaaaccaaacataaaagccacatgttacatgattccattgatataaaatgtccataataggcaaatccatagaaacagaaagtagatcagtgttgcttagggtggagggtgaggataagggtagggggaaagggaattgatagttaaagggtataaggacttctttttgctataatgaaaatgttcaacaattgattgtggcaatggtgcacaactctgtcagtatatcaaaaccattcaattgtcaaaaaaaaaaaaaagttaaaaaaatttaccggccgggcgcggtggctcacgcctgtaatcccagcactttgggaggccgaggcaggaggatcaccaggtcaggagatcgagaccacggtgaaaccccgtctctactaaaaatacaaaaaaattagccaggtgcggtggcaggggcctgtagtcccagcttcaggaggctgaggctggagaatggtgtgaacccaggaggtggagcttgcagtgagattgcgccactgtactccagcctggggcgacagagcgagactccgtctcaaaaaaaaaaaaaaaaaaaaattaccatatgacacagaaattaggtatctacacaagaaaaatgaagcatatatctgcacacagacttgcacacaaagttctgagcatcattcttcttctttttgagacagaatctcactctgtcacccagcatggagtacactcgcatgatcacagctcactgctccctcccgggttcaagcaatcctcttgcctcagcctcccaagtagttgggaccaaaggtgcagcctccatctctgaggctcaaaccattctcccgcctcagcctcctgagtgtctggaactacaggcatgtgccaccacgcttggaaaatttattttttaaatttttttaattttagtagagacaaggtctcattatttcgtccaggctggtctcaaactcctggcctcaagggatcctcccgcctcagcctcccaaagtgctgggattacagatgtgggccactgtgcctggccagttttgttattcttttttttgttgtttaagttctgttgcccaggctgcagtgcaatggtgcagtcttggctcactgcaatctccgccttctgggctcaagcaatcctcttgcctcagccccccaagtagttgggaccaaaggcgtgcaccactacacctagctatttgcctagctacatatttacttttttttttgtttttgagacaatctcactctgtcgcccaggctggagtacagtggtgcaatcttggctcactgcaatctctgcctcccgggttcaagtgattctcatgcctcagtctcctgagtagctgggactacaggcatgcgccacaatgcccagatatatatatatacatgtatatatatgtgtgtgtgtatatatatatatgtgtgtgtatatatatatacgtatatatacgtgtatatatacatgtatgtgtatatatacatgtatatatacatgtatgtgtatatatatacatgtatatatacatatatatatatagagagagagagagagagagagagagacagtcactctgtcacccaggctggagtgcagtggcatgatcgtggcatgatcatggctcactgcagcctcaacctttcagtctcaggcgatcctcccacctcagcttctagagtagctgggactacaggcacttgccaccacactcagctaatttttgtattttttatagagatggggttttgccatgttgcccaggctagtctcgaatccttgagctcaagtgatcctcccatcttggcctcccagagtgctaggattacagacatgagccactgcacccagctagcccagctaatttttgtatttttcgtagagacaggtttcgccatcttggccaagctggaatcgaactcctgggctcaagcgatccatccgcctcggcctccaaaagtgctggcattaacccgctttttgaacaaggggccctgcattttcattttgcactggcccctgcaaatgatatcaccaggcctgaggccatgagcaggtgccgcttcagacaccccggcttcagggtttcaaatgacaaaatccaaacttggcttctctccacacctcagacttggcctcctttcattggcttcaatctcagtcctcctgcagaggcaggacagagacagtagctccagaaccagcagcagcagtaacagctaaagtctttcctgcaaaccccagcaagccctcctccttgagtttcaaggagcctcgtgcccttcctggatctattgctcctattgggagtgcgatgccggaatgggtttcgtcctgattcatgtactcagcctcatctgagctgagactagaggagatgtggacctggaagtgaaaagcaggggacagtagccagagatgagcaaaggagaacttgggcaatgacagcaatgcctatgccttcctggatgcccagtagccacaaatcccctccttccttactcacagccacagaaacacatctgcacacactgaccatgcatttacttcctccttggggggagcaaactcagtttttctttcttttttctttttttttttttgagacagagtctcactctgtcacccaggctgaagtgcaatggcacaatctcggcggctcactgcaacctccgcctccaagattcaaccgattctcctgcttcagcctcctgagtagctgggactataggcatgcgttaccattgcctggctaatttttgtatttttagtagagatggggttggtcttgaaccaggctggtcttgaactcctgacctcaaatggtccacctgtctgggcctcccaaagtgctgggattacaggcatgagccactgtacccagccccaacccagttttatccagccactgtttcccactctaggactggaatctgtttttttgtttgtttgtttgtttttgttttgagacagagtctcactctgtcacccaggctggagtgcagtggtgtgatctcggctcacggcaacctcagcctcccatgttcaagtgattctcctgcctcagcctcccgagtagctgggatcacaggcatgtgccaccacacctggctaatttttttttgtatttttggtagagatggggtttcaccatgttggccagactggtctcgaactcctgatctcagcctcctgtcttagcctcctaaatctaggactggtatctttgataacttggcatttctgctaagtctgggatgtgggtcctcatagtctggccacctatggctgaatgaggaatttgaccaacccagcccatgaagggggtaattctagaaagagacctataaaaccatccaaaacccaggccaggtatggtggctcatgcctgtaatcccagcactttgggaggccaaggcgggtggatcacttgaggccaggagttcaagaccagcttggccaatgtggtaaaagcctgtctctactaaaaatacaaaaagtagccaggcatggtggtgggcgcctgtaatcccagctactctggaggctgaggcaggagaatggcttgaacctgggaggtggagactgcagtgaactgagattgtgccactgcattccagcctgggcgacagaacaagactccgtctcaggaaaaaaaaaaaaaaaaaaaaaaaaaaaaaaaaaaacagagctgggcgcggtggctcacacctgtaatcccagcactttgggaggccaaggcggtcggatcacgacgtcaggagatcgagactgtcctggctaacacggtgaaaccctgtctctactaaaaatacaaaaaattagccgggtgcaatggcgggtggctgtagtcccagctactcgggaggctgaggcaggagaatggcttgaacccaggaggcggaggttgcagtgagccgagattgtgccattgcactccagcctgggcaacaaaagtgaaattctgtctcaaaaaaaaaaaaaaaaagtaattaaaaatttaaaatagagacaaggtctcactatgttgcccagcctagtctcaaactcctggccttaagcgattctagtgctcttctggacagttccacaggtgagagtaactgaagccaaacattggtcaagtcagggtctctggatagaaactgtgccatgggaattcctgttcttatcaacaggtctctggcttgcctctgctgccagcgccacaccatggctaccctctgagtctgtgctgccatcttggccaccacccccctggggtttctgccctcaggctgcatgccagctacgctttacaaaagaaaagagaggctttgcacagaccagtgctgagatcaatcatgaaccaagaggtgaatcactcaatgcttgctccctggggtcaaaaaacagacagaggaaaaaaaaaagactaaaagcaaacaaattaattaattcatgtatcacttgcaaaagttttcaaaatttaaagttttcaaattatatatatatatatatatatatatatatatatatatatatgattttattttaggttctgggatacacgtgcaggacgtgcaggtttgttacacaggtaaacatgtgccatggtggtttgctgcagctatagacccatcacctagatattaagccccacatgcattagctatttattctgatgctcttccttcccccgccacctccaaaattaagtttttaaaaaattgtgagaaaaactcaaggaccaaaggaaaaaaaaaagacaaatttaacttcatgaaaaaactttttttttttttttgagacagggtccctctccgtcatccaggctagaacgaggtggcacaatcatggctcactgcagcctttatctacctggctcaactggtcctactgcctcagccccccaagtagctggggctacaggtgcacgccaccacatctggctaattttttaattttttattgagacagggtcttgctatgttgcccaggatggtctcaacctcctggcctcaagtgatccttctgcctcagctcctaaagtactgggattacaggggtgagccaccatgctcagctgttcatgaaaaaatttaaaatttgtgctaaaagacactatcaacagagtaaagaaacaacccacagaatgggagaaatatttgcaaatcatatatctgatgagagattgacatccagaatatatacacacctcctaaaactagacaacaaaaaacaaacaacctgattcaaatatgggcaaaggacttgaatagacgcttatccaaagaaggcatacaaagaaccaaaagcacatgaaaagatgttcaacatccctaatcattagggaaatgcaagtcaaaaccacaatgagataccatctgacaccccttaggatggctactatccaaaacccagaaaataacgagtgtaggtgaggatgtgagaaatcggaatccttgtgcactgctggtaggaatgtacgccggtgcaatcactttggaaaatggtatggcaattctttaaaaaattaaaaatagaattaccatatgatcagcaattccatttctggctacatacccagaagaaccaaaagcagggtctggaagaaatatttgtacaccgatgtccatagcagcatttttcacaatagccaaaatgtagaagcaaccagactgtccaatgacagataaacagctaaactaaatccaggccaagcatgcaatggaatactattcagccttgaaaaggatggaaattctgacacatgccacaacatggataaaccttatgctaagtgaaataagccagacacaaaaagacagatactattaatatgttattccacttatataaggtacctagaggagtcaaattcatagagaaagaaagtagaatggcaggctgggcacagtagctcacacttgtaatgtcagtgctttgggaggccgaggcaggaagatcacgtgagtccaggaggtcgagaccagcttgggcatcatagagagacccccgtctctacaaaaaataaaaaaattaggtggctatctatggtgacatgtgcctgtagtcccagctatgtgggagactgagttgagaggatcgcttgagctcaggagatcaaggctacagttagctatgattgtgccactgcactcaagcctgggcaactgagtgagaccctgttttgttttaaaaaacaaaacaacaacaacaaaaaaactcagctgggtacagtggctcgtgactgtaatcccagcactttgggaggctgaggcaagaggactgcttgcgcccaggagtttgagactgcagtgagctatgatggtgacactgcacttgtactcagcctgggcagcacagcaagaccccatccaaaaaaaaaaacccacaatgcttaaggaggaaaaaatataaatgactaagatgatcaattttatgttacatgtattttaccacaataaaaaaagtagtaaagtagtttaaaaaaaagaccatgagaggctgggcgctgtggctcatgcctgtaatcccagcactttgggaggccgaggcgggcagatcatgaggtcaggagttcgagaccagcctggccaacatggtgaaaccctgtctctaccaaaactacaaaaattagcctggcatgatagtgcacgcctgtagtcccagctactggggaggctgcagcaggagaatcgcttgaacctgggaggtggaggttgcagtgagtcgagatcggaccactgcactccagcctgggagacacagcgagactccatctaaaaaaaaaaaaaaaattgtgagaacaatccagggactagaggaaccattttcaattaaggatcaaaaggcatcaccagttttaaggaggagccaagggagttgcctggatgcctgcaggtgactgacaggtgactggggtgtgggcagggcctgcagagggctgagtgagtccccagttccctcagagccatcagcagaagcccaggggacagagtgctttctcttatggaggttgagagtggaaaaccacaccacaggagggagactgagtggcgagaaccgagatgttggcaaacacatctccaacaaggtctgccctacctgtcctgggcaacatcatggaacacagcaatcaggcatctgcggcaagcttgtgcaaaggcccctcccccccccccttttttttttttgagacagagtctcgctctgttgcccaggctggagtgcagcggcaggatcttggctcactgcaatctccgccccccgggttcacgccattctcctgcctcagcctcccaagtagctgggacttacaggcgcccgccaccatgcccggctaattttttttgtatctttagtagagacagggtttcaccacgttagccaggatggtcccgatctcctgaccttgtgatccgcctgcgtcggcctcccaaagtgctgggattagaggcgtgagccaccacgcccggccatgtattttttttagtagagactgggtttcaacatgttaaccaggatggtctcgatctcctgaccttgtgatccgcccgccttggcctcccaaagtgctggaattacaggcgtgagccaccacatccggctttttttttttttttttggagacggagcctcactctgtagcccaagctggagtgcagttgggtgatctcagctcactgcaacctctgcctcctaggttcaagcaattctcctgcctcagcctcccgaggagctgggactacaggtgcgcaccaccacacctggctaatttttgtatttttagtagagacggagtttcaccatgttggccggggtggtctggaactcctgacctcaggtgatcctccttcttcagcctctcaaagtgctgggattacaggtgtgagccactgcgcctagcattttttttttttttaagactgggtctggctgtgttgcccaggctgaagagcagtggtatgatcacggctcactgcaacctctgcctcctgggctcaagcgatcctcccgcctcagcctcctgagtagcggggactacagatgcatgccactgtgcctatggaggccccacttaagtccctgcaataatagcccagtgtgactcaggtctggcctcccccagaccctcacagggatacccacgaatggcgaggtgcttcacgcagaccactgggctggaacaagccacatggtggatgctgagttccaggtgacacttggatcggggccaggcagccctcttcccccgaagcaggggatccctctgcccactgttggcataaaagtaatcggggctgtacggacagtgtgatgaccctccgccctcccttctggactgaatgacttgggctccgactgctggaatgtcctgcgaattgcccgtgactgaggagagttgcctcattcaaggtcaaggtcaagttcacatcccctttctgggttctacttggaggtggctgaggcagggggagaatctcagcctgttccctgaacccaggtctgaagtggaggttgggtgaggccgtgctccggcctgtggcacagcccagcgtctcccgggcatgtccagcttctgcacttccccacgcgagctgacaagggcacctgagtaatctctgcatgctcctctccatctcagagtgttcgtcctagggagccctgtctttggcagtagccgcccttgtattctttttttcttttcttttcttttctttcttttttttttttttctgagacatagtcttgctctgttgcccaggctagagtgcaggggtaccatctcggttcacagtaacctctgcctcccgggttcaggtgattctcctgcctcagcctgctgaggagcgtgccactacacctggctagtttttgtatttttagcagagacagggtttcaccatgttggccaggctggttttgaactcctgacctcaggtgatccacccaccccagccttccaaattgctgggattataggtgtgagccactgtgcctggccgccttgtattcttttttgcagctgccaaaacaaatgaccacaaactgggtggcttaatccacagaaatttattcttatacagttctggagggctgaggtccaaaatcaaggtgtgagcaggccacgccgcctgcagaggctctagaggagggtctgtcctgcctctcccagctccaggccttcctgggcttgtggctgcatctctccagtctgcctccgtcttcacatggccttctcctcggagtctctgtatctgtccttctcttctaaggacttgtcatagggcccactgtaatccaggatgatctcatcgcgagagcctcagcttaatcacatctgcaaagatccttactccaataggatcgcatcctggaggttccaggtggacgtatcttttaggggaggccgcaactgagccctcggccgcagtccaggcttctgtttctatggcaacactaagagcaaccggtgagctccaggaagggcggggtcttggttgcatttgtctctgggcctccaggagttcctcagaaagggtggcaacatgaatagtcccatctgccaccgccgtgaactgtcctctcttgatggtgctgagagcaacatgcagtgtgcagggaagacgcagaccccacccccacaccagcacccccagtgctgcagccaaaggagtttccagctcggccctgcccctctagggtgagcaggtgagcaggccagcttaggagagaaaggaggcctgatggcttggttggatgtcttttgaaacttttctttttttaagacagagtcttgctctcttgctcaggctggattgtagtggctcaatcacggctcactgaagcttcaaccttctaggctcaagcaatcctcccacatcagcctcctagtggctgggactagaggcatgcaccaccacatctggctaattaaaaacaaacaaacaaacaaacaaacaaacaaaaaaaccctgtagagatggggtctcactgtgatgcccaggctggtctcaaactcctgggctcaagtgatcctccagccttgacctcccaaagcactgggattacagttgtgagctaccacatctggcggtcttttgaaactttctaccgaggataaagagtaactattttccaccagggaagctgtcaaggttgaagttttaagggcttctgtgtgggccaagccagtcacaggtaccttcccaggaatgtagggccctgagatatcaactgggagacaacatgtatgagtcagtattctccagagaaacagagccaatgggatgtgtatagatacacagaaagaggttgagtatgaggaactggctcacatggttacggaggcagagaagtcccaagattttccatctgcacgctggaggtgtggttccaatccaaactcaaatgactgggaattgcggggcccatgggttaagtccttgtctgagtccaaaggcctgagaaccagaagcgccaatgtcagagagcaggaaaagaaggatgtcccagttggagccgaaagaattcacccctcctcagcctttttgtgctattcaggattgtacctgcccacctgcattggtgagggtgatcttctatattgagtctgctccaattcaaatgctaagctctgccggactcagtggctcacacctgtaatcccagccctttgggaggcggagttgggcagatcacttgaggccaggagtttgagaccagtccagccgacatggtgaaactccatttctactaaaaatacaaaaattaggtgggcatggtggcatgtgcctgtggtccagctatccaggaggctgaggcacaagaatcacttgagcctgggaggcagaggttgcagcgagatgagattgtgccactgcactccagcctgggtgacagagcaagactctgtctcaaaaaaaaaaaaaaaaaaaacatttagctggatgtgatggctcacacttgtagtcccagctacttgggaggctgaagttggaggatcacttgagctcgggaggtcgaggctgcagtgagctgtgattgcatcactgcactcaagcctcggcaacagatcaagactctgtctctcaagtcaaatcaggctgggtgcggcggctcatgcctgtaatcccagcactttgggaggtggaggtgggcagatcacctcaggtcaggagttcaagaccagcctggccaacatggtgaaaccccatctctccaaaaatacaaaacttagctggacgtggtgctgagtgcctataatcccaactacttgggaggctgaagcaggagaatcacttgaacccaggagggggaggttacagtgagccaagatcacacatgtgacagagcaagattccgtctcaaaaaacaaaagtcaaaccaaatcaaatcaaaaggcagcaactgagaaagacattcatcttcaaggaagatgcaggtggctgctgagagagaggcgggtttcggcacgtggccatgtgtgcctactcatggaagttccccagaagacctttgttcgtggaagtgatgaggctgtgattccatttgtgtggcgctttctctctttgccccatgcccccctctcccctctgtgatgtccatgggcaacggggggccttggaagaacctgggaatgaggctgagtcccagcctggagcctgcatctcattgcctgtagagcgaggccgctctcgtcacctcctgccagttgtcatgaggctcagatgaggtgatggggagagaggatgcagcacagcaaactgggctttcgacccgggaggggccacgtggctcatctacaggctttgccaccactagcaggcaactctgggcaagctgggttctcagaacctggatttcctcttgctaagaagtcgtgagcatctaaggagcgtaggcgctgcccaccgaatggtggttaccagatcatggaaagcaatgagctcagtgcctagtgcataatgggggccctgcgtgtgaatcctttcccttccttagggccactcggtggtacatgaagaagccatgagagcagggatgaggctgcctttgagtgtcctgggctgggtggccatagggtagactgcagggggcccaggtggggaccggcatccatgaactgtgtcttggtcaccaactcactgtgaatgtatggcttctactaactctgaggcacatggatgtttaatgacttgcccaagcccagccccagctgaaactgcagcgtcctgtctaccgtgggctctaaatgatgatgaaatcatgtttggtccacaagactcatgacccttagaatcccttaaactgcagcatgcatgattttgtgcatccatgcacagatgcgtggactgtctaacagttctctttttgggataattttttttttttttttgagacagagtctcgttctgtcacccaggctggagtgcagtggcgcaatctcagctcactgcaacctctacctttcaggctcacgcgattcttgggcctcagcctcctgagtagctgggactacagacatgcaccaccatgcccagataatttttgtgcttttttttttttttaagtagagatgtggttttgccatgttggtcaggctggtcttgaacatctggcctcaagtgattcacctgcctcagcctctcccaaagtgcttggattacaggcgtgagccactgtgcctggcctgcaataatatttaaaaaaaaaaaaaaaagtaagactagtcaattgcagcagtaagaattttttttttttttttttttttttttttttttttgagatggagtctcactctgtcgcccaggctggagtgcagcggcatgatctcagctcactgcaagctccgcctcccaggttcatgccattctcctgcctcagcctcctgggtagctgggactacaggtgcccgccaccatgcccagctaatgttttgtatttttagtagagacggggtttcaccatgttagccaggatgatctcgatctcctgacctcgtgatctgcctgcctcggcctcccaaagtactgggattacaggcatgagccaccgcacccagtcttttttttttttttttttttttttgagacggagttttgctcttgtctccaagactggagtacagtggcatgatcccagctcactgcaacctccgcctcctggattcaagcgattctcctgcctcatcctcccgagtagctgggattacaggcgcgtgccgccatgcccagctaatttttgtatttttagtagagacagggttttgctatgttggccagggtgatctcgaactccagacctcaggtgatccacccgccttagcctcccaaattcctgggattacaggcatgagccactgtgcccagccaagatttttatttatttatttgattttttttagagacagagtttctctcggtcatccagcctggggtacagtggcaagaccatagctcactgcagccttgaatccctgggctcaagcaatcctcctgccttagcttcctgagtagctgtgactatacatgtggaccaccacgcccgggcagttctaactttttctcatagagactgggcactaagttgcccaggatggtctcgaacttacaggctcaagcaatcctcccacctcttctttccaaagtgctgggatgacaggcgtgacccactgtgcctgaccaagataaatactgaatgcttagcgccaaatagcagatgaataaggagggctgatgtctgcagggtttaccccattgcgttgtacaacaggccttggcagccctaaaacaagcagacgggttgtttgtcaccgggatcaggagacagcagagctttgtcaagctgccttgctggggtgagctgcagtgggagttggactctcccacgacacagagacggatgcaagatccaggactcgcgcctccttggtgctctcctgctacctggtggcctcttctttcctttagtcctctgtccctcttccacttctctctgcctcctccacccgttcctgcaggcgtctggccatcaccttcgatgggtgcttctgttcatctttaccactctgaaccctccaaaatagcccccatgcaaaccaggacgtatatgacctcccacgggcaacaacaacagcggagtttacctacttcaattgcaagacgctccttggagggtagaaacagttctgggacaaacgcatttgatgtgaatgggccccactctctcctgatccacaaagcttcctgtcctgccctcttgagggccctgacctcatccttccctctcagtccagcctctctcgggagtttgacttgtatggtgcaaattgaaggcccacatagagtaagaatggatcttgatggggtcacagcacacctggactgatggcgagaagtccagccctgtagaagtagtcctagggccacaccatgacaattaatgtgcaaaacgtggccacccctctgaatggtgacaatggtgacaatagttggaccatcctccaacagcagacacccactgagtgcttaccctaccgggagggctgagtcaagctctctctacgcatgatcttgttgactcctcacaaccgctctgggaagtagatgcccctattccccttttacgaatggatcaccctaagctcaggaacatatccaaggacagcaggacaccaaggcccatccgatctcacagtgacagcattgagtcccacaccgcacagagggcggggctggcacactccccacagcgtggggaatctgcacttaattgcatagcagggagtgatcacacaagttctgtcacataccaacactgcacgcccctctggctcttccaccacgaagcacgtcctggtgatggacgcagggcagggagaggaggagagaggagacctcgggttctgccttccccagcccctctctgctgggcacatggagatccacctggcagttggcccctctgggccttgagccagtctggcacaggcaatgtaccgttcggtggcatctggacccatgtttgtgccttaagcatgacaggtggccctggctcaaacttcctgggctccttctccctgtttcctgatgggggaaaccctagttttgggcccaggctgggacctgggatggactcagatgctttggaaatgtatgttgggctggtgggtcgggcctcaccagaagcttgtgcacaggccaaggagcttccaggaaatcactcacccgtggaagggaggagccaggcccagtgagctgacctggaatagttagttacatggcctatcacataccaacaccgcacacccctctggctcttcagaccctgtggcatacgtagccagggagcaggaggaacctgggggtgcatatacgccataagtaaagatgagctgatttaccctataaaacagggcacagacactgctttggtgatgatagtagccaccagtagtccagagagagcagatgcagcctggtgaagccgtagcagccaatttgtttgagtgcacacatagacacagccttcagtgacatcttctcaggggctgtagcaaggtcagggtgagagctggccgggttatgactgccttcttcccatgagggcagcatgcaccagagaaaggacatgggctctggggagcttggttctttttttttttttttttttttttttgagacagagtcttactcccatcacccagatcacctaggcaggagtgcagtagcacaatcatggctcattgcagccttgacctcctggtatcaagtgatcttcctgtctcattttttttatttttggtagagacaaggtctaactatgttacccaggatggtttcaaacgcttggactcgagtgatcctcctgcctcagcctcccaaagtgctgagatgacaggcatgagccactacacctggccgggagctggattctaatctcattcgcaccacttccttgtgtgtgatctggggcaagttaattaaagactcttaaactgggatgtgaatgccgctgcctgctgtggtttaaaatatatccacaacaaactctttgatattcctccctttaagaggtggagcctcatcccctgccgttgaatgtgggatggaattagtggatcacttctaaatgataaggcaggggtgacactgtgtgaccttggggactggtcataaaaggcctgtgggttcctactttttccctcccttgctctcagatccctcctctggggaaaaccagctgctatgtcattaaaacagcactgtgttggccactggtgaagaccaaaccctccagccagcagccacaagaaggcgccatcttggaggtggctcctccagccccagttgagccttcagatgatagcagccccagccgacatcgtaaatgcaacctcacaagagaccccgagccagaaccacctggattaaaacgaccatgatgttcctgaattcctgactacagaaactgtgagataatgaatttttgttgttttaagctaatatgttttggggggtaacttgttacacagcaatcgataactgatagactcatctgcaggtacgtgccaggatttactgagccaacatacacaaggcgccagatgtccactggaccctcagtctgatcagctccttgccacactgaggtctcagcagccccttcctcatggcggcaaggtttggactgtggttatgcccactcagggtccggccctccagccaggttcctggctgccccctccttttccccaggcttgcctttcccctggccttgcccacgagagaccctgtcacactggggaggcctgtgctctcttctaaacaaaggatcaaagaaatcggtttgtatgctgttaaacatttaaaaaaattttttttaaagagatggggctcttactatgttgcttgggctggactcgaacttctggccttgagcaatcctcccacagcagcctcccaactacctgggacaacaggcacaccactgtgcctagatcatatcactttttgcacaaaacccttccatggtttccctttacccttacagtaaaaatcccaacccgtggccgggcgtggtggctcacgcctgtaatcccagcactttgggaggccaagacaggaggatcacgaggtcaggagatcaagaccatcctggctaacatggtgaaaccccatctctactaaaaatacaaaaaattagccaggcgttgttgcaggaagtcagggaccccaaatggagggactggctgaagccatggaagaagaaggtggattgtgaagatttcatggacatttattagttccccaaattaatacttttataatttcttatgcctgtctttactgcaatctctaaacataaattgtaaagatttcatggacacttatgacttccccaatcaatacccttgtgatttcctatgcctgtctttactttaatctcttaatcctgtcagctgaggaggatgtatgtcacttcaggaccctgtaataattgcattaactgcacaaattgtacagcatgtgtgtttgagcaatatgaaatctgggcaccttgaaaaaaaaacaggataacagcaattgttcaaggaataagagagataaccttaaactctgaccacccggtgagccgggcagaacagagcaatatttctcttctttcaaaaacaaatgggagaaatatcgctgaattctttttctcagcaagaaacatccctgagaaagagaatacacacctggaggtataggcctatgaacggtcccccaggtgcgcctgtcttttatggtcgagactgcaggggtgaaatagaccccagtctcccatagcgctctcaggcttattaggaagaggaaattcccgcctaataaattttggtcagacggttgatctcaaaaccctgtctcctgataagatgttatcaatgacaatggtgcccaaaacttcattagcaattttaatttcaccccgatcctgtagtcctgtgatctcgccctgcctccacttgccttgtgatattctattaccttgtaaagtatttgatgtctgtgacccacacctattcgcacactccctccccttttgaaaatccctaataaaaacttgctggtttttgcggcttgtggggcatcacggaacctactgaaaatatgatgtctcccccggacgcccagctttaaaatttctctcttttgtactctgtccctttacttctcaagccggccaacgcttaaggaaaatagaaaagaacctacgtgaatatcggggcatgttccccaatatctggcacccacgtggtctttcttttttcctaagtgcttgagggaacccgattccctttggtaggcgcggtgcaacgtcaattggcttggtccacagataacgcgtgttcgactccctgatgagtggtgagtagtctgtgtaaggtctgggttaactgcaggtcatgcatagtctaagctcgaacccgggaggcggagcttgcagtgaaccgagattgcaccactgcactccagcctgggcttcagagccagactccgtctcaaaaaaaaaaaatcccaacccgtgaccatggctacaagactcctataatataccccaaaccccatgatgtgaccattcatgatgttcttctctgtgccctgcaaactcaccagatcaccacactttgtttctctgatgcaaaccgttcttctacccgatcgtcacggctgccttctttcccgttgttctcatctttacttagtgtcaccttctcagagcatgccccaccccaggtcctcttgaccacaacacctcatcatttttagcaccagctaaaatatcctgtgtgcatgattattgtttgaagccagcccttgcacggaaactccttcagagcagagctctgctgtgcttgctccagggtctgggagagacacacagcagagatttgtgagctaataaatgtgtgagacacacaacagacacttgacaaatgtttgtgggctggagagctttttgatatcaatcacattcccttttaaaagctttggaggtgctccaggttccagaagagccatctggaaaacccttccatgaaggaagttaatcactttcagcccttcttccagagcaaagtgcttacaacctttcttagttgcatcatgatcattttaatccaggaaagttcttattaggggtttgcaaatgctggtgttctaaggggagctacatctttccctgatttagttccgggtaacacacatggactggaacaccatgattttttcccttgggtaggttttcatgtggggtctgtcaggccagctggccctctgtgcggaacaaggatccagtgactgcacggttgtaggccgcaaaccttttccccaggactgctgtggatttggggtcagtccaaggtatataggacaggcacagctggaaacacctatgggggacaccctggaggagcctttgacccaagggagccggtgggacttgaacaccaagtaggactctgagcaggggaaggcatgggctgagccacccagcagggatcccaccgccacggtggagctgggtcccaaaggctgccctgttaccggctggctgcagggaagtccaggggtccctggggtaggggatggaatggcagggaggcctctggggcctagccacattggagtattcacagatttcaacacctaaactagctgaaccggggctcgccagaccctgccttggcctccccactggccaaagacccggccgtcctctgcctgcttctccatgtccagccgcgctggcctccaatccactcctcgaagacactgtgctccctcggggcttcacacacactggctgttttccctaggagctgcccgacctgaaaacatccccctcttccttctgcaggcagttcctcgttccattcctctaggcggctttccctgacccctagactggtccagggaccctgctccccactcttgggtctagccttcctagcacatgcccagttgattgttttgttttgttttgttttgttttgtttgagacagggttatgctctgtggcccaggctggagtgtagtggtgagatctcagctcactgtaacctctgcctcctgggttcaagtgagtctcctgcctcagcctcccgagtagctgggattacagatgtgcaccaccgtgcccacctcatttttgtatttttagtagagatggggtttcaccatgttgcccaggctggtctcgaactcctgagctcaattgatctgcccacctctgcccgcctcggcttctgcctcccaaagtgctgaatgtgtccatttcataatcccacagtgaggacgtttcccactcaaccgactccagaattatttttctcactattctctcaccaacttctcattaaacagttgccgaatgaacattcgaatgaatggacagacccaaaattcacggcctcttgtgtatcccgtgaatccttctctggctatgcctcctggtagggagtttaccactcttgggggtctagaaaaacaggttctgtgtggatgctgggacctcaggcgtccttcccagggtagcaccgagagcccacgtgggctggctgtactggacaggagattctgccagagaacattaggggccaaaccgcaaagccccagtgtggaggtcccggctgttgcaggggaaagttgcccaagagacgcttggtgagctgatgagaccttttctcccagcgataagacctccttcggctcacctgcacctgtcttgcagcacagacgtgagagctacatctgtgaaacattgttggcgttgcctttacccaaacaatcaacctgctttgtctctccatccttttgattgttctaccaggattttttcccctatagaaagatttcatctttcctgagtggctggaaaggtggtaaaacaaacaaagtgttaaaaggcgtttaatgggccgggcgtggtggctcactcatgtaatcccagaactttgggaggccaaggcgggtggctcacctgaggtcaggagttcgcgaccagcctggccaacatggcgaaaccctgtctgtactaaaaataacaaaaattagctgggcgtggtggtgggcccctgtaatcccagcaacccgggaggctgaggctggagaatcgcttgaacccaggaggcagaagttgcagtgagccgagatcccgccattgcactccagcctgggcaacaagagcaaaaaaaaaaggcgtttaatgaaagagaatacactaaataataagtttgtgctatttcgtccttttcttagagccacggtaagaggtataggggagaggaaggagaagtggtcttttcttactcaattcttcaaatcgcctaaactgggaaggtattggccagatagtttccagaaggaactctcccgcagctgaaggcaattctcccagccttggcagctgcttggagtaacacgcacaccttcttggtgttaacctcctttgacatcgtgcaaatggccgatacttacctggttgcagtggggcccctgccacgcactgtcccgggcggagaggcatctttggcttgccgggtccgtgagctgccaatcatcatgcaggaaaccaactcgctggccagacctcctgcataaatgccctggagcagccaccagagcccagaagttggacagggcagggaggaagccgctggcagaatgaggaaaacctgttctgagatgggaggtgggaggtgggaggtgttgcgctgggaagggaaactccgtggaggggttgggtggtcctggctcatcttgacccttgcctgtctggaagggggatttttaaaaaactggatggaaattggacaagatgtacttgtttaatggggaaagatgaggtgagtgattttaagtgttagagaacaatctgggaaacctgccccttaaggaaaacctgatatgggggaaaattcccacaaagctgagaggaagcaggtgccagtctcgctgatgcagactggggagcatctttctctctgcagaatgtgctcaggggttcacccccagtctgtaattgagggtgaggcagggaagctgaaagcagcagcagcagaagtccgcccaaaggtggctgtgattccagcccggtcaagaacggcggatccactccttggcagggaactgcaagtcaaacccacagtgaggctgggctcgggggctcacgcctgtaatcccagcactttgggaggccgaggtgggtggatcacccctaaagtcagaagttcgagaccagcctggccaacatggtgaaaccccgtctctactaaaattacaaaaattagctgggggtggtggtgggcccctgtaatcccagctacccgggaggttgaggcaggagaatcgcttgaacccgggaggcggaggttgcagtgagccaagatcacaccagtgcactccagcctgggcgaaagagtgagactctgtctcaaaacaaacaaacaaacaaaaaacaaaaccacaatgagacaccaccttatgtccacgaggatgccacagtcaaaaccatggagaatgagaagtgatggcagggacgtgaagacatggcaacctttatgcacctttgatgggaatgtaaaatgacgcagccattgtgcaaaatagcatggccattccccaaaagtttaaacacagggttaccagcaactccactcctatgtatatacccgggagaaatgaaaactgccatccacacaaaaacgtgtgcaggcatgctcacaccagcattgcctttaatagcccaaagtggaaacaacccagatgtccgcaaactgatgaatagataaacaaaatgtggtctatccatacaatggaatattattcaaccataaatatgactgaagtcaggcacagtggctcatgcctgtaatcctagcactttgggaggctgaggcgggtggatcacctgaggtcaggagttcgaaaccagcctggccagcagggtgaaacccagtctctattaaaaatacaaaaattagctgggcgtggtggtgggcgcctgtaatcccagctactagggaggctgaggcaggagaatcacttgaacctggtaggcagaggtggcagtgagctgagatcatgccactgcacactagcctgggcaacagaggaagactctgtctccaaaaaaaaaaaaagcaggaagtagaagatgtatggttgtctggagttaggattggggaatggcaggattagggaagtgatagttaagagataatggtgtttctttttgggataatgaaaatgtcctaaagtggattgtggtgatggttgtacaactctatgaatatatgaaaagttattgaattgtatacttaaaagggtgaatcaggccaagcgcagtggctcatgtctgtaattctagcattttgggaggtcaagatgggaggatcacttgagcccaggaatttgagatcagcctgggcaacatggtgagaccccatctctataaaaataaaaactaaaaaaaaatagtgaatcatatggtatgtgaattatatctcagcaaaactgtttaaagaaaaagaggccgggcacggtggctcacgcttgtaatcccagcactttgggaggccgaggtgggcggatcacgacgtcaggagatcgagaccacggtgaaaccccgtctctactaaaaatacaaaaaattagccaggcgtggtggcaggtgcctgtagtcccagccactcggagaggctgaggcaggagaatggcgtgaacccgggaggcggaggttgcagtgagccgagatcgcgccactgtactccagcctgggcaatagaacgagactctgtctcaaaataaataaataaataaataaataaataaaagaaaagaaaaagaattttgggtcagggagtctgtttttagtctgtgtggtaggatctcctataatccctccagctgtctgtgaaatgattgacctggactggatagggctaacaataaaggaatttcttgttatagtaagtgcataagataagggtacaaattctactctgaggcacccatgaaaagtgagggctaggaaaaaaaatatcaccctgaacattcagactaaaaacaatcaatacataattgattgtgcaacaatctgcagtaatataagagacagcttaaaaagaaactgcaatagagaagaaattgaatcagtaattaataactttccaaaacagaaagtgccaggtccagatgggctcactggtgaattctactaaacactttaggaagaaattataccaattctctacaatctctttcagaagagagaaactgagggtatacttcctaactcattctacgaggctagcatcacgtttcctaacttattctatgaggctagcatcaccttaaccagacatcaccagaaagaaaaactacaaggcagggtacaatggctcttgcctgtaatcccagcactttgggaggctgacgcagaggactgcttgagctcagggagtttaaaaccagcctgggcaacatagtgagagctcgtctctactgaaatttaaaaaaaaaaaaaaggttgggtatggtggctcatgcctgtaatcccagcactttgggaggccgaggcaggcagatcacctgaggtcaggagttcaaaaccagcctggccaacatggtgaaaccccatctgtacaaaaaatacaaaaattagctggtcgtggtggctcaggcctgtaatcccagctactcaggaggctgaggcacaagaatcccttgaacccaggaggtggaggttgcagtgagccgagattgcaccactgcacgccagcctaggtgacagagtgagactcagtctaaaaaaaaaaaagaaaagaaaaattagccaagagtggtggggcacacccatagtcccagctattcggggggttgaggcaggaggattatttgagcctgggaggttgaggctgcagtgagccctgattgtgccactgcactccagcctaggcaacagagtgagaccctgtcttaatttaagaaagaaagaaaaagaaaagaaaactacagaccaatatatcttatgaacatagatgcagaaattcccaacaaaatattagcaaacagaatccaacaatgtataaatagaagtatacaccactaccaagtgggatttgtcctaggtatgcaagcctgattcaacatttggaaatcaattaatgtaatccatcacatcgacaggctaaggaagaaaaatcacacgaccatatcaacagatgttgttacacccttcacacaaattaacgcaaaatggatcccagaccatttgagttaatgcagtactataaaactcctagaagataacataggagaaaatccagatgaccttgggcatggcagtgacttttagaaaacaacaaaaaagatacaatccatgaaagaaataactgataagctggatttcattaaaatcaagaatgtctgctctgtgaaagacactttcaagagaatgaaaagacaagctacagacttggagaaaatatttgaaaaagacttatctgataaaggactgttatctaagatatacaaagaattcttaaaactcaacaataagaaaatgaacagatggattgaaaaaatgggcagaagatctaaacagacgcctcaccagagaagagatacagatggcaaataagcatatgaaaagatgctccgtatcatatgtcattagggaaatacaaattaaaacaacaatgagctgggtgcggtggctcacgcctgtaatcccagcactttgggaggccgaggtgggaggatcacgaggtcaggagatcgagaccatcctggctaaggtggtgaaaaccccgtctctactaaaaatacaaaaaattagccaggcatggtggcacgtgcctgtagtcccagctactctggaggctgaggcaagagaactgcttgaacctgggaggcggaggttgcagtgagcggagatcgtgccactgcactccagcctgggcaacagaacgagactacatctcaaaacggtgtcgcagtttcttacaaagctaaacatacccttaccataagatccagcaatcacactccttcttatttacccagatgagttgaaaatttcagtcaacacaaggatctgcacatagatgtttatagcagcgttattcataattgttaaaacttggacacacccaagatgttcttcagtaggtgaagggataattaaaccttggcatatccagacaacggaatattattcagtactaaaaagaaattcaatggactattattcagtgctaaaaagttatcaagtcatgaaaagacatggaggaactttttttttaatacaaattttaactgtattaaaatagagatggagtcttaccatgttgcccaggctggtctcgaactcctgggttcaggcaatcctccagcctcagcctcctaaagtgctaagattatagatgcaagccaccacacccagccattttatttatttatttatttatttatttatttatttatttatttatggagatggagtctcactctgttgctcaggctggagtgcagtggcacgatctctgctcactacaacctctgcttccccagttcaagtgattctcctgcctcagccttctgagtagctgggattacaggtatgtgccaccatgtctggctaatttttgtattttagtagagatggggtttcaccgtgtaggtcgggctggtctcgaactcctgacctcaggtgatctgcccgccttggcctcccaaagggcagggattacaggcgtgagccacagcgcccagccattgacgaaccataaacgcatgttactaagtgaaagacaccaatctgaaaaggccacatagtatatgattccaactatacaacattctggaaaaggcaaagctatgcagatatggagacagtaaaaggatcactagtttctaggcgttaaaggagagagagggatgaataggtgatgcacagaggatttttagggcagtgaaactactctgtatgatacggtagtgatggattcatatcattatatatttgtccaaacccataggatgtacaacaccaagagtgaaccctaatgttaactgtggacttcatgaaggtgtgtcaatgtagactgattctatctacctacctacctacctacctacaaggtctcgctctgttgcccagggtggtcttgaattcctgggttcaagcaatcctcttgccttggccttccaaagtgctgtccagtgtaggtttattgactgtaacaaatatgccactcagggcaggatattgattgtcagggaggttgtatgtatgcggggaaatgggtatgtgagaattctctctactttctgctcaattttgctgtgaacctaaaacaacaacaaaaaggaagggaaggaaagggagagggaagggagagggaagggagagggaggggcaggccgggcatggtggctcatgcttgcaatcccagcacttttgggaggccaaggcaggtggatcacttgaggtcaggagttcgagaccagcctggccaacatagtgaaaccctgtctctactaaaaatacaaacaaattagctgggcatggtggtgggcacctgtaatcccagctacttggcaggctgaggcaggcgaattggttgaacctgagaggtggaggttgcagtaagccgaggtcgcaccactgcactccagcctgggccacagagtaagactccgtctcaaaaaaaaaaaaaaaattagccaggcatggtggcgcgtgcctgtaatcctagtgctcaggaggctggggcaggagaatcacctgaacccaggaggtggtgtgagcccagattgtgccaccgcactccagcctgggggacagagcaagactctgtctcaaaaaaaaaaaaaaaaagaaaaaagaaaaaagaaaaaaaagtgcaacttttgctcacttttcaacagcaacaatggaagctagaagtagtagaataatctcttcaatctgttggaaagaaaactaaacaacacaacaacagcaaacttgccaaactagaattttactcagtggaaaagttcttcagtaaagagaagtctagggtgttcttcaggcagaaggaaaaattgtcccagagaggaggttggggatagaggaaggaatgaaaagggataaaaatgtctcactctgttgcccacagtggcacgatcttggctcacttcaaattctgcctcctgggttcaaatgatcctcccacctcagcctcccaagtagctgggattacaagcatgtgccaccatgcccgactaatttttatatttttagtagagacagggcttcaccatgttggccgggctggtcttgaactcctgacctcaagtgatctgcccgtctcggcctcctaaagtgctagaattataggtgtgagccaccacgcccagccgcttattgtaatttttagaataattgctaaaaatggtaaaaaaccagaatagctctcaaactaacacaggaacaaaatgaaaatgtaaaaatgcaaccaaactaaacaaagccaaaaatgagataaaagaacagagaaggccaggagcagtggctcatgcctgtaatcccagcaatttgggcggctgaggcaagtggatcacttgagatcaggagttcgagaccagcctggccaacatggtgaaaccacatctctactaaacatacaaaaattagccaggcgtggtgacgggtgtctgtgatcccagctactcaggaagctgaggcaggagaactgcttgaacccagaggcagacgttgcagtgagctgagattgcaccattgcgctccagtctgagcaacagagtgagacgctgtctcaaaaaaaaaaaaaaaaagaaaaaaaaaaataggacagagaataggtgatgaatagaaagcccattcatggcaaactgcatatcagtaattacatgaatggtaagtgggttaaatgctccagctaaaagacaaagattgtcatactggatagacaccaaatccaacaaatattaaatacaagaaacacgtgtaatacttagagataaagcaagactgaaaggaaaataataaagaagtatacactattgaaatactattaggacagccagtgtagtaaattccaatgtcaagcaaatgtactttaaaatgaaaaaaaaaaaaaaaagcgtctctagaattaaggagggtcaccctataataataaaagattattttaaatttgtatgtacctaattacatgatacatagagcaatgtgaacagaattatatggagaaacagacaagtccatattcatagtgggatgtttgacacagctttttcagtaatcaatggaacaggcagacaataaatcaataacactgtagaagatttgagacatcataatgaacaatcttgttgtatgaacatatggagaactgtgcacccaacaagtgaaaaatatgttattttcaaaaagatatcatccattttaaaatacgatgatctgctgggccaaaacgcaagtttcaacacatttcaaaggattaaaatacagcagataatgttatcctaacatattgcaaatagtttaagaatcgataataaaaatattaaaaagtccctgtacctttgaaaactatactttcgagtaacgtgcttctaaaatatacttctaaataatgcatgggtttcagaacaaataaaaacggaaatttgaaattactttgaactatactatatgtaatgaaaaacaaaatacaacaaaacttatggagtaaagctaatgcagtgtttggggggaaatttatagccttaattgcatattttagggaagaagaaagacttaaaatataatgagctaagcacattcattttaagatgtcaggaaaagaacaactaaagaaacccaacaaaaatagacaggaggaaatgatttaaatatataataaagtagacaggaggaaatgatttcaatgtataataagtataaaaacaaacacacaacggagagaatcaacaaagccaaaactgaaaccactaataaaattggttaatccctaaagagaatgattaaaaggaaacaatttgacagttttcacaaaaggcatctgtgaaaagaaaaagaaaatagaaaaggaaaaggctgggcgtggtggctcacgcctgtaatcccagcactttgggaggctgaggcgggcggatcacctgaaatcaggagtttggcaccagcctggctaacatggtgaaaccccatttctactaaaaatacaaaaaattagctgggcgtggtgatgggtgcctataatcccagccactcaggaggctgaggcaggagaatcgcttgaacccgggaggcagaggtttcagtgagctgagatcgcgccattgcactccagcttgggcgacaagagtgaaactctatctcataaaaaagaaaaggaaaaaaaaaaaagaaaagaaggcacaaataacaaatacaagaaataaaaaagggacttcaccacaaaataagagtatattatcgaaaactttaagccaacaaacttgaaaatttggtgaaatgaacagattcacagaaaaatacaacctaactgacacaataagaaatagaaaaccttagtccttgggcaggtgcagtggctcacacctgtaatcccagcactttgggaggccgaggcgggcggatcgcctgaggtcaggagttcaagactagcctggccaacatgatgaaaccccatctctactgaaaataacaaaaattagctgggcgtggtggcgggcccctgtaatcccagcaacttgggaggctgaggcaggagaatcgcttgaactcaggaggcgcaggttgcaggagcagagatcacaccattgcactccagcctgggggacaagagcgagacaaaaaagaaaatcttagtcctgtaactatcagagaaattaaactgtaatttaaaaaaatcctatgataaaactcagagcctaaattccttcattagggaatactactaaacactgaagaaagaaataaagctaagttataacatactttttccagaaaggagaaaaagaatcatggactaattttgggagactagcataacctttatactaacagccaacgagaacagttaaaaaaaaaaaaaaagaaagaaaaatacagattaatttcactcattaactgcaaaaatcctagacaaaatattagcaagtcaaatcaagcaatatataaaaggattatacataatgaccatattggatttattccaggaatgcagctttggtgtaacattaggaaatcaatggacagaattcaccatgttaatagattgaaggaggaaattcagccggtgtggtggctcatgcctgtactttgagaagccaaagtgaagccaagtgttttgagaggccacactgtgaggacagcttgaggccaggagtttggaaagagcctgggcaacatagtgagaccctgtttctacaaaaaattagctgggtatcatgatgcatgcctatagtcccagctactcaggagggtgaggcgggaggatcgtttgagcccaggagttcaagtttacaataagctatgattgtaccactgcactccagcctgggtaacaaaagaagaccctgtctcttaaaaaaaaaaaaaaaaaaagggtataaagggttaggaagttgggaaaaaaattaccaaaagagtctttttttttttctttaagacagagttttgcttttgttgcccaggctggagtacaagggcaagatctcagctcactgcaacctctacttcccaggttcaagcaattctcctgcctcagcctcccaagtagctgggattacaggcgtctgccaccacgcccagctaatttttttttttttttttttttttgagacggagttttgctctgtcacccaggctggagtacagtggcacgatcttggctcactgcaagctccacctcccaggttcgcgccattctcctgcctcagtctcccgagtagctgggactacaggtgcccaccaccacacccagctaatttttttgtatttttagtagagacggggtttcactgtgttagccaggtctcaatctcctgaccttgtgatccacctgcctcagcctcccaaagtgctgggattacaggtgtgagccactgtgcccggctaatttttatatttttagtacagacagggtttcaccgtgttgatcaggctggatggtcttgaactcctgacctcaggcgatccacctgccttggcctcccaaagtcctgggattataggcgtgagccactgcacctggcccagagtcattattcttatatactgattctatatgaagaaaatccaaaagaatctactgataaacattacagttaaaatattttagcaaggttaatggatatagagtcaatatacaaaaatcaagagcattccaatactaaacagaaaaatacatttaaaacagatttgatctacaatacctttaaaatatgtcattgcctaggactaaaactagcaaaagatgtgcaaagacctctaaataggaaataaaaaattaagttattacaagaaatttaaaaagacctcaaaaaatggagagatataataaaacatccattgataagaagactcaataatgaaagtacatcaattttcggactgatctatagatccagtgcaaccccagtgagcatcccaatagttcttttaaaaaaatacaactgggcaaactgactcccaaaaacataaacaatcaaaaagtccaggctgggtgcggtggctcacatctgtaatcccagcactttgggggcctgaggcaggaggattgcttgagcccaggagtttgagaccagcctgggtaatataggaagacctcgtctctacaaaaaatttaaaaattggctgggcttggtggcacacacctgtggtaccagttactcaggaggctgaggtgggatgatggcatgagcctgggaggtttgagtctacagtgagccgtgaccacgccactgcactccagcctgggtgacagagtgatacactgcctcaaaaaaaaaaaaaaaaaagaaaaaaaaaaaaaggaccagatcagttatctgttttgccattttctaactctgtgaccttggataagatacttaacaactctgagcttgactggcacgatccccaggcataaagggggatatagttttatctcacagagttttggaatgagtacggtggagaaacagtaataacatgggactaggccagccatggtggctcacacctataatcccagcaccttgggaggccaaggcaggcaggttgctagagtccaggagttcgagaccagcctgggcaacacagtgagacacccatctctacaacaaaattaaaaaatcatctgggcatgctggcgtgcacctcagctacttgggaggctgaggtgggaggactgcttgagcccaggaggtccaggctacagtgagcagtgattatgccactgcgctccagcctgggtgacagagccagatcctgtctcagaaaacagaaacaaaacaccaaaaatacatgagattaactagattgtgatatgtttgtaccatggaatacataaagcggttaaaatgataggataactacctcaaaaataaaaagttctcactctgtcgcccaggctggagtgcagtagcaccatctcagctcactgcagcctctgcctcctgggttcaagtgattctcctgcctcagcctcccagcctgggattacaggcacccgtcaccaggcctggctaatttttgtactttttcagtagagatgggattttaccatgttggccaggctggtcttgaactcccgacctcaggcaatctgcccacctcggccgcccaaagtgctgagattacaggtgtaaggcaccatgccaggcctcaaaaataaagtttttaaaaatgatagtgtggatctgtatatccgcatataaggaaggaactccatgacacataagggaatgaacaaagcgaatcccaattcagtatcagtgtgcctcaatcctcatgcatcagaatccctgtgtgattcgcgtctcattgttctccagtgagacccaggcactggcatttaaaaacaaactaaaaacaaacaaagaaagcaaacaacagttattgtcatatgcagccctgcgctgagaacccgtggtaataaaaacagctacagctattattttggacttacaatgtagccgacatggttctgaacactttgtttacagcaactcactgaatccttacaacaactccaggaggaaggttcgattctcaccacccccccattcacagataagaaaaatgaggctcagagagtttacgcagcttgtttataatcacgcagctagtggatggtgggggtggcacttacgggatccaggcagagcggctctaaaaatctagcagaattccatgcagtggtagggagggaagaggagagtagaatttagggattttcaatgtgagtcggcaggggaggggcccaggaatctaatgatccccagatctggaaacctggggcattgactcccaactccctgataataactgcctggggcattctttaactgtaggattccagggcatcttggagattctgcttcctggatctgaggcagggcctgggaaccgtcatgcttagcaagggtcccacgggggcccagcttcacagacctgggcagccacagacagctcaccctgaaggggccatgcttgcttcaaacctctgctgtcgacagcctgaaattctttttttttttttttttttttttttttgagacagattctcattctgttgcccaggctgaagtgcagtggtgcgatcttgactcactgcaacttgtgcctcccaggttcaagcgactctcgtgcctcagcctcccgagtaactgggactataggcatgcaccaccatcgcgggctaatttttgtatttttagtagagatggggtttcaccgtgttcgccaggctggcctcacactcctgacctcaagtgatccgccccacttggcctcccaaagtgctggattacaggtgtgagccaccatgctgggctgaaattcttaataatgtaatcttcgaatgtgtgttttgtaagtgatgggacagtgtgatgtgcaccaggggcttggggcctaagtacctgtgatctcagcccctaccctctctctgcctccctgggaaggctctccctggcagtccccccacacctggatgccccaggcttggttcccctacctgcccctgccttgtgcactgccatgttctgccctttatcctttgtccccagagggcctgggcacaagtgtgggaaggactggactcaggtgtgctgcctgcaaccttgtggggttgtggccattcctgccccaggctggcagcgcccagcacatatgtcttggtggggttggtgagccccgcgcatcttggcacagatgtttaaaaatccctgggggtccctgtctgcaatgcaatggggcagtgagcatataggagaagagatgcctggctcgacctccgcagagggtccccacacaccctgcctgagctccatgcctgggggaccccctcttcctccttccaccctctctgagttaggcctgcatgggtctcttccagtgtacccaaggacaaaagcacaacacaaatggtgtaatttctgtgattctgcacgcaagttaaatgctctcatatttgcacttaaaactggcattgcacgatatatggatgaacagtaaagttcatgctgataatttacaattttatttttctttacgtagaacgacattaaataagaataaaaaaatacaccatgatgagtcaagggagagagaccacagaaaaaaggaaaaaagtttacacgttaatatctttcacagcacttcgttctaacttaaaaaaatttttttttcagatggcatctccttctgtcgctcaggctagagtgaggtggcatgatcatagctcactgcagcctcaactgcccaggctcaagggatcctcccacctcagccttccaagtagctgggactacaggcatgcaccactatgcctggctaatttaaaaattttttgtagagacgggggtctccctgtgttgcccaggctggtctcgaactcctgggctcaagcaatcctcctgcctcatcctcccgaagtgctaggattataggtgtgagccactacacctagcctgttccaactttttgaacaaggagtccttcatttttgttttgccctgggccccaaaaattatgcaactggctccaatctcagggattcttattgtcagggaagttcaagaagctgttcaggaatacggccgggcacggtggctcacgcctgtaatcccagcacttttgttggccgaggtggacagaccccttgaagagctcaggagttcgagaccagcctggccaacatggtgaggcagaaaatacaaaaaattagctgggtgtagtggtgtacatccgtagtcttagtcccagctgcttgagcggctgaagcgggaggatggcttgagcccaggaggcagaggtggcagtgagctgagttcgcttcattgagctccaacctgggtgacaaagccagactctgtttcaaaaaaaaaaaaaaaagaaactagaggaatatggattggagaagactctaaatttgtgtctgtgtgttatgctgagcattttagttaaggacactactgtagcatctcagcttccttgggctccccagctacaagggcatatccaggaagacaccacaggctccaaccgccttccttatggtcaataggcagcaagccaggctctggagatggagctggggtggaggcgtctcaggctagtgggcaagtactctcgaagggccagccaggggtgctcagtatttggcttgggtggacactggcctggggagaagggtagctgcaggccctggataaaaggcactgggcaatttttagccagctgtattatttacatatgtataaatggatagacatagatgtaattttgcctgaaaaaatacagtgtaccctatttaattaattaattaatttttttttgaggtggactatcattctgtcatccaggctggagtgcagtggtacgatcttggctcacagcaacctctacctcccaggttcaagcgattctcctgcctcagcctcccaagtagctgggatcacaagcacatgccaccatgaccggttaatttttgtatttttagtagagatgggggtttcaccatgttggccaggctggtctcgaactcctgacctcaggtgatcctcccgcctcggcctcccaaagtgctgggattacaggcgtgggccactgcacccggcctaaatttgaatttcaaatgtcaaattttttttttttagtgtaagtatatcccaactcatgcactatttgggatatacttatactacaaaaattattcattgttgatctcaccctcatagttacatatacaccctgtatttttatttgctaaatctggcaacatccactggacaggaaattcaaagatccagattctagtcctggctttgcgctaacgaggagttggagcaaagagggtactgcttctcaggcctctggttaaaagaagcccctctccacctccctcactgcctccaccatccagggtgagagaggtaccgtcagacacgccagagctagaccccaagcggatgctttctagggcaaggtgagattttgcaggaaaggagtgcataggcgtgcacaggggacgcgcgctaagcgtaaggcggcgttctcaatgcttagcagtgcattgggatcgcctggtgaacgggaacgatactgacggccagcgcccccactcccaattcgactggtctaaagtggggcccagatacttgtcttttttttttttttaaagttccacagtgactccgctgtgacctgcacagttaagaaactgcaggagtccgggcggtttccaaggatgggtcaggggctgaaggcggtctgtgcaattggccccgggcttgccgagctggaagagcccctgagtggcactggagccacttccgcctgcatgaagaaaggggtgccgggaggactgaggagggactaggaccccatccctgttcctgagccagcgcccgtcccacctctggcacggtgcctccagaaacccaacagggggagcgcctggaccccaggcaggacgccgcgtgggggacgctggctgtggacccctgtcccgagggcggccagaggctggctctgaatcccaggatgcccaggccacgctcgctcagtcccggagcttgggacttctgaagacgcggggcctcgtttggggtcgcaagtctgagcgctccggctctggttggcgctaggtggcgcccgagagcgcgccaggctcaccctggggagacctggggccagccggggtctccctgctctggcgcaggcagatcatcgacccctgcgtggcgcagttacaggatccttgggcggtgccatgcaatgccttctcaaggcccagcacttcgcccgatccctgggagggatggacagtcgtgcgccccatagaggtttgggtcaacagcctgcatataggaccgtggtcccataagattttcacggagctgaaaaattcttaacattcttatggcctagagacttcataggggaacgcattcctcacgagtttgtggtgatgctggtgtaaaccaacctacagtgctgtcagtcatataaaagtctagcacatgtaattatgcaccgtacataatactcggtaatgataataaacaactgtgttactggcttaggtatttactacactatacttttttcatttcattttgttttgtttttatagagacagggtctcactctgttgcctaggctggagtacagtggtgtgaccatagctcgctgcaggcttggcctccggagctcaaacaatccttctgcctcagcctcctgagtagctgagactacaggtgtgcgccagcactcctggctattttttaaaaatttttagtagagacaaggtttgacgaagttgcccaggctggccttgaactcttgagctcaagcgatcctctgaccttggcctcccagagtgctgggattacaggcctgagccatggtgcctggtccttattgttccttagagtgcactcatatttttttacagttacccgtaaaacagcctcgggcaggcctttcaggaggtattctagaagaaagcattattatcacaggagatgacagtctgcatacacattgcctctgaagaccttccagtgggacgagatgtggaggtggaagacagtgacattcatgatcgtgaccctgggtaggcctaggctaatgtgtatgtgtgtcttagtttttaataaaaaagtttaaaaagtttaaaaaaaattaatagaaaaggctgtccaggcacagtggctcctgcctgtaatcccagcactttgggaggccaaggcgggcagatcacctgaggtcaggagtttgagaccagcctggccaacatggtgaaaccccatctccactaaaaaatacaaaaattagccgggcatcgtggtgggcgcctgtaatcccagctacttgggaggctgaggcagggagaattaattgcttgaactcaggagacggaggttgcggtgagccgagatcgcgccacagcactccagcctgggcaacagaatgagactccgtctagaagaagaagaaaaaagttaatagggccaggtgcagtggctcacacctgtaatcccagcactttgggaggcagaagtgggtggactgcttgagctcaggagtttgagaccagcctgggtaaggtggcgaaaccctgtctctacaaaaaatacaaaaattagccgggagtggtgatgtgcatctgtagtcccagctatttgagaggctgaggttggaagatcgcttgagcctgggagatgaagcctgcagtgagccaagactgtgccactgcactccagcctggatgacagagtgagaccctatctcaaaaaaaaaaaaaaaaaaagctaatagaataaagacataacgaaaataaatatctttgtacaatgtgtttgatgtgtttgtgttttaagctgtgttttacttttttacaaaaaagtaaaaaagttaaaaaaattaaaaagtttataaagtaaaaaagttctagtaagctaaggttaatttattactgaagagaaagaaccaaattttattttattttattttattttatttttttgagatggagtcttgctctgttgcccaggttggagtgcagtggcgagatctcggctcactgcaagctctgcctcccaggttcacaccattctcctgcctcagcctcccgagtagctgagactacaggcgcccgccaccacaactggctaattttttgtatttttagtagagacggggtttcaccgtgttagccaggatggtctcgatctcctgacctcgtgatccacctgccttggcctcccaaagtgctgggattacaggcgtgagccactgtgcccagccaaaagatcaaatttgaaataaacttagtgtggtctaagtatacagtgtctatagcgtctacagtggtggacagtcatgtctgaggccttcacattcactcaccacccacccactaaccaagagcaacttccagtcctgcaagctccatttatggtaagtgccctatacgggtgtgccatttttaatctttatttttttaagatggagtctcactctgttgcccaggctggggtgcagtggcgcaatctcggctcaccacaaactctgcctcccaggttcaagcggttctcctgcctcagcctcctgagtagctgggattacaggtgcccaccaccatgcccagctaatttttgtatttttagtagagacagagtttcactatgttggccaggctggtctcgaactcctgacctcaggtgatccacctgccttggcctcccaagtttctggtattacaggcgtgagccactgtgcggcccatttttaatcttttatactgtatttgtgctgtgcattttttatgtttagaagtgtttggtcatcagagaaatgcaaatgaaaaccacaatgagataccatctcacaccagttagaatggcgatcattaaaaagtcaggaaacaacagatgctggagaggatgtggagaaataggaatgcttttacactgttggtgggagtgtaaactagttcaaccattgtagaagacagtgtggcgattcctcaaggatctagaactagaaataccacttgacccagccatcccattactgggtatatacccaaaggattataaatcatgctactataaagacacatgcacacgtatgtttattgcggcactattcacaatagcaaaaactcggaaccaacccaaatatccattaatgatagactggattaagaaaatgtggcacatacacaccatggaatactatacagccataaaaaaggaggacgtcatgtcctttgcagggacatggatgaagctggaaaccatcattctgagcaaactaacacaaggacagaaaaccaaacactgcatgttctcactcataggtgggaattgaacaatgagaacacttggacacagggcagataacatcacacactggggtctgtcatggggtggggggaggggggagggatagcattaggagaaatacctaatgtaaatgacgagttaatgggtacagcaaaccaacatggcacatgtatacttacgtaacaaacctgcacattgtgcacatgtaccctagaacttaaggtataataataatgataaagaagtgtttagatacacaatcacttaccattttgttacagttgcctacagtattcagtggggtaacaagctgtacaggttggtagcgtaggagcaataggttacaccatgtggcctaggtgtgtggtaggctgtgccatctaggtctgtgtaagtgcaccctgtgatgttcacacaatgacggaattgccttatgtcgactttctcaggtgtcaataagcaacacacaggctgggcacggtggttcacgcctgtaatcccagcacttcgggagtgcgagttgggcggatcacttgaggtcaggagttcaagaccagcctggccaacatagtgaaaccccgtccctgctaaaaatacaaaattagccaggcgtggtggcacacacctgtaatcccagctacttgggaggctgaggcaggagaatcacttgaacccaggaggcggaggttgcagtgagatgagattgtaccactgcactccagcttgggtaacagagcgagactccacctcaaaataaaaaaaaaaaaaataaagcaacccacatctgtaattgatctgtattacctcccttccattctgtctgctcttgaaagggtccaaatggcacatctatcttgtcaggtcatgcacatctgcgttaggcaaatctggaagattcttcaaagttttcctgtttctccctgtcagttggcaacaaaaatcacatattttaaaaaacaggaaatttatcagaacagactcaaataagtgtattttctatgttaatgttgatgcagggcaggtgagcccccaaattggggcttagcctgggagggttcttggcttcacccaggaaagaattcaagggcgagccggtggtgttagacagcaacttatattggagcggcagtgtccagcagcagcagagggactgctccctgccacacagggctactccataggcagtgtgcccagagtagcagctcagaggcagtgctgccatcatatttatacccacttttaattacatgcaaattaaggggcagattatccagactctaggaaaagggaggtaacttctgggtgctgggtcattgccatggaaaggggtggtaactcccagatgttgccatggccgcggtaaaccgacccggtgcactggtgggcgtgttttgtgaaaatctgcttccacccagtccctgttttagctggtcgtcaatttggtctgcatcaggaatcaagtcccacttcctatctcaatgtgatgggagaggagacccccaatgaggactttgagacattacaaaatgttggctaggcgcggtggctcacacctgtaatcccagcactttgggaggctgaggcaggtggatcacttgaggtcgggagtttgagaccagcctgggcaacatggtgaaaccccgtctttactaaaaatacaaaattagacaggcgtgggggcataggcctcaagtcccagctactcgggaggctgaggcaggagaatcacttgaacctgggaggtggaggttgcagtgagctgagattgtaccactgcactccagcctgggcaacagagcgaaactccatctcaggaaaaaaaaaaaattaatcaagaagaatccaggctgggggcggtggctcatgcctgtaatcccaacactttgggaggctgaagcggacagatcacctgaggtcgggagtttgagaccagcctggccaacatggtgaaatcccgtctctactaaaaaataaaaaattagttgggcatgttggtgcacacctatactcccagctactcgggaggctgaggtaggagaaccacttgaacctgggaggcggaggttgcagtgagctgagatcataccattgcacccacagcctgggagacaagagtgaaactccatctgaaaaaaaaaagaagaagaagaagaagaagaagaagaagaagaagaagaagaagaagaagaagaagaagaagaagaagaagaagaagaagaagaagaagaatccaattttcttcaacattatcttcatttagagttctttaattattttttaaaaaatagaacaagggatccattcctcatgcttctactgatggcagctctccctaaagcaggacattccaaaaacaaacaaaaaagcaacagccaaacatacatggaagtaagatggtctctcaaagctctgagaattggaaaggtttcctttcaagaaacttgagttagcttttggaaaacgatcttttgtatgttactagatatttcttttttttcctctccccattttacttaaataacttattcaattaacatctatttgccaggcttcaaagtcagatcctggaagaaatacaaaaaagcagcaaataatgggaaaccatcccggcctgtaggaaactcactaactcggtagaaaggcaggcttgtaaatgacaccaatacagcgtgcttgggatttcatgggatcacatgtattttggtgtttggaagcacagaggagcaagtattaattttttaaacttagtataatgaaaaatttcaaatataaaccaaaataatagtataatgaatcctgttacccatcacccaacttacaaaataattatcctattgccaactgtttcatctcggccttactaccttgcaggttacttttttatttttacaatgttttttagatatagttacatatagtaaaattcacccactctcaatgtataaccaatgccttttagtaaatttgtagagtcatgtaaccaacatgatccaatttttagaacatctccaccatcctaaaaattttactctcaacttgtgacagttctcctcccttgccccagcaaccgttgatctttctgtctctatagatttgccttttctggacatttcatatttctttttttttttttttgagacggagtctcactctgtcgcccaggctggagtacagtggcaccatgtcggctcactgcaacctccccctcctgggttcaagcgattctcctgcttcagcctcccgagtagctgagactacaggcacctgccaccacgcccgactaatttttgtatttttagtagagatggggtttcaccatgttgtccaggctggtctcgaactcctgacctcaggtgatccacccaattcagcctcccaaaagtgctgggattataggtgtgggccactgtgcctggcctctttttttcttttttttttttttggagtgcagcgtcacaaacatggctcactgaagcctcaacttcctgggctcaagtgatcctcctacctcagactgctgagtagctggggctacaggcacacgatgccctgcctggctaattttttagtttttgtagagatggggtctcactgtgttgcccaggctggtctcaaacttctgggctcaagggatcttcccatctcagcctcctaaagtgctgggattacaggcatgagctactgtgcccagactcaccttaatttttaaaaatgttcatggtggaggaaggggcaggaacatccaccagcaccagccagggttctctgaaaaaggcgctgaatattttgctcagctctgtgcttctgtgctcgagccaaccacacgtatacttgaacacgaaggaatgtgcttgagcattaaggaatgtaagccacaggctcatgcctggctgccttccaaggagtcataatagtcacggatatctgcttccagaggcagatgcggcttgagccctccccgagaagtggggtgtgggaagaggaccctgtttctgatgcaagttctggaactgaggtggattctctatcaaggcacagagaggaaagaaaccttagtctaattcccaggttggccgtcactccctctgtgccttacatatgcctgagcctttatatgccttcctggaaaatgggattccttgcattttactgaattttagaacattttattagaattaatatactggttgctgaggggttgttggaaccccaggaatccatcacagtgagatttattccttccggttctagcacattttgatttaatgagtattgcctggtgcttgagatcaggtctggtgctggagtcgtaggggccacttgtgtctctggatggaggaggcgccaggaccaggagctgcggtaggaggagcacggcccaggcccttggggacacccctgcagcaggggaggcagtgcagacgcagggaggccgagctgcagtctccgctcggggtgcagcgcctacaggaatctttggaggctcggcacaggtcgaggtcaccccagccagagtccccaaagccctaagtccgtgtaaagaaacccaggagggcttccaagccagcacggacggccgaagatcctccagggcttgcggccactgcggttccatctgcctgtgcggctcccacctctaactgtggccaccgtcttcccagtgccccatagtttgctcatggggagattcctggtgatcataggtcctctgcagctatctgaagggtgagttgatgaatgaacagacaggtgaatggaggatgaccacgacagtttctggagggccacaggttgggctgggctgggcgccttgagaacacgtgggttcttgtttctcccggaggtctggcattccctggtagcatccagaaggccgaatgcacctgagtgtgctctgccttccctcttagtctaagccttattatttgtttaattattaattattattattattatatgttttttaaagacaggctctcactctgtcacccaggctggagtgtagtggcgccctcatggctcacttcagcctccaactcccaggctcaagtgatcctctcacctcagcctcgaactcccaggctcaagtgatcctctcacctcagcctcctgagcagctgggactacaggtgagcaacaccatgcctggctaatttttttttttttttttttaatatacagatggaatctcactgttgctcaagctggtcctgaactcctgggcttaagcgattctccggcattagcttcccaaaatgttggaattacatgtgtgagcctccacgctgggccccatagcctaagtttttttaaatgtaattttttttgttgttgtttattgagacagtctcgctctgctgcccaggctggagtgcagtggtgtgatctgggctcactgcaacctctggctcctcccaggctcaagcgattctcctgcctcagcctcctgagtagctgggattacaggcactcgccaccacgcccagctaatttttgtatttttagtagagacggggtttcaccatgttggccaggctggtctcaaactcctgacttcaagtgatccacctgcctcagacttccaaaatgctgggattacaggcatgagccacctcgcccatcctcaatatatatttttcactgagatctaaatcacataccatagaattttaatgtgtacagttcagtggtttttagtcttttcacaataaattgagtttttgagtagacaatgcattcatatggcttaaaattcaacgattaccaaggaatatacacggaaacatcttccttccccgcatcccgcatacatagatcatattatctatttcttgactatactcatagatattttatgcaaatacaagcaaatgtattccgtccctttttaatctacatggtggagaactatatgtactgttcagcatcttgcttttttacttaacttggaggtcctgctggtaccgagctttctcattccttctggtggctgcctggtattctagtctatggatggataaatatttattgatggatatttaggttgttgctacacctcagcttttgcaaacaaatgctgcaaagaagaacctggtgcatgagacattttgcatgttcgggcagatctgtagaagtaattcccagaagggcgcatgttttttacattttgacagttcttgctaaatggccctttatagaggttacaccagttttaattcccatcagaatttatttccaaacctatcatgagatacgccagcactgacaagaatcctcactgcggcattgttcatcgcgccccaaactggaaacagctcaatcgatcctcagcggaacggagaaatcatggcctcttcacgcgatgaaatattatgctgcaatgaaaagaaacaaaattctgctgcacacggcagggaggaatctcctaggcggattgatgagtgaaagaagccagacacagaacggtccttactgcatgatttctgtgatatgactcaaccccgaagtcaaaaggaagacgcaatctaggatgacagtgatggaaacagaggtgacccttgggcggcaaagggagtctgctgagcgtctagaaacgtcgtatatcttgttcggagtgatagctgtatgggtgcatcagtgtgtgaaaactcaccgagctacgtgcactttactgatggaagttgcaccccaacaaaaacttaaagggtttaaaaatattgcccacactgacgcgcaaacaacacgaccgccccagcaggcagactcctccgatgcaaaagcttaggtgacaggctgtctttcttttgtccagtcctgagccagatgtgggttctgggccaaggaggtgaagcacgaggctccctctgctgcctccagagctgtccagggttcccctctgcgcccccaaaagcgcagggtcacaccagtcggggaggaaggaccagagcgactctgcgccctcaccccaccgcctccttctctgtttgctctctgaccggtgccgtttcattgttcccttcctggacgccatcccctcgtccagacaattccctgcaccagctgccaagcagctgcctggctatttatagcctctgtcatcagccccttcctcccgcccttggccctactcctgggaccactctccctacccccacccactttccaagggtccggctgtgtccagccaaccaggagaagagtggggacagtagaggctgagttcgttgacaaatatcatacaacacaatttttaaaatgtttctggaacattccaggacccgttgttgtggggaggggcctgcccttgctgagctggtcccttggtctcctgaggtgatctcaactgtgtccatggcttttggacaaggtgagacgaacttaattctttttttttttttttttttttttgagacagagtctcgctctgtcgcccaggctggagtacagtggcgtgatctcagctcactgcaacctctgcctcctgggttcaagcgattcctgtgcctcagcctcctgactagctgggattacaggtgtgtgccaccacaccctgcctgtttttgtatttttcagtagaggcaggatttcaccatgttggccaggctggtcttgaactcctgacctcaagtccacgccccttggcctcccaaagtgctgggattacagatgtgtgccaccgcgcccggcctgtaatcctactggccgtcaaatccactttaaaagcagtaaaggcatttgactccttcctgtttctcgttccttctcacccccactcaggccatctcccctcgccccaccacttcctccctgcacctacctttcttccttcctttctcggtgaagtgaagggtcacctctcattgtggaagaaggactagtaaagccagctttaaatgaacattactgggttggcctatgccaggcaggcgcgaggtctctattccccatgtgacaatcaagctgggtgcgttcacgcccaggatgctggggttgtcccacctctaggtttggagtgggacgacgaggagaagcaatttgttcaggagcagagaaagttcgcttggctgtgactcatcgcctctccattgagagtctccggcgggtccgtgatcatcggacacgatcatgatccgtcctcaggccccgcctgtgcagagtgcgcggaggccaaggagttattggcagaaaagcaagagcggaatgagcttgcgtacttgaagtctgtggccgtctgccaacatctccttcaaatatgaacattcttattttcgctctggaagtttttgtcaggtttattgcaaatgcaagggtggtgagcagacagaaagaaaatggtatttactgagctggaaggactgttttctcaaccgtttctcaagagcacgcaaggagacgtgcactttcctgggtgacatcaggttctccgtggggattttaatccaaatcagatatggccttgttttacgagggatcctcttgggtctcagggtgtgaggattcataataagtacacgtccatccagtacatggcgaagaccattgtaagccacccctggaaacacatacaagacagatgggcacgcagttcacaggatagcgcagaattctaatgaatttcattggcatcaaatgttatgttcctgtaaactgagagccatgaaattagaatgagtgcctcacaatagttcaaaagtgactcacttcattgaaaaaacgtctcggaaacataaattggtaaatcaaaactaaaactagtaccctttaaaaaaaactgagaatgatgtccctaagtttttttttttttttttttgagacggagttgcgctcttgttgcccaggctggagtgcaatggcgtgatctcggctcactgcaacctccgcctcttgggttcaagtgattgtcctgcctcagcctcccgagtcactgggattacaggcacccaccaccactcccagctaatttttgttatttttagtaaagagggggtttcaccatgttggccaggctggtctcaaactcctggcctcaagcagtcctcctgccttggcttcccaaagtgctgggattacaggcatgagccaccgtgcccggctgggatgactattttaatctcaagagagccatctgggttccttccagggcacaattctatttaaggatatactttcttatttttacacaagtttgataactggataaaaaaaagacgaacttttttttttttttttttgcatggaccaaaaaatgtagccataagagcatttgttaatacgcacgtctaacatcctccttcccacctccctgtgcagcacaaagtggtaaagacagcaagaattttctttctaaacagttgggctgaaattaaacaacaacaacaacaaaaacccaaatgcccattctcctcccagcggaagtacaacctctctttgtatcatgttactcatccgctgcacacacctgttcatccaacaacagctaacaaaagtcagactccgagttaagcgatgtacacatcacagtttgtgctggaaatctgatccaagcacatggacagaactttctatggttctcggctcctaagcttggcagcttgttttcagcgtattcttaaaaacctaggaaactggcaatcatacttctaagttaaaagattgggaaatcaggccagtgaataaatacttactttggatctgcactattgatgaaaaataaaaaatcactggaaaaaaatgagcccctttcttctatttttgctcaaagcagtccaaagaaaacaagttttggttcactgctgtctgtgagctcagtgttgaacaaattccagcaaaatcacagagaaagttggaaccagatttgcagcgctctatctcatacatgtttcttcttcttctttttttttaagagacagggtctcgctctggtgcccaggctggagtgcaatggcacaatcacagttcactgcagctttgaactcctggattcaagcgatcctcctgcctcaggcttctgaatagctgggaccacaggcacgcaccaccacccccaggtgccttttatatcatttgtagagatggggtctcactatgttgcccagggtggagtgcagtggcatgatcatagctcactgcagcctccaacccctgttgccaaggctggttccaaactcctgggctcaagtgatcctcccactgtggtctcctaaagcactgggattatagacgtgaaccaccacagctaccccgtggttcttaaaaaggggtctccttaaaaaggaagcttcaccttcctttttggtgtgagggagacagaccgtcagggagagggcactttgttcttctaattgcctttctgcagaggttcctgctcaaggaacgggacgcctaaacctcaaatccccagtggcattcaaggctgctcgcaggcacagggcgtgttctggccaatcctgttcgagcaaggggagctgacattggcccagcacaggcaggctgcacagagctgcagcccattcttcctggaagcgcctgcatcagagccaaggacaggccacctagtagcagtgtccctggagcctggtgcttggctcagtacattaaaatgcaacaaccaggccgggtacagcagttcatgcctgtaatcccagcattttgggaggctgaggtgggcggatcacttgaggtcaggagttcgagaccagcctggccaacatggcgaaatcccatctctactaaaaatacaaaaattagctgggcgtggtggcctgtgcctatagtcccagctacttgggaggctgaggcaggagaatcacttgaacctgggaggcagaggttgcagtgagccgagatcgcgccactacactccagcctgggcgacagagcggggctccatctcaaaaaatatatacgtatttcacagatacagtccttcctcgttttggtaattgacagagcataagcagtttttaattttttcaaatttacaattaggctcctgcacggcaactctcttcctgtgaactgaagggaaacttggagtctccctctccacagggttctcgtcttctggaaaagagaagatgggaaaatgcggataagaagagggttagaggggaggaaagaaataaaaaccgagcaatttctagaaaacatgatgattaaaaaaaaaccatccacgcttttggaatggacggattctttaacacctgtggatttccttattctgtgactagcaagctcccaagcccacaggtaggaagcttcagccagtgtgtgtggaaaaaacgccggttttgggatacgacggacaagtcagaagcctgcttgaaccgccgtcacccctttgcagccatccaacaccacgaacagcaaaaacatcaggttctggcaacctgtggggacaaagtgaccatcagcacggggaggtcgctgtcagagccgcgtcacagctcttacgcctcccagaatggtttttggtgtgaggattgctgcatggattgagaaggtggaatttgattggaataactggatcatctcacggatggctgaatcctaaaatgcctacaaagcgtgaaactgactcaggatttcacagaggatggtaaggctctgatttttccacttggcactcatctgggtgttatcattagcactttggtttaatgctgcagggtgaggaggatgtacccagaggccccactgacgcaccccgtccagtggcttctgacatgcagagctgcaggacgggcgtcgctgagctggccggggcaggctgggagctgagctttgcagacactgggtcctggtgaacgacgatgcttcgacatccactcttctgggcattcccagcctgtcctctgctctgtccctgccctcccctaattccaattggtgggattgggtggggctctctgggccccacactggtctgagagcctggcgtgctgctgctgggccagcccaggagcgaatggatgaagttcctctttctgagccgggatcaggcccagaactcccagctcgcagctcgggcagctgcctggtgctgaaaccagaagggacctccgggacttagtggcagcttacagggaatggctaggagtgtctccctctgggccagtgagtagggtccagaccaggaaaagcgtcagaaacggaacacgaggttcaccaagaagccaagggggccggctgagggccagcatcgcacgttgatgctgggaggttgctgctttgcaggagtaagggaaggaagaggccatctcagagcagccgcaacactggagtccacacaggggagctcttggcagagccatccacagcgatgattactgtggacacagatggggaggccctgtgtgtgaggcagtgacagagccattggttgggaacacagccaactcttttggagttttgttaactatcccgaggtagaggctgagggggacacgcctacatgtcatgccacaaacttagcgtactagaacatgctagattttctctcaaagcacgcaggtctgagcctgtcatcattctgccagtataacagacaggtgaatgaagagacgggggaacttggaaatgaggggctgaaaagaagagaaagtggaccctggtactggctgtgtaagaaaagtaaatagtgacccagaagaatttgggtcacggtctgattcatacaataaattcattttgtctcatttgaaatattttaggaaaaaggcatgcttttatccaaaattacgtcaaaaattgcctcaaatgtctctcattaaaaaaaaaaaagtagttggaccaggcgaggtggctcacgcctgtcatcccagcactttgggaggtggaggagagaggaccacctgaggccaggagtttaggactagcctgagcaacatagtgagacctcatctctataaaataaatacataaaacagttgcaccttatcttcttagctcttaattgaattaatgtcctgaaagttcacataaatgacattcttcaatattcaaaaagaagccaaaacaaaacccagtctccaggcatcaggttggatgaggactttagaagtctacggatgtccttcatttaggtttgtttgtttgtttgtttgttttagacggagtcttgctctgttgcccaggctggagtgcagtggcgcgatctcagggctcactgcaacctctgcctcccagaggttccaagcacttttcctgtctcagcctccagagtaactgggattataggcgcatgccaccacgcccagctaatttttttgtatttttagtagagatggggtttcaccatattggccaggctggtctcaaactcctgaccctgtgattcacctgcctcagcctcccaaagtgctgggattacaggggtgagccaccacacctggccaaaatttaggtttttttaaagcttaaaaaaaatgttttggggtcttgctctgttgcctaggctggagtgcagtagtgagatcatagctcactgcagcttcacctcctgcgctcaagcgatcctcccaacgcagcctcccaagtagctgggatcatatgtgtacaccaccgtgcctggctaattttgaaaaatttttcgtagaaaaaatttctacaagattttttgtagaaaaatttgtagaaacgaggtctcactatgttgcccaggtctcaaacttctgggctcaagtgatcttcccgtctcaaccccacaaagtgctgggattacaggaatgagcaactgcacccaggcaaagtcatattttttttcacctgagagctccaattgccacgaaaatctcaaattatattctatgataattcaagttaaatgggcaagtaatatttcttttctttccttctaagtgcctgaaatactagaaatacacaataatggcttttaaaaaactacctaacacaataaaaaattgtgatagaatttattgtgtaatcaacaagttagggaaaactgattttgcattaaaggaacatcttctgtttctgttaaacagcaggaaggacaagacaccagcgcaatgagctttttttttttttttggggggggatggagtctccctctgtctcccaggctggagtgcagtggcatgatcttggctcactgaaacctctgtctcccaggttcaagcgattctcctgcctcagcctcccaagtagctgggattacaggtgcatgccaccacacctggctaatttttttttttttttctagtagaagctggatttcaccatgttggccaggctggactcgaactgctgacctcaagtgatccgcccgccttggcctcccaaagtgctgagactacaggcgtgagccaccgtgcccggccagcaatctgtcttttctatggaggcacaaatgtgcagcaaaccttgcctctcccctatgaccatttggataatttggttactctgtagacaccgagttgaggattttcagagatcaggcttatttgagcaattaaacatttctccattctaagcatacactagataataaatattccacacataatttaagcaatgaatcttatgaaaagagcgacggagggagaagggggaaaatacatttttcctcgtggtcactttctgaactactgtctaagcctgacattaaactcacaccctccccctccatctgggttcttcgttctttccttgaaaaggaggaggaaggaaaagaaaccgtttggctgtaataccgcgctctgtttctggctgttaccagcaaaaacactgtggccaatgatgcccagttagaacctgggctttctaacctgataaacagaaaagccttctgccaacacttcaatggggcatcctgaggccagaggaggctccaggggttttcagctcgttggcagaaaagcatagcataacagcagactatcttccaggtagaggcatatttgcgtatgtgaaaacagaatttactggcggaaaagtcattctcttgaagtcaaagcagtgcctggtgatcttgttgctgaaggtttatctacagtcctagagtcagggagggggagggtgatggcggaatgggggtggaggccacaggcggagtgcagaaccgtggcatcctggggcttgaggaaggcaggtgtgtccttggagaagaataaatgtcctagagacgcagaaccaaagctggagctgggctgagctgagacccgagggttcccacaggccagttctggaggagatagagaaggctagaaagccgtggagaatacgggatgggggtcctgggagggcagggctagggggcggttcaggtgcgtcttggcacaagcatgtctgtgcccccgggcgtcctgagcagagcggggtgtcagggcggggcgcgggcatttcgctcctctctccctgaaccctttcacatccttcccgatcctgttttgcgttatcccaggatcacacgcacaaatccaaacaaacttttctggtcccgttcatctccctctcatcctagagggcacggattttgtttgatgagaaaataaagaaggtcagagggagacaggacacagaaacagcagctctcgggagggcagctggaggccgggctagggctgcctccactgtgccagggctgggggggattggcagagacgtctgggtccccaaccatcggctcttccctcaaagagcagcgggggctctgcgggaggatacactaccctgaaagactctcaccagccaacccaagccagtgtttgttctgcctggctctgggaccctcccgccaggaccccaaacactgccgagggaggaattttaaaaataaaatggatgggccgggcacggtagctcacgcctgtaaccccagcactctggtagcctgaggcgggcagatcacctgagatcaggagttcaagaccagcccagccatggtgaaactccatctctactaaaaatacaaaaaattagccgggtgtggtggtgtgcacctgtaatcccaactactggggaggctgaggcagaagaatcacttgaacctgggaggtggaggttgcagtgagccgagatcgcgccattgcacttccagcctgggcaacaagagtgaaactccgtctcaaaaaaaaaaaaaaaaaaaaagaaaaacaaaaaaagatgatcttatgggcagcagctgccatgagctccttcatcaaggaaccaacacagaagtggtgcagttgttttctctgaatctttctcgtcggttacttttttttttttttttttgagagaatcttgctctgtcgcccaggctggagtgcagtggtgcaatcctggctcactgcaacctctgcctcctgggttcaagcgattctcgtgccttagcctccaagtagctgagaccacaggcacccaccactacgcctggctgatttgatttttgtatttttagtagagacagggtttcaccatgttggccaggctagtcttgactcctgacctcaggtgatcctcccgcctcggcctcccaaagtgctgggaccacaggcgggagccaccatgccctgcctcggttgctttttattcagaggttgaactctccataaagccatggacaaaaaaatcatcttgcatgcgttagggttgacgttaacagccctatttaaaaatgttggccaggcacggtggctcacatctgtaatcccagcactttgggaggctgaggtggatggatcacttgagcccaggaatttgagaccagcctgagcaacatggtgaaaccccatctccacaaaaaatacaaaaaccagcagggcgtagtggcacgcacttgtagtccttgctacttaggaggcagagacaggaggatggcttgaggccagggaggttgaggttgcagtgagctgtgattgagccactgcattccagcttggatgacagagtgagactcttatctcaaaaaaaaaaaaaaaaaaaatgtccgtacttgattcctcatatctggaaagtcccttcagtttataagtggaattcacagtggtaaagccactgggacaagcacagcttctaatcacagctgtttctcaaatgctctcatgtattgcagaaaatttaacaacctaggtaaattaaaaaacctaagtaaagggagtttagggcattatatggcacacagtagtcgcttgacaaatactggctggatgttacttatctgttggaaataattcaactaacatatttgtgtactgaaacgttttttaagcagctcttcaaatatatttagataactcacacattaaattctaaaatataattttgattaaaaatgcatgtatcaacgctgggcacagtggctcatggctgtaatcctagcactctgtgaggccaaggcaggtggatcacctgaagtcaggagttcgagaccagcctggccaacatggtgaaaccctatctctattaaaaatccaaaatttagctaggcgtggtggcgcatgcctgtaatcccagctactcaggaggctgaggcaggagaattgtttgaacccaggaggtggaggttgtggtgagctgagatcgtgccactgcactctagcctgggcaacagagtgagactctgtctcaaaaaaaataaataaataaaataaaaacgcatgtaacaatgagtagcattaacatgccaaatcaggtttccagcggagagtccagaaacgctaggaaacctcatctgcagagagttggaatgaaaagtcatctctcctctggttaccgtggatcaggggcactctatttgcattcgtggactcctgaaattatatataaaatcaaaagatttggccgggcacggtggctcacttctgtaatcccagcacttagggaggctgaggcaagtggatcacctgaggtctggagtttgagaccagcctggccaacgtggtgaaactctgtctctactaaaaatacaaaagttagccaggcatggtggcacgagcacctgtaatcccagctactcaggtaactgaggcagaagaatcacttgaacctgggaggcggaggttgcagtgagctgagatcgcaccactgcactccagcctgggcgagagagccagactctgtctcaaaaaaaccaagcaacgaaacaacaacaacaaaaaatcaaaagttgtttttatgtgcattttttctggacaaagtaaccataaccttcatcaaactatcaaagcctttgcgagccaaacctgtccccaccccggaaaaaaaacaatgaagaatccccgctgttgactgagactctaacaggcacgcggattacttaactcacatctccttcagactttcagggccagcagggatacgagaattccctaagcttaaattactctaatattcattaacaactctttagagtcatgatatttaaaaaaacaatttttaaaaaggaactgtataaaaatagacacttgggaagattttaaatgtacatgtccattgcgtgcaagtgtgtactttttcttaatcgcttcctcttggctttctccggttagtttcactttcccagtacgcgggatctattccaggtggccacagccatagattcccacagtgggggaaaagcaaccatgtgaacaagatttcagatgaaagagaaaccacaaatgatcagttctggggctgattgcaaaaattagaggctgcctttcttggctgtttgagaaatcctctaagtcactgggtgccctttctagtagaaagacccacgttctggctgggcgcggtggctcatgcctgtaatcccagcactttgggaggctgaggaggacggatcacttgaacccaggagttcgagaacagcctggccaacatggcaagaccccgtctctgcaaaaaaatacaaaaattagctgggcatggtgttgcgcacctgtagtcccagctactcaggaggctgaggtgggaggatcacctgagtcagggcaggtcaaggctgcagtgagccctgatggtcactgcactccagcctgggtgacaaaatgagaccctgtctccaaaaaaaaaaaaaccgaacaaaacctccattcttacaagaccctcaaggcagcaaggacgggttattccctaagctggaaaggtgaccagggaggcctgcagtggcgactcgggaggagagtgacctcatcaaacagcaacctcattggccccgggctccagcagagaatcagctggaggctgcacccccgcaagtccatgagcaaccaccagaagccatgaattcagctccctttgtggagtctacaaaagaatctttgtgccctgaagttggtcataaatacttaacttaccaggccgggcacagtggctcatgcctgtaatcccagcacttcgggaggctgaggcgcacggatcacttgaggccaggagttcgagaccagtctggccaacatggtgaaaccctgtctctactaaaaatatgaaaattacccgggtgtggtggtatatgcctgtaatcccagctgctagggaggctgaggcacgagaattgattgaacccaggaggcagaggttgcagtgagctgagatcgcaccacggcactccagcctgggtgacagagtgagactctgtctaaataaataaaaattaaaaaaaaaataactcatcaggaaaacccctacaggggaaggggctctaacccctggaagatccatagtttggcctcagatgcgggagtgtggtgaactcccaagaagtgtagaaaatggcatgtgtgtttttctgggaagaggctctatgactttaaacagattctgaaggggctttgtgacttcctcaaaacacctgggaccccagtgatctgtgtacctgcaatcactctttccttttcagaaaacctactttttccccctcaattccttctctaaggatgttgcagaaaactatttaggaggcctgacagggaaaatctcacaagcaaaacttgtcctgcaaccttacttttattgtttaaaaaattctgtgtaaaaataaatacttttcaactcaagttaactggagcaaatagatccaattaaaaaaataacataaacacaaacagggttttctacttgccctgtttctgaagtcatgacgtgaaagaaaggcaaacccacccaggtgagccacagatcgcagaaaacacgagctgtccaaggaagaccgccctcctctctgaagcagtgctcatcttttcaataagaaaacaccaggcatcatatatttaaattttagaatattttaatgtccatttcttcagtgaatgcattttgaaattattagaattaacaatttaaaaagagcagataaaaggatatatggaaaatgcaaacagtcggttcttgctaattcaatttcagattctaggcatgatgtgattttccaaacaaccaattaaaaaaaactccttacctcgaaaatctagaaattcaaatgcagacgtgtctttggaaactacaaatgattacagcccatgtgacaggaagcacgcggccttcggctctccggatcgtgtgcaaatgtgcagggggagcccccgcgggtgacgtcagtgtggatgaagtcacgggtgtggcagagcctgtggggctctcaagctattcgagggttttgtaactgatgctctacatttgtttgcattggataaaattgtgtgtgcttgtttaccatatatatatatatatatatatatatatatatatatatatatatatggatatataattcgatctgagctgggactgagaagaaaatagcaattgcaactcaaagcaactatttacacacattcaatgctgaagtattgcttcctgccctaagttcctaagaggtattgccaccctgaagcacgacccatgccgtcagcagccctcgtgccagctgcttagaaactcgtgtctccagcacgatgtgctcgctgccaacagacaagagatgcacggcgtttccgctgcagagattctgtggttctgcactgaggtatgcatcggagcaggggacggggaggacccgaggggcttcgtggcccagagagaacgtctgcactggctgtttaggaaggctcagggtgtttgaaagacaacgttaagctctgggtgagtctgcacggggctgaaccagactccactttgcagctccttggtttcccggggtgaggaatcacaaacacctttgtggttggggaaggaaatgggcttgatggggaagaagtgtgtgcggagaactttgcggagcatgttctgagcgagacagcaaggtcgtgagcaaacgcccagcccctcaaagctacacagcctggaggggaaaggggaggggaggacattcaaatatacaccttaatactgatgcagaaagagcttcatgtgaccacaatccccacgaacaaggaaagcatcaggtagtgttttttaaggaaaaaaaaaaatctgcggtgttttataatacattctttagaagcaagaggtattgtcacaaccaccctttcttcggtattggaagaccagcaaactgacagtcacacctgacaggaaaccttacagctaatggggggaggtgccctggactctcaggacgccgggaccctggctctggctgtcctgatgggtggccatcccaggcaccgcccctggagaggtggcgggtcagaattgtgacttcttcatgccggggagggcaatctgtatgtctctggggaggagtagtgatgatggggactgatgcggtgtgaaaacgagacagtgagatttgacagcggaaagcaaaatgcacagggacaacgggcaagactgacaaggagtgcaccctgggcctcatcagcgtcccggggtcccctgaaagactggctacaactccgaccggacaactcgggcgagctcacttccacacaaacttcagactcaatatggcaaaacataatcagacaggaccagcagccaactgcccggacggagctcccccacaccaccctcgggattccgcccctaacaaaccccgcgtttgcatccagatgcctctgtccctagatacggtgtgagaactccatttcagagctggaatttgctccccagattaaatcctgccactgataggccctgtgccatctgagagcgggaggcagccaagaaacttctggaatttgtggaagccaagatggcaccggtgctgccggcacagacccccgtggttctgagctggaccccggcagggaggagcccccgtgggtggcaggggcagctggtgggcttctcctattcccctagcctcagaattgcactggccatgctttgaggtcccactcagacccctcttggggtggggaggttgggggcggccccaggtggccaaaacacaaaagagacatctggttaccttcctgggaactgccctcccctgtggctatgaccccccaccctgaggacccagcacccctcccgggagcgcacatgcttccgggtaaataaataaataaataaatgcaacctcggatgtttatttggtatttccctctccgatgagtcagcttccaggaccaacacctccactcccgatggggagacccctgggtggagggtcgggggtgagaggcggctctgagacccccgaggcctgggcacacgggcgtcgtgcccggctggcatttgctgtcttggcctgcatgcatgtgggcgagcccctaaacccgctcagtgcagggagcgcggctcacccacagcccacggggcgcggtgctcgggaaagtgcgggtgggcaatggggggtggcggagctgtcgtgacatgcccccttcgcaccccctcttggcggattactggcactttatatcagattcatgaatgcaagtgtgtgtgcgcatgtgtgcttacatagagaggtcgggtcgtagaggaacactgtgacatagacagaaacaaaataaactcaaaaacagggtattagccagagaaccgaaaatagtgtctcgtgggacgtgggaaaaagcaataaaaatgagatcttaaccacagcttttgttctaaaagtcaaataatacccaaagccatgatctccactggcggcctctgtcccgagactcgaggccgaggccagccctgaaggcacttgttctccaccacgtgctgaacggatgacccagaggcagcggggtttccagggaagggagcgaaagggaagaatggatgaaaatgaaccctgaataactgtgatccacacagaagttagggctgaaatgaccacataacaccacgtccggggagggcaactgtggcgcttggaaagcacaacagccaaatacaaatattactgtgtttcgacaaacagagcacctcgggcagcgggtgggcgccgcctcacacactctttgaaacgttgagcttggtgagttcgttggcttcttctattcctgtttcgtcacagtcgtctttctctatggctttgccaaatcgacccctttcttcggctttgacgggctccttccacggtctcttgggggacaggtgggcatccttggcctgcgtgctgctgtcagaacccagagatgtcttgtccacatactggacagaaggcaccaggttggcaatctcgtctgtgggagaccgtccgatgctgccatccacctggacgcggatgtctggggagatggacagctggtgctgtgggatgaccctgtgatccgtgcactttgggtacaggtaggtcttcatctggcctttccccttgacattcacggtccctctgtagtcgaagtcatagcccatcttgctcaagacgcggtagctctcttcgctcacctggatgcggcactccacgccggtggtgtccatcctgctggcgatgttgacggtgtctccccagatgtcgtacagcagcttggtggtgccgatgaccccggccgtgaggggcccatggttgaagccgacgcggagcttgaagttgaaccacagcatgttgttgttgaagtcgtccaccacgcgcatcatctccttggcgaactcgaacaggatctgcaggtgctcctgcgggtggctgccgtcctgggcctgcgcggtgttcagccctgacgccgccatgtacgtggctccgatggtcttgatcttctcgatgctgctgtagtccggcttgcttaggagctcgtcaaagtccccgatgagctcgttgaggacccggtagcactccttgccgccctcgtagttctcctcgtagaactcgctgaagttgacgatgctggcgaagatcacccctccgctgtcatggttcttggagtaggtctgggacaccttcagctgctcagccacgtggtaggggatgatgttcctcagcagccagtctgcctggtcccgcatgctctggatcttggtgcggtgaagatccgcttccacgtctccgtggtagtggaggcggtagctgacttcaaattcgcgattcaggaaccagaccaacaagagcaggagaaagaagacgagaaccacctcctggccgatgaggctggcgggccgccggaggtcacgcggcaccgaactattgcacgggttcctctcggaactggagagcaaagacacgggaaagggagaggttactgctcggcgcttccaagctcagaacagccccgctagctacgcaaagctttgttgagtccaggccttcaacaacctgaagctgtcaagctgcccattcctggtttgggctggctgaaggtatggagggataaagactaacttttgaaactgattgatttcattttgttaaatagaggtggggtctcactgtgttgcccaggctggtcttgcactcctgggctcaagcaattttcctgccttggcctcccaaagtgctggaattacaggcgtgagctgctgtgcccagccctgtaactaacatctttagtaagtgcttggtaatcgtttttcttttctttttctttttctttttttttagaagtctttagcttctttcaaaaatcttttcttttctctctctcctttgtttttttagagacatggttgttgtccaggctggagtgcaatggcacaatcatggctcactgcagccttaaactcctgggctcaaacgatcctcctgcccagcctcctaagtagctgggattacacgcatgtaccaccacacctagctaattaaaaaattttttttttgaagagacagggtcttgctggttgccaaggctggtcttaaactcgtaacttcaagccatcctcccaccttggccttccaaagtgctgggattacaggcttgaactgtgcttggcctaacatctttttttttttttttttttaagattgagtcttgctctgttgcccaggctagagtgcagtggtgcgatcttggctcactgcaccctctgcttcctgagttcaagtgatcctcctgcctcagcctcctgaatagctgggactataggtgtgtgccaccatgcctggctaatttttgtatttttagtagagacagggtttcatcatgttggccaggctggtctcaaactcctgatctcaaagtgatcagcttgccttaaagtgctgggattacaggtgtgagccactgcacccggctttttgctgaatgaactttttgaaagtaagttgctgacatggcacttcagctctaaatatttcagcatgtatctcctaagaataaggatatttccctatgtaactacaatatcatcatcatacccaagaaatttaacattctctgatatatttggttcttagatttctttttttttgagacggagttttgctcttgttgctggtgagatcttggctcactacaacctccgcctcccgggttcaagtgattctcctgcctcagcctccccagtagctgggttcacagacatgtgccaccacacccagctaattttgtatttttagtagagacggggtttctccatgttggtcaggcttgtctcaaactcccgacctcaggtgatccgcccacctcagcctcccaaagtgctgggattacaggtgtgagccaccgcgcctggccttggttcttagatttctaatccaataaacttatcattttacaaatagcttttatgagttctatactctctacctgtataaaaaagtttgacaagacgccatctcccctgattctgggttagttctttttgccgaaatcactcaggacaatgctaacatctgaaccagtgccattattttctcatggctgtgcagtgttccagcactcggaaattctgtaatttagccagattccccctgatggaactgggcccgagtctgtcttttcttaccacaaacagtgtcacagggaatattcccctacccctatctttgtgcgtatggaagtgctgagtcattttaaatattgcacatttagaatttccttagaaatttccaaattgcccttctaaacaaggctgaaccagtttctgcttttttttttcttttttttgagaaggagtctcgctttgttgcccaggttaaagtgcagtggcgtgatctcgcctcaccacaaactccgcctcctgggttcaagcaattctcctgcttcagccttctgtgtagctcggactacaggtgcacgccaccatgcccagattatttttgtacttttactagagacaggttggtctcaaactcgtgacctcgtgatccacccgcctcggcctcccaaagtgctgggatcacaggcgtgagccaccgcgcccagtctctgctccctttgataactgagcctgctttcagcggggctgtctccacttcagtggcactgatggagacagccatggtcagggggctgcagatgagtggtgagtagcacaatttctttttttctttttcttttttcttttttgagacagagtctcactctctagcccgggctggcatgcagtggtgtgatctcagctcactgcaacctccacctcctgggctcaacgattcttgcggcccagcctcctgagtagtgtgcgccaccaggcccagctaatttttgtattttttttttggtagaaacggggtttcaccatgttggctgggctggtctcaaactcctgacctaaagtgatctgcccgcctcgacctcccaaagtgctgggattacaggtgtgagccaccacacctggctgagtagcacaatttcttaaagtttgtttgaaatatatatatatatatatatatatatatatatatatatatgtatttttttttttttttaagaagagacagggtctgtctctgtcatccaagctggactgcagtggtgcgatcctagctcactgcagctttgacctcccaggctaaagcgatcctcccgcctcagcctccagattagctgggactacaggcacacaccaccacacctggctaattttttgaactttttgtagagatgaggtcttactatgttgcccaggctggtctcaaactcctgggttcaaactgttctgcttctgcctccccagtgtgctggaatacattttttcccatttaaaaatactacatactcatcatagaaaatgtagaaaaaaatagacaaaaaagatttgtccatcgtcctgccatccagaggcaatcactattaacatttgttgaactgcattctagtctttttcttttttacaacaccgtgactgttctgttcatgtaaatgctgtaccctgatgcattcctcccgcgcacagagtaggccagttgatttgatgcaataatgggcttggtcactatatacttatatatgcgactggcggatccacagtttagacagctccatcacactggaaagctcaattctttttcttttagagacagggtctcgccatcttgcccaggctggtcttgaactcctgagctcaaccaatctgcctgccttagcctccccaagtgctgggattacagggatgagccaccacgcctggccaaaactcaattcttcttttttctttcttgctctgttgccctggctggagtgcaatggcgcgaccttggctcactgcaacctccgcttccaggttcaagtgattctcttgcctcagcctcccgagtagctgggactacaggtgtgcgccaccatacttggctaatttttgtattttttagtagagacagggtttcaccatgttgaccaggttggtctggaactcctgacctcaggtgatccacccgccttggcctcccaaagtgctgggattacaggcacgagccaccatgcccggccaaaagctcagtcctttaatcaaagtgtctaataagtttcactaactgttcttgggatattaaaaaacaatgagcttgacctgtgtggccatcacggccctctgcgaagcacaaccgccaaaagccctggccgtgggtggaacagaacccctgggccccatcctggctggaccgcgggggagtttcagaatcttgggtaagccatgccatctttctgggtctcagtttcctcgcttgtaagctgtgaagatggactggagcatggctacgtcccttccagcctaaggttccgtgcaggaaaggcctgaggctgccatccttggaaagacctgcctgcaaaggtggtggctggcaccagggagctgggatttggggagggttcctgccattccttgataagagcggctcacactgcctacactgtctaaataaggaggtttacgctgaatacccgctttcctgctggaagtctggaatttaggcacgtgctgggcagaggcgggagacctgaacagcccctaatacaagcctggacaccgagactttaatgagcttccctggtaggcagcatgttacaagtgttgtcaccactcactgctggaggaattaagcccatcccgtgtgactctaccgggagaggactcttggaagctggtgccggcttcctccaaacgtcaactcacacacccttccctttgctgattctgccttatgtcttttcgctgtaatcacagcggtgagagagcagattgcggagtcctgagtccacctggggctggtcttgggagccctgatacgggctttgtgactcaacgcctatgaccaggaaccaagagtcctcagtgggaagacaccctgtgcttcactgactcatttcgtgaactgctattgaaacagatgacattacatatcctacatctcaagtactaagcaaaataaccatttgttacgatgatgactcaaacatatttctgtccagctccatgagccctctggttgattgtaaatagagcaggaagagaatatggactgggggaaggttttgtgagccccgctcgttgggttaggagttgacctttcttttggtttctcaaagtggtgacaccaagaacagtcccctttaggagcaggtgtcaccaaggtctaacatccccattatgtgcagggggtgtttccagtctctgtggtggaaatgggagactgtatctgggcttctcaatcagttatcgcttgtacagctcactctaatctgcgggagccggagccagcagcacagctgactcgagacgggcgcaggccaggcccctccaggcagaggagggacagcagcacatgggctagtgccagagggagaggaaggcagagcacagcgtttgctttccacctttgcttccaaggaagaaaagccatcacacacagcatgtgcactcagaaaccaagggggctgcctcgcaacagaaggcatctgtaagaaacaggtacgaggacagcttcccagctagaatgtgtgtttcctattttaataccaaaggaacaaaggagccgatcctattcctaaattcaaatagcaaagatccacttcaaaaagaagaatttctttttcttttctttttttttttttgagatggagtcttgctctgtcccccaggctggagtgcagtggtgcgatctaggctcactgcaacctctgcctcccgggttctagcaattctcctgcctcagcctcccgagtagctgggattacaggtgcccgccaccacgtccagctaatttttgtatttttagtagagatggggtttcacaaacatgttggtcaggctggtctcgaactcctgacctcaggtgatccacctgcctcagcctcccaaagtgttgggattacaggcgtgagccaccacacctggctcaaaaagaggcatttcatgtgactaaatgcaggagttaatttataagtcataaatggaagttagagtaaaatacagtgtaatccgttatcatggagaagagggattgaaaaactgaaaaaaatagaaagcaaacatcacttgcagtcctaaccagccaaacgtggcttcggttgacactttggtatatttcagtgccatttaaaatctgcccctagggaggtggtcaggtcgggggagagggggtcagcagcggtggggttggagggcttctggggtagtggtaatgctctacttcttggtctgggtggtagttaaatgggtgtgttctctggtgaaaatgcactgagctgtccttttatgatcaggtactcttctgtgcatactgacatacacatcaataaaaggttaaaaaaagatgctaggtgctttacttttaagtactaaagctgtaatcatcactcattcattatatcctaagtataaatcttgtacatatttttactatatataaatacctagttgtacctatagtacatatatagtttcacctagtaaatgaaaatcttaaatgttttccatatttactgcattttaacagttgtattatttgagtaaatgtataatcagttaatttatttattattgacaactacagttgctaatgaatcttttttttattttattttattttttgagacagagtctcactctgtcgcccaggctggagtgcagtggccgatcttggctcactgcaacctccgcttcccaggttcaagcaattctcctgcctcagcctcccaagtggctaggattacaggtgcccaccaccaccccagctaatttttgtatttttagtagagacggggttttgccatgttggccaggctggtcttgaactcctgatctcaggtgatccacctgccttggcctcccaaagtgctggaattacaggcatgagccaacgtgcctggccttttttttctgagacagagtcttgctgtgacaaccaggctggggtgcaaggacaccatcacagctcaatgcagcctcaaattcccggcctcaagcccaccttagcttcccgagtagctgggactacaggtgcataccaccatacctggctaatttttacaattttttgccaaaacaggatttcgctatgttgcccaggctggtctagaactccaggcctcaagtaatcttcctgccttggcctcccaaagtgctgggattacaggcgggagtcaccgagcccggtccttttctgtgtgctttgattttctctcccttcctctcaaatctgtccatcttttcgttgtggttctatttattatttgtaagcctggaaagttatctcagttttagaggcttgaaaactattgaattttactttttctagattttatatagtttaatttttatttccgactcttcaatttatttagaatttattctgctgtttatagtaaagcaagggtcaaacatttagtattttggatttcaagtcagttattttattactttttgagacacagtctcattctgtcacccaggctggagtgcagtggcacaatcttggctcactgcaagctccgcctcccgggttcacgccattctcccgcctcagcctcctgagtagctgggactacaggcgcccgccaccatgcccagctaattttttgtattttgtttagtagagacggggtttcaccgtgttagccaggatggtctccatctcctgacctcgtgatccgcccgcctcggcctcccaaaatgctgggattacaggcgtgagccaccgtgcctggctgatttcaagtcggttattttaaaatattttacaaaataacttttttctttgatttgcgagatttcctttgttgcatgcgaaagtcttacataaaattacatgactgtaatgtcttattaaaataataaaactaattttattttccccattagacattataactatgatacagttcaacgaggagatattttccactttctattctaagaatgcacgtattgttccttttattcaagatcccattgttttcaggaagcttcgaaatgggcagggtaatacagtcactctcgtttattcagacagaagtgcaatattaaaagcttacctgaaattctgtactgcgtcaaggggcgaagttaatacagaactgaaattaaaatgcagaaaaatattatcataaagagcaaagaaggcattccacaaggcaacctgagaagagcttgaacaaactatgttccttttttagacgtggttgtacatccacataaagccacctgctcccacctctttcttcacatctgtgtctcccaatgctgggggcagttcccttggtaaagctgagtttacgtctttgtttaccatcccgcatcctctctatcctgctgaggcttagcaaccgtgatgggattaggggctctgaggcctcaagtggatggaggagttctgggccgagtggaacttcaaccatcatccctaccccagatctgctatttgaactctgggcacaaaggcggcagaggggtcccccatcactgtggctctccagctccaggtagaaaagccccgcagccatgactaaaggccacggtgaatgcccgatgagggacctgtgatggatttaaaaggtaaaaagcagtttgctggatttcatactctcgagaaagagctcatcgtgaccatcgttctagatggccataccttcagaaaaatccaagtctgctttattttgcttaatctattcattaaagtttcctttcaagtactgaatgacagtcctattttaaattccctttttgatcttaatttgcagggaatttaaatgtcttttgtattgtgattcttttcttaagtaaactgaggacggatgctcacactgcccatggctggactgttgctttgctaataaccaaagacaccccgtgcctactccgtctgatactgacaatactgcggcaaatagaatcattttgtgcttttgaatgaattcaagcagaggtccttggcaacagcaatgccactccaacggggcatttcggaaatgccaggggtccctctggttctcttaataactcagggagccagaatgttagatctcctgcaaggacaaggaagaaatgtcccatgtgactttaaaacattctgcgcacctaaaccctctgtaattgtaaacaggcggttcttcaatacacactaatagtgaaacatttttataagcagttataggaaaagcccaatatttgggagaaatttattacatgaatggaagcttaatgggtttaagatatcacgaaatatttgaataaattgttcactgcttacattctgttatacaaggtattactgtatttccaacaacacatttagttgaaaaggcttaaaataccctgaaaccagtagcaaatgtgtaataggcaattttgagacttattttttatttttatttttggagactgagtcttgctctgtcacccaggctggagtgcagtggcgcgatctcggttcactgcaacctccgcctcccagggtcaaccaattctcctgcctcagcctcctgagtagctgggactacaggtgcacaccgccatgcctggctaattttttgtatttttagtagagacagggtttcaccgtgttgcccaggctgtcttgaactcctgagctcagacaatccacccgcttcagcctcccaaaagtggtaggattacaggcgtgagcaccaagaccggctgggacttatttttaacaaatcaagaattattcagttagtgcaacacatgaaagatagggatcttactggatgtcgctaatggcaaatattttaaatatagcacctatcactgccatcctgtaagtttttacattttttgtagtacaatgatgagaactgggcttgtccccagaggtctaccggcctccctgactcctgtttctgtgtctgcgccatcccattcctcagcacctaccagtgatacggttctgaaggccagcgtcctcctcagtatgcagaggatttcaaaataaaagacctatgttcagtgactggtcattaatcctacgtctcatgacatcatatggggaactgttttgacctatttattattttttgtttttgagatggaatctcactcttgtcacccaggctggagtgcaatggcacaatctcagctcactgcaacctccgcctcccgggtacaagcggttctcctacctcagcctcccaagtagctgcgattacaggtgcacgcccccatgcctgactaatttttgtatttttcgtagagacggggtttcaccatgttggccaggctggtcttgaactcctgacctcaggtgatctgcctgccttggcctcccaaagtgctgggattacaggcatgagccactgtgcccagcctgacataatattttgaaataagccccaggtgacttgcaagatcatcctacgtcttcacctcctccttccaggctgtgacctgtcccggttcatgaaccctaccccactcaaggaaagtcagcaccagcttcctctccaccttcacatccatctgcagctccgctctttcatggccttgaccatcttctatgaaatccttcaggtcctactttcttagattccagcccattcatcagaagtcacctcggtataatgcaatggcagcattatgttttccaggatgtctacattcaactacccagagtgctgttctaaatgatattctttttctttcttttgcatattactctgagggcatctcattagctctttggtatgatgtgtgctgacagctattttgggtcatgatgggaaatatctctatcggggcgtgagaagcaatgtgcaaatgcagccaggccctacgcaacctcgggcaaggtggccacgcaccctggtgcccgcaagcagtgctggccgcgtacctgtctgggcacagggagacgtagagcaggagcagcggcccggcccccacgacggtggcgagggaggacctcatccaggagctgagctggcagaagttacagtagtgcacgacggcaatcagcgcggccgagcctgtgaacactgggaactgcaagaggcgaagggttaggacagccgcccagggccaccccgccacccctgctatacccggccgccaaaacattcgccactaatccatgtttccttttttttttgactgagtctcactctgtcgcccaggctggagtgcagtggtgcaatctcagctcactgcaacctctgccttccgggttcaagtgattctcctacctcagcctcatgagtagctgggatgacaggctcccggcaccacacctcgctaatttttgtatttttagtaaagactgggtttcaccatgttggccaggctggtctcgaactcctgacctcaggtgatccacctgcctcggcctctcaaagtgcctgggattacaggtatgagccaccgctcccggcctaatccatgtttctgtgtaacctaaaaatatcaccgataccagctaattgctcactatctgcagtcagtcttacttttgctagtgggcagtgtcaaggacagatcaagcctctaggttccctacccggcgtgaggctccctgttcacatggcatcacactcttctgcaggtgtgggaaatggcacgtgtcttcgtggaaaggaaagggaggcctccctgtttgagaaacgctgtgtgatcagtttccttcaaaacacttttccttggggcccagtgagatgtgatttggggctaaagtgtcaaacaccatcagcccgcccggaagctcatgctcacttgcaccagaaggatcatctcccacggccgtgctggttccctctccacggagtttagcacagttcccttcctgatcagcagcagccgacccgggcacaagtcaattctgtgtgccaggtatgcttctcgcatggttaggaaaggtgggacagacgcttctttgtaaaatgtgaaggaaaataactgatttggaacttgatgaagaagaagccacactggcagggactcgtgcccaccggggactccccagcccggccactgcccgggcgtgagcatctgggcaggccaatgctaagtcggcttctaaaaaagctggctcaggagagtaaaagagttcgtgcctcttcaagggtttattttattttatttattttattttattttgtgacgcagtctcgctccatcacccaggctgcagtgtggtggtgcaacctcagctcactgcaacctctgcctcccaggttcaagcgattctcctgcctcagcctcccaagtagctgggattaaaggcgcctgccaccatgaccagctaattgtatttttagtagagacggggtttcaccatgttggccaggatggtctcgatctcttgaccttgtgatctgcccacctccacctcccacagtgctgggattacaggcgtgagccaccatgcctggccaaagggtttatttttaaattgctatcccaagtgatttaaagaaaagagagattagggagtccaggagagcgtggaaataaaacggctgagcctttacttacgtgtatgttggtctcatattcggaggtgacatgggagtagacggccagtgcgggaagcgacaccaggatggccccgatgcagtgacgtggtagccagccggcgatccactccagcaggcgcttggtgcaggccatgacgtcctccaggaagaacaccatcctgcgagaggcatgggggttagcaggagcgacggggcccggggtgggtcatcggccaggagacaggtgcgaggccgcagccagcgccgccctctgctctctcccgtgttgcccctgggatgggcgtgagagcaggcgtggggtgggagtctacctccctcacttttggtagaaggcaaggaagccaggcttagctcattgtacctgattctagggtcacatgttgcgttgtgataaaatatgcttgtgaaaagcacatgcttcgctcgcctaacagaacacgtgagagtatcacaggccctgaggagagtctcctgggggccaccacgttgccgtcaccggctcccatcagcttctgaggcaggaggtcttgacgggggcagctttggaggcgtcctggaattctgtggagcccgtgcagttgtcgcagcagaagaggcggtcctggcatctggtgggcaggcgccagggacagagctgtcctgcatgtgggcaggtgccacccagggaggttctgccctgcaccccacacagcagccaagcccctgggcacctgcaaaggcagaaggctgctgacagcatcttagcccagaggctgtgtcccagctacaaacagggtgctctgtggtggtgctgacacaccctggattttcttggagcgcagctcctgtggaaactgagtgacagtggtctctgctgtttggggcatcatcatcagtgtttcagaaaatcacaccacaggctgaacctggctcgtggcgcttagaccaccaaacccgcacacgcgtgccgtctgcatctgggctgtcatgttcatcgtgcatgttcacctctagctggcggcttcaggactctccagacagcggggctctgttgtacgtgaggtccagcaccacgtatttcattttaaaagactttgtccttctaagcagagcgactgtattcactgactccttttgcaggcgtgtgtctagcgggcttcgtttcaggagtgtgatgttgacacaataaaagtttctgtataaagaagcagctgagtgtgcgggccaagaaccactgtgaggaggaggaacaggtcttggctgagtccaaggacccctgggccatggtggggccacatggggaggtgaagagaaggtgtggggtcctcgtggggagacagtccttctctcaagcttgctgccagggagctggggataggcctgctgtccctgcctcaggagaggctgggcgggggccgctgttgtgactgaacagcaaaaaagcctctggcacagagccccccgcccccagccttcgggcctgaacacctaccatgcctctccctcttggctgcgtggtgtggccaggcgagggaacgctcactctccagccattccccacatggacgcaggcacagcctcacccttttagggtcctggacagccctggcttcctgatatttaaaggataatgaagactttggaatacttccaagaataaccacaaatatgcagaatacagaggccctaggaggggggacagagggaaccaagttcccagtcagcagcgggaaagatgtgaggttggagggggccttcatgctggtccctgagactgcagggatctgaaaatgagacctcacgcctgctggggcagagcagagagggtgatgcaggaagcctcctggaggcaacgggcggggcctgggccagtcactgaggaggcgcctggctttcctcctgtacaggaaagggatggggtgcccgtataccccacagcgcaggttcccgtcaacctggggtcctcaacacggccctcagaggggccagggaagcctttcagggtctgggcctctcccaggcttgacgattcctggtaaatggaaccaaatcccaccacaggcctgttcaggggtgcagcagccaccaccttcaccagatccttggggagtatgtctgtgcaggcagttccagcgcacctcaccccagccctcggcagtctacaccggggttgccctcaatgctttagaattgggtctgaaggagcagggaataatagctaaagggtgaaagtaaaaaggaatggagacaatgctggcctcagagccctcaagacgctacagctacccacattagaggaaaacctgggggtggaccagggaaggcagacctgggggagtgactgcccatgaggatgggtttctttttggggtgatggaggtgcccgatagttacatagtggtgatattcatacaattcttcaaatttgctaaaaatcactgagttgtccacttgaatgagtttattgtatataaatcatgtcacaataaagcagatcttcttttttttcttttttgagatggagttttgctcgtcacccagaatggagtgcaatggtgcgatctcagctcactgcaatctccacctcctgggttcaagttgattctcctgcctcagcctcccgagtagctggggttacacgtgcccacaaccaagaatggctatttttttttttttggtattttttagtagagatgaggtttcaccatgctgtccaggctggtctcgaactcccagcctcaggtgatccacctgccttggcctcccaaagtgctgggattacaggcatgagccaccatgcccagcctaaagctgatctttttaaagaggaaaaacaaaccaaccaggggcctgaggatgtctggtttgggttctggggaagtggaccctgaaagggtttgcaggcgacggctcctttgggaggggtccccagaagcacaggagggcactgaggcaggaggggaggctgtgccaggaagagggctgctcgctgggggtgatggggcatgagcccacagggagttctgggaaacactgagcacacgccacagacagcatggcccatggcggcctcggaggaagctgaaagggtcctgggtacagtgcaggtgggaaggagggggcaggaatcccagcctgcccaccccagatgggagaagccagcattccggcgcctcacgccagactcaaagccattcatttctgccctgggatgttggataagggcagcagacgctcaaggtcagggctgcctccccatgtctgtttgaagcccagctccggggcaccgttgctagtgggactctgctaggccggcagccatcctgttgagggtgacaggaccacccaaggggcttgtggtgcccaggacggggaccacacagggccaccttcctgctcaggaatacagagccgctgcgagccccctcagggagccaggctggtcccgagggcccagctttcccaagacgcacctgtggtctattcggagcctctgtcccctttaaaatgagctgtctttttattatcaggctatgtgtgctctttatccattctagatgttagaccttgtccgaggcctgatctgcaagtgttccctcccgttctgtgggttctttctctttcttgatggtgttctttgtagcgcaacagcttaacttctgaggaagttgggcttgtctattctttcttctgttggcgtcacatccaagagaccactgcctgaggcaagtgcgtggagatgctgtttggctccggtactctgaagaggcgcctgctgtcccaggcccactacccccgctcatgtcttttcctttccttcctccagattgtttcctatcttctcaccttctcctttgcagtctctgaacctggaaatctggggacaagctggcagcggttggggctgtggaggcaccgccccctccagcgaggtggtccccccgcatctgggccaacgtcagggagggaggatgctggggcacagggctcggggaggacacggggacccatctccagaaatcagccagcagggacagctggctggggaccagtccaaccgctcagccataagccatggagccagaagagggagctaacggctcagagctggagacccagtccacgcggcgcttacctgatggacaccgcgagggacagcacctccagcagcagggctgcactgaagaccgccagggcggcgggcgggggaggcacggtggccgcctcgtacttcaggaagcaggtggtggacagcgtcagaaacactgtggtcgacagaaacacatccaggagggagctgaaggtgggactagcaaacgtcttcacgggggagttctttatgacctgtgtggagcaggagtggagcagaatgactgggaggccatgggcggccaggagcgcagttcagatggagaaacaggcaacacgtgcggagcactgctgctctgggccaggcacagggcaggaaggctctcggagggctgtctccctctactaccccatttaacactggggagtccaaggcacagagaagttaaacttgcccagggggctgggcacggtggctcacgcctgtaatcccgacactttgggaggctgacgtaggagggtcgctggagcccaggagttcccggccagcgtaacacagtgagactccatctctacaaaaaactttaaaattagccaggcatggcagtgcgtgagtgtggtcccagctactcaggaggatgacgcaggaggattgtgtgagcccaggagtttcaggccgcagtgagctataatcatgccactgcactccagcctgggcaacatagcgagaccccgtctaccaaaaaataaaataattagctgggcatagtggtttgtgcctgtagtcccaggtacttgggatctgaggtgggaggattgcttgagcccaggagtttgaagccgcagtgaactatgatcacaccactgcagaattataccgtttccgaaaacaaaaaaacacaaaaaaaaccctgccagggtcacagagcaactgattatgacccagcacattctcatagacacattatatatttagctgcaagatgagttactgactggcgcaggtgaggtccctgcatctgtaaggcagttggacgagagcaatgtgcagggcggtcctgctgcatggcggagtcctaggttcagcaggtgcgaaagcggggcttcgtggcggaagtggccgacggggatttaagtggcacatcatcgcctgggaacctacggggcctggctctgtgctgggggccagtacactagagaggcacacactagtgttcggcaattgagggggagaaataacgatgctgacacgtccaagaggtgaccaggcccaggccctgcaaggctctggggaggtgcgatctccattgacgctcacggcaccccacaggcaggaactaccacccatctcggtgtacagattgggaggccaaggccaggggctacccctagggcacacagcgaacaaggagccaggccaggacttggcatggaccggttgactcctgagtgtgtccctaacctagaggaaggtgtaggatccaaaggcagaggctgtggttgggagaggaagggatgtagccagttcagctgctttccatttggccttgcaaccttctggcaacccctgagaggccatgggtgtccactcagcatcccggccaggctcggggctgagggcaggagctggagacgcacggagcggaaaggtctcctggcagccctgggtgcggtgtgcgttctttgggacaaaccagctccgggtgcctcgaccactcccaggaactaggtgggagggcaggaggggcacttggacggtgggagcaaggctgccagtcagccctgatgccaggctggaccctgccagggcaacctgggggttagggtttggttccaaattctctccaaggaagctggaggctctgtagtgcccaaaagggcaagtcaggtcccagccctggaatcccctcagaaggtgtgggaatttcttttttttcatttttcttttcttttccttttttttttttttttttttgagatgggatctggctgtcgccaggctggagtgcagtggcgcgatcttggctcactgcaacctccgcctcccaggttcaagcaattctcctgcctcagcctctggagtagctgggaggacaggcacccgccaccacgcccagctaatttttgtatgattagtagagatgggatttcaccaagttggctaggatggtctctatctcgacctcgtgatctgcctgcctcggcctcccaaagtgctgggattacaggcctgagccactgtacccggccaggtgtaggaatttcaggggcgacactgcccatgcccactcaccttggcagaggcccacgcacgtcccctttctgtggggctccatctagtgcccgtcaggggttcgagtcagggccgggtgcatgcatgtgatgtccctgagacatcactgccttgcccacatgtgaggccggaaggtttccacgtgggctgccgtccttctgagagcccacacctcccaccttccaagccaagggctcgggtacagggcctttcctgattggggctgccatctcctctgtagaactgccccatccatggacgctgccagaggccccgctcctccctccacctcccttgcagtctctcctgcctgccctgctacttgccagagacacctgtccctgccacagcctccccctctgggccacccctggccctgatgccagaggctcccaggcccatctgccccacccctgtgcatcccgggagtgccacctgtcccagtcccactgagaacgacgctcccccacatcatgacactctttcgccctctctccccatgggcgaaacccagggacagtgccactggctgccagggcaccgtgggccaggctccgccctgctcactacccacatcccagggcctccgggtgcggccgtcccaccatcatcagagcacaggctctgcagccgggctgtctgggctcaaggccactccaccatgattagctatgatacccacgcgtccatgcctcagtctctttatccaaaaccagggataaaccagtacttgcaccttgtgggcggtgggatgctcggctaagaacgcacccacgtggagcccccagcacaatgagtccccaaacgcgggccagctgggaggctcccttgtcctggcatctctcctttcctccccaccgggaccctgtggccacctgccctgagtttcggtaacagcctcccacctgtcatgtggcctcctgtcttgtccacactcttatcaccctccgaaactcagctgatacatgtttgttttttttctttttttgagacggagtttcactcttcttgcccaggccggagtgcaatagtgcaacggcatggtctcggctcactgcaacctccgcctcccgggttcaggcgattttcctgtctcagcttcccaagtagctgggattacaggcgcccgccaccatacctggctaagttttgtatttttagtagagacggggtttcactatgttggccaggctggtctcgaactcctgacctcaggtgatctgcccgcctcagcctcccaaagtgctgggattacaggcatgagccaccgcgcccggccatgtttttcttctttttgttggaagagacagggtctcactatgttgcccaggctggtctatctactggcctcaagtgatcctcctgcctcagcttcctgagtaattgggattacaggtgtgagctgtgtgatctttgtaacacaacctgttccagatccttcaacagctccccatggcctgtggcataaagtccatggcatgggagccgtgacctggcccctgccacgtcctgccactcctgccccaccctgccccggatgcgcctgcaactccctggacgaaccaggctctttggtatctctaacgtttgtgggtgctggccccactctccagaatgttccctcatcccacattccattaattcctagtccccccactgaggcaggctcaggagttccccccttggagcccccagcctgggcttggtgcctcgccgtgtgctgggagggcactcgcagacctccagctccggatgttgtttctaattcctgctccccatcaggccacgtctttcccccttccccagcaccaagaacagtccctggcagagcagaggctgagcgtacatttggtgcctggaggaaggcatggcaaaggtgtctgctgtttgggaggctcagcagtgcagggcgagaagcggcccggacgcctggtttggcagccagaccactcgtgtccgaccccggctatgggaccacagccacctgttcagccttgctcagcgtcagctctttggtaaaaggaggataatcatcagcttccctacagcattgctatgagcattaaatgagacgatattttgccttacgggccaccaaccagccaactgccaacttgcaagtccactccgggagccatgtctgggacattaacggatattcactgtcccttggaggctgacggaagggggcacctcccaccccacgaggcatgaactggctctactgggctcaccagggtctctctagagcccaagccaggacaccacggagtttaatgaagacctgctggaggaaccaagggaatcagagtgagaaatcccttttgttccgggtggggagggcatccactcttgacttgggaacactcagaggttaggtttgggcccagaggagagaatgcagtctggaagccgccaggattcaaaccaggctctaggttcttgtattattccttccagcaaccccctaaggagcacttgtgagcgctgggactctgctggaggctgtgaggaggggctggaggagagagatgggtgttgggactgtgctggaggctgtaaggaggggctggaggagagagacgggggtcctacctcacagagctgagcatctagggagggaggaacacgaatccagaaccacacacggaaagattccaaaatggggcacacacggagaaggaagtgtatgaagggaagtacaatccagtctgcagtcggggagagcttcttggaggaagtgggattgggtgatgggctgagaagtcaagtacaaggggttaaggcggtgggggcgggagagggaacatggagccggagttagagagagaggtgaaggcctcctgggcccttctcaggggaagaaagcagggagggcaacagagaagagtctcacccaagactccaggacaggtgggacgggggctcttccagggcaggtcggtggggagttcccttccagggcaggtggggggttcccttccagggcaggtgtgggggattcccttccagggcaggtgtggggggttcccttccagggcaggtgtcggggttcctttccagggcaggtggggaggggttcctttccagggcaggtgggggaccccttccatggcaggtggggggggttcctttaccagggcaggtgtgggggccccttccaaggcaggtgggggggtttccttccagggcaggttgggggtttcctttcaggacaggttgtggtgggggggccccttccaaggctggggatagcctggagatgccacggcagaggaaaggggctagtaatggcgaggctgcgctttaagacaaaggactaaagaaagggtttttttcctcctttgcaaagagacatttcatgtacagttgccacttagggtttacagagtgtgggaaatcaatgttcgccttcgtgttcccatcccttggtaaagcacaaaactaacagtgaatgaccatgtgagaacaacaaacacattctttagtaaaagcgcaaggagaaatgaacgcacctcttcctgatagctggtcctgtaggatcgctccagctcctgatccaggaagttcaggctgaactgattaatgggcggcttaaaaaagtaatctttcatcaggctagaagacacaacaaatgcagtcgatcaatacccagcaccataactgtgccaatgttttcagatcataattagctaccaaaacgctgctcattaggtatattacaacagctgcgtctaaaagcgcctgtggaacagacgccactcagctgccccttgttaaaacagatctgtggaaagtccttcgcacctcaaagcataatcatattttgtgtttcaccttcgttaaagaatgaccatccaccatgattatagcacacatcatcagaaccttggttttttggggttttttttttttgaggcaaggtctcactctgtcgcccaggctggagtgcaatggcgcagcgatcttggctcactgcaatctccgcctcccaggttcaagcaattctcctgcctcagcctcctgagtagctgggattacaggcgcctgccaccgcacccagctaatttttgtattttttagcagacgcggggtttcaccatgttggtcaggctggtctcgaactcctgggctcaagagatccacccatctcggcctcccaaagtgctgggatgacagcgtgagctgctgaggcttgtttttgaaaacacattcctaatgtctaggattaggagaagatgaaggcagcttttctgttctttgaaacaatcttttgtgaagaacacgcagatcactgtgctgagagtacttacatggatttggaggcttcaaacgaaaacataattcagaaccggcggtcctgtcattcagagcactgacagtaattgccaccgtaaaagctaacaggttgttatcacaaaattgtgtttatagttagcgtaattttggtgctattgtcacatatgcagattgcatgtgaaacctgcagaatgataaagctcagtgattttaatagcagggaaatcaaccccgctttccatgactctttcattcatttatgaattgccagcaaatagtaatatcctttctatactgcagaaaattactagaaactaagggaacgttaacatgatttcagaaagcaaatatagctgtgttagcctctctccctcatacagtgactatcagaagtaaattagacgaggctgggcgcggtggctcatccttgtaatccccagacctttgggaggccgaggcaagcggatcacctgaggtcaggagctcgggaccagcctggccaacatggtgaacccccgtttctacaaaaaatacaaaaattagccaggcctggtggcaggtgcctgtaatcccagctactcgggtggctaaggcaggagaatcacttgaacctgggagatggaggttgcaatgagccaagatggcgccactgcattacagcctgggtgacacagcaagactatgtctcaaaaaaaaaaaaaaagagtaaatcaggtgaaatatgtcaagtgcctcatgtgccccccacacaaagtacggctcatcacgtgtgttccttcctgtccttgcagcacggcggacactctcctttctgtgacaggtatccagtaacttccaacattctcagactcagaagagaaataattctgtcccaggacactgaccctctctcctcccctgactcagggagtgtggactgagggaagagcaaccacgcagctgcagagaggatgtgcacaaggccacattttagcagtcaagtggcagaagcgacactgctattagctgtgctgctccatttatttcttatttgttttttgagatggagactcgctctgttgcccaggctggagttgcagtgctgcgatctcagctcattgcagcctctgcctcctgggttcaagcgattctcctacctcagcctcctgagtagctgggatgacaggcacccgccaccacgcccagctaatttttgtacttttagtagagacggggtttcaccttgttggccaggctggtcttgaacccctgacttcaggtgatctacctgcctcggcctcccaaagtgttgggattataggcgtgagccacagcgcctggctgaaaatcaccctttgaggcattatagtgaagacagaggcaagaatcatcaatgaatgttaaatctagggaattctgatggggaatgaaatatgtacaagatcttcaagtattttctcacagattgcttattagtcataagaggaatataataaccctagatgagacaacccggcaccaccttgcctaattaatcaaaattagtatcactaatgaggaacagacgggcactgcgtgtccctggagaggacaccctgaggaggacacggcatcccttctgcagtctctgcctggccagagggagagcctgaatctaaccaatccaacttcaggaatatttgataaaaggactggacctgtatttttcaaaaatgttaccattaggccaggcacaggctcacacctgtaatcccagcactttaggaggccgaggcgggcagatcacctgaggccaagagttcgagacccgcctggccaacatgttaaaaacccatctctactaaaaacacaaaaattagctgggcatggttgtgtatgcctgtagtcccagctacttgagagacctaggcaggagaattacttgaacctgggaggtggaggttgcagtgagccgagattgagccactgcactccagcctgggcaacacagcaagacctagtccttataaaaaaaaaaaaaaaaaaaaaaaaagccaggcgtggtggctcacgcctataatcccagcactctgggagggtggggtaggtggatcacccgaggtcaggagtatggagaccagcctggccaacatgatgaaactccatctctactaaaaatacaaaacctagccaggcatggtggtgggtgccagtaaccccagctacttgggaggctgaggcaggagcatcgtttgaacctgggagatagaggctgcagtgagccaagatcgcgccactgcactgcagcctggatgacagagcgagactcagtcttaaagaaaagaaaagaaaaaggcagagaggcttctgcctgcaacctttgctttttcccagacagccccagtcgtacctgtcttctttgataacgtccacaaagtgggcgtccgttttctcccggatgttcttgaacctcagcggaaggagagccgactggtccaggctcacccctgcccaccttcccttctcctgcaagatctcacacagagaagtctgactgttggtgagcttctcctcttggggagggctgaggagcccgttctgagttttgggattaggtcctccagaagcctgcctcgagacaaagaggacgcagacacgggaagtgaagtggcaccgggcactgggcacacacgcctgtcccaccccgacctccgctgcggggcgctgctgcactgggcgtgggactttctgacctgcgaggaacccccacccccctgcgcctacagacctgctccaatcccagccctgactgcccgtctgctccttcctgttacccaacagtgcccagtggtaacgctgggtgttcaggctgccaggacattgagacatgggaagagtcggtgcggaggtggaggggaagggaggaaagtgaggagccgaggcccccagagtctgcttaggccagaaccacggttctgggagcagggtgcatgggtcgggggtccaggagaagtatgacgaggggtccagggctgtcagggcacaggcaaggtggatggaaacgggctcgtgtcgtgggtgtcccccgtggctgtgggaaggcatgggatgacctgcacctgcaatcctttggcagatggagagcagatggaggacgagagcccgcgccccaggtgagtcgcctgcatgagcccccgccgacaggctctcgcgggtgggctgagtcctggccctggtgtccaagtctggttttcctgaaagccttcctgccaccggccctaactcccaacctctctcttcacccagcctttctcgccgtgaagaccccctcttgtctctgcccgtctatattctctcataaactgagtccagcttccagtaccacaaatcccctcccggcactcgaatccacgcattttaaacccttattggcctttaaaggaatcccgcccagctcagcccctgagcgctggtttccacgtgggttgctgctgaccctccctcgagctccctgccggtctcttcaacacccggaggacccgcgggtgcggagtgctgttacccaagaggagttactctcagaactaagaagtcgacaagacaggaatgtcaccttgggtggatgcgccaggagaggaactgacaggaacaacagccatgagcttgttaccttggtgctgtttttatgctcgtcttggcagccgttttgaggtgctcctccctcggcgccggcttcagatttgggagcaaatgtgattccgcacgaagggcaggtctagaagaaaaacacagactgtggggacacacccagaaaccgcgactgccaccctgaattcaggcaggtccgctgttgccatctgccgtcacgcagcatggtggtgagcaaggggaaggcacacagaaccgctcggggatgagctgaaagccaacgggcaaagtgacagtggaaacacacagaaacccgggcacgaacgcaacaggacccaaaaatggaaccgggaatgttcactgactgaacaatggatcaacaaactgtggtctattcgaacaatgggatattactcagccacgaaaaagacggaagcactgacgcctgccacagcatggtgaacctcgaaaacattatgctcggggagggaagccagacacagcacagatattacgtgatcccgtctatgtgaaatattcagaaaaggtgaatccttggagggagaaggcagattcctggctgccaggcgggaccgggggcaggaagggggagtggctgctaaggggcgtggggtttgctacgattcgaatgtttgtgccccctcaaaagtcagacgctgaaatcctaattcccaaggggatggcattggggggcaaagccttgggaggtaattaggtcatgggggacaagccttcaaaataggattagtgccctcataaaagaggccccagaggaatccctcgtcccttcgccctgggagaaggcaccatctgtgaagcaggaacgggtcctcactggacactgaatcttccgggaccttgatctcggacttcccagcctccagaaccctgagaaatacatttctgttgtttaaaagccacctggtttgtggtatttcaacagggtttctctttgggatgataaaaatgttctgaaattgatcacggtgatggttgcacaaccttgctaaatatactaaaaaccactgaactgtacactttaaaaagatcgatttttaaatattttttgagatggagtttcactcttgtcacccaggctggagtacagtgtcacgatcttggctcactgcaacgtccacctcctgggttcaagcgattctcctgcctcagcctcctgagtagctgcgattacaggtgcctgccaccacgcccggctacttgttttgtgtttttagtagaaacggggtttcgccatgttggccaggctggtcttgaactcctgacctcaggtgatccacccgtcttggcctcccaaagtgctgggattacaagcatgagccactgtgcctggccaaaaagatcgattttatagtatgtgaattatatctcaacaaagctgttattaagtaaagaaactggccaccaactatgcgaggacacaaatccaaggttcttaagctccgtgtgatggtgagctagtctcataagatgggctgaataatcaaaggtacacgatttccagatctaggcgtacttaaaagtttataggaattaatggacctagaaaagagaaggcaagatttaatacaggtaccctaaaaagagcaaagcctttatttctcataaactaggattcaaaccctagtcaagtacttactagtttggagactctgttcaaatcactttacctcagttccctcatctataaacaaagagtgaagatatgttgctaagaattaaatgaaattggctgggtgtggcggctgtaatcccagcactttgggaagctggggtgggaggatggcttgagtccaggaatttgaggccagcctgggcaacatggcaaaaccctgcctcaacaaaaagcataaaaattagcctggcctggtggcatgtgcctgtagtcccagctacttgtggggctgaggtgggagggctgcttgagtctgggaggtcaaggccgcagtgagctttgatggtgccactgcactccagcctggggcaaaagagaaagaccctgtcttaaaaaaataataattaaatgaaataagtatatatatagcctagcacagttcctggcatacagtatacccgtaataaacttattattattattaatgtgaccaggtaacctaggaaccatctaagaaagcaactaacagcttccaatgaagaagacaaaccgtggcaagaaatatatttttttttttttttggactcaaaagcaatttccttgcagcaagaagtgtaaaacattgaaataaattatgggaggccagatattattttggaaatttaaagtaagtgtcactacctaagggcaaagatatgacccaggttgtatttaaagttagactgcagacctgtactatattaaataaaagaaacaaagattctacagggttgtatagtttgggaatctgatgtaacatacaagctaaatttgaacatttgtatgcattcaaaaaatgaaaatatacatgccaaaacagctagcgaaatcattaattaacatatctgagcaaataatggcatctagataacatttgcttacagctctttaaaaactgacattatcaacagaggtaaaatgttctagttatcaataacatacagtgagtctatttgaaagcacctcttggtattgactggcagagttaaacttctaaacattttgctggtgtgctggctcacacctgtaatcccagaactttgggaggccgaagcaggaggactgcttagggccaggagttcaagaccagcctgggcaacatagggagaccttgtctctactaaaaataaaaccaattagctgaccttgatggcacgtgcctgtggtcccagccactcgggaggctgaggcaggaggattgcttcagcgaaggaagtcaaggctgcagtgcactgtgattgtgccactgcactccagcgtgggtgacagagcaaacccattctcaaaatacatatatatatgtataaatatgtatatatttgccaatgagaccactgctcttattaaatgtaaaaaaatctaacaccaagagaagaataaaataggtgtgcctgatacccatgcctaaaagatgcctgagggaactctctggtgtggctaaggtggggggcttggtgcttgatggggcacaccagccatttcagggcccaaccggtagaccaggaaaggaagctggaggtgtggaagcgtctgctgcacttggctcagccaaagcccgaagtgcaagtgcgtgctcagtaaatgctggtagtgaatatgaaaacttctgttaactatgctctctggtcattaaagttcatctggtaattcaatgtccttgattacagacagaacagcccttggtatctattcttctgtagccatttagtcacaggaatctcctggcgtcagtctgtttcaggtatttttcttgcctcaagttcatctgctgtgcttttctctctttttttgtttgtttgtttttttgggactgagtctcgctctgtcacccaggctggagtgcagtggggagatcttggctcactgcaacctccacctcctgggttcaagcaattctgctgcctcaacctcctgagtagctgggattacaggcgcccaccaccacgcctggcttatttttgtattttcagtagagatggggtttcaccacgttggtcaggctggtctcgaactcctggcctcaagtgatctgcctgccttgccctcccaaagtgctgggattacaggcgtgagccaccgtgcccggccaaccctcctgtgctttaagacgaggccgcctgcttcttcagtgccccccacggcacactggctttatgagattttctaagcatttagagccatgaatgtgtcaccgtgacagtcaaaccaacttggcaccagagggcacactgaggacagggggctccatgccctccacaagggcttccctcagaggggctggaaggccggtgcagcccgggcatgcccactgggatgaggctgagctctgggggcctggggcagtggtctccacaggtggggaactcagtgctttgcttacatccccttgaacagaggccgaggcctgcaccctgcagtgataagaagttctgatacagaagtgaggtctggcagagccgcccacaaatggcaaatgaggctgcgcttgcagaaggaagggggctgtctgggtcacatggccagctgtagacacccacgctcgggcctcctgagggccgggacagtgctcactgcctattccattcccagcaggtttgtccgggaagtgggagtatgggaggtggggggagagccaggtgcagactccaggccgcgctgggtggcatggtcccacagacctgtgtcacccggacccagcagccatcattttactgcactttgaaaatgcggattttggctgggcgcagtggctcatccctgtaatcccagccctttgggaggctgaggcgggtggatcacctgaggtcaggagtttaagaccagcctggtcaacatggcaaaaccctgtctctattaaaaatacaaaaattagctgggtgtggtggcacacacctgtaatcccagctactggggagactgaggcaggagagtcgcttggacccgggaggcggaggttgcagtgagcccagattgtgccactgcactccagcctgggcgacagagcaagattcctcagctaccttccttttgagggataattttctagataaaaactttcaaacaaatgaaacaaaagaaatcttagagctgggtgtggtggcttgcttgagcccaggagtttgagatcaacctgggcaatgtatcaagaccccatctctacaaaagctttttaaaaattttagaaattagctgggcacagtggtgtgtgcttgtagtcccagctactcaggaggctgaagtgggagggtcgcttgagcccaggagggagaggctgccatgagctatggtcatgccactgtactgcagactgggtcatagagcaagaccttgtctctttaaaaaagaaaaaagaagccaggcgcagtggctcatgcctgtaatcccagcactttgggaggccaacatgggtggatcacaaggtcaggagattgagaccatcctggccaagatggtgaaagcccgtctctactaaaatacaaaaaattagcctggcgtggtggtgcacacctgtagtttcagctactagggaggctgaggcaggggaatctcttgaacccgggaggtggaggttccagtgagccgagatggtgccactgcactccagcccgggcaaaagagcaaaactctgtctcaaaaaaaaaaaaaaaaaaaaaaaaaaagaaaagaaagaaagaaagaaaagaaaagaaaagaaaagaaaagaaaagaaaagaaaagaaaagaaaaaaagagaaatccatctacccaatggagagattctcacatctcaacatccccttctgagctgtagttagaggccccttctgtaccaggagggtcccaccatgcaatggtgggtgggtttgtttccctcccctgacctcctaccccccaacccccatggcaattttccttgagcgattcattagcttaattttaatctggattaagacatttcacaacatgttttttgccaagtacagatgcctctgtgaaatgtttcccagccggctaaacagcgtctccccctgcacagctgcaggcatctccacccctgctgagaagccctccctgggaagagtatttctgactccaggaagctgcaggcatggaagcacctcactgccttgggagacaaccctagcagctggctcacagggagccacacgggcaggcacattagagaaaaagcagtgtcataatgacagtagctactatgacttaggaatgtctatgggccaagatcctacccgtgaacaagtcgggcccccatccacgcaatatctgcagtctcgactgtatgatctcgtcctttgcagccacactgtgaggcagcaatgatcattccgcagacggccacagactccagggccctgggacccggaccaccgtcatatggctctggccccctttcctggcacaaggaggacccaggaataatcctggcaccttgctctcctgggccttgtttccctagagtgacctgagcagctatgcctgtcctcctggttcttccaagcagcaccctgggccctccggcatcaagggaagtctcaagacttctaaggtcctcccagcagcacgcctggcgggccagggagtttgctggctgttgcctgggtaacctgagattccctggagaacgcccaagagcaaactctgcatttttccggattatctttgctccttcccccatgtggacgtgggctttggagggaagagtgtagccatttctctaacacacttgggcacatttgcatttgtttttaacacatttcaggacgtgcaccctacattccggtcaaaatatatggcacaaagctataaaatcgttttttcttcaaggttatttctcatcacaagataaatcatttctaagccaacagctgtcccttttcaaaactgtcaagggagggagtggggaaacctcttttctcagaaatgaggaggatacaccagtagaagagccctggctttgcctgcttcgtcttctcaacacgactgttttgcaagatgtcgtgttatcagaagcatcctttgctcccaaactcaaaatgatgttaacatggtgagcaggaatagtcatgatattgcaaccacaataaccacaaacacaatttcctgaggtgttctttgaaactccttgtatctgcttaaccctcgtaagcaaccacgatgcaggtactatgatcggttccattttacagatgaggacactgagacagagcaagcactggcccagagccacacggtacggtcggaaccgcgtaaagaggcggtgagcccaggcagcagagctcctggccccaacgatctccaggtgaacggggcagcctgtcagtgcggcagagccatggggctaactctatgtccctggcattgctgtttaagctaacaggttaggtacgggcataagtacaaaatagagtatttctgctaatgcaacattagagaaaaatagaagcagaatattagaagaaaagataagcagtaattatcacagaaaaagaaattttcttacatccccaaagcagtaagaacagacagcagatggcctgagaatactagacaagtcaccacatgaacacacacgtgtaaaactcacacacacaatctcagagccacacggggcggagtcgaaaagtccctggacctctcactcaatcccttagccctaaaggaccactgggctcaataaccaggctggtgatggcgatccgagtcaagaatagatgaaaatatactcagcagactgtcaggcaggaagactgttaccagctgtggaaacagtccatcatgaagtcaagataagaaaatatttggcatctggggaaatttcatggaaatgcaatatttcactctctggcaatgccagttcaatgattccgcacatacatttccatccctctctctacacacacacacacacacacacacacacacacacacacacatatataatttcttactttgaaataattttagacttgcagagagtgggaaagacagttcaaggactctgcatatatcctccgtacatactcaccgtacagttatcaaaaccaaagcaactcatgctggcgcgataccgttaactaagctgctggctttattctgatgtccccagtttccgcaccgtccctttgctgttcgggtctcctctaggtcccgtgttgcatttagccctcatgccccctgctcacccccagcctatgggggttcctctgtctttctctgtctcttctggccctgctgcgtttgaagtcccggccaggcattttgtcaaatgtccagatctggacctgcctggtgctttctcagagcagactgaggtttggggtttgcggaaagaatgccgcagaggtgacatgcccttctcagcacaccacactagggtaccggatggcagtgagcagggaggctcacctggatcatttggtgaaggtggcatctgcccggtttgtccactgtgaagttcctattcctaccccgccccccacctttcttttttgagatggggtctcattctagtgcccaggctagagtgcaatggtgcaatcttggctcactgcagcctctgcctcccagactcaagcgatcctcccacctcagcctcccaggtagctgggattacaggtggataccaacatgcctggctaacttttatagtttttgtagagatggttttttttttttattgttttttttttttgagatggaatctcactctgttgcccaggctagagggcagtgacatgatctcagctcactgcaacctccgcctccaggttcaagagattctcctgcctcagtctcccaagtagctgggactacaggcaccagccaccacacccggctaatttttaaatttttagtagacatggggtttcaccatgttggccaggctggtctcgaactcttgacctcaggtgatccatctgccttggcctcccaaagtgctggaattacaggtgtgaccacctcacctggcggagactaccctttagttttacaacagctttcttaagatgtcatttgcaaagcatataatgcacccatttaaagtatataactccagggtttatagcatattcacagggatgtgcaagcatcaccactatcaattcagactaccacttataataaatacctatttaatttctaagctatatatatttatatatgtatgtgtctataaaatatgaaatcattttttcaatttctataacgaatgaaaagccccttacttcctcaaattgggccaactgagcctactcataatgacttgacacatagaaaacaagtagataaaagaagttatcatttagggtcattttcaaaattcactgtcacaaaaggatggttcctgaggtgagtggccttaaaggggaaggagaaaccttttgaaagcaggacaggtcctctctgaatcatccccgtatgggtaaatctacatcactagcttcattactgactggtccatgtagaaacacccagtggccaagcagcccggggttctgaataatagatgaaggtaaactcaggaagaccagccacgcaggtgcgctccagggaggcctttcagagatgtactaagatgctttcacagctcaaatggttccctgatcagaagtaatgtgatacaagtaattcaattttgggttttcttttcttttcgagatggagtctcactctattgcccagtctgaagtgcagtggcgtggtctcagctcactgcaaccttcacctactaggttcaagggatcctcctgcctcagcctcctgagtggcttaggactacaggcatatgccaccacacctggctaatttttgtatttttagtagagatggggtttcaccatgttggccaggctggccttgaactcctgaccgcaggtgatctctctgcctcggcctcccaaagtgttgggattacaggcatgagccactgagcccagttgggttttctttttcttcatgaagatgttggaaaagctgtttttattgatatatggcatctagatccactcatcacccacagggttcatgagaaaatggaaagcaaatgcctgctggagcgctgacgtcacattcaacaggccaaggcacacatgctcccgtgtcatacaagtgacttggttacggccgagagcatccaacccacagcaatgctcagccgcaatcactgtgagaatctccctcgaatcggaaccgtggagaagatgggaccttccccagagagtcagtgacttcctgcaggcaagctgggaccgtctctcggcccctcccagtcctccatggctccgtctgtggtcactgtccctgctctgcgtggagtgaaggcgtgcgtgccgagtgtgagcgaggcttcttctcagccctggcgtccacaggcaccattccggctcatctcccagcaatcccgagaggtctcttccttatcaccaccgcactgaagaggaaaactctcacttagaggaattaagtgtgtgtttgctctttcttttctttttttttttttttttttgagacagtgtctcattctgtcaccctggttggagtgcagtggcatcatcacagctcactgcagcctctaactcctgggctcaagcgatcttcctgcctcagctgtctgagtggctaggactacaggcatgagccactgcacctggctgcagtttcttcacagtcgcaaagccaaggcttgagaagggtcttgcttcaagttgcgcccctgcccgccgtggtccgcctcccctccgcgacgctgacagtggcgtcctcatgtctaatgcttactccttggtttccttcttgacctctccttccttcactcgggcagtatctgtcccccacattatgcaatgtcagggcccttaggatgaggacctctcactgctggtcatttcaagaacccaaggccaggcacagtggctcatgactgtaatcccagcattttaagaggccaaggcaggaggatggtataaccccaggagttggcaaccatcctgggcaatatagcaaaaaaaaaaaaatttaaaaattagctaggcatagtggcacatgcctgtggtcctagctactcagcaggttgacttgggaggatcacttgagcctgagagtttcgagctgcagtgagctaagatcataccactggtactctagcctgggcaacagagcgagatcccatctctttaaaaaaaaaaaaaaaaaaaaaagaagccaacacttgggtgtagaaagggttccctttgagctatgacttcaggaccaaagccctggcctttgacatcactatcatttcctggtaggtcgttacagtacacaggttatgttacattagataagaattttccagctatgacctaggagatgacttaaggtcacagaggacacacatgctaagggcaggaaataaacccttcgtgggcgctgccctggttctacacagttctgctcgggcttctgacttcagtccttcgcctggctctgcagagctgcatcgctccatgtgtttaattaaagaattaaaaagccaaaaagaaactgttaattactacatgccaggcaccatgctcgacacttgggaaatatttaagttatttaacactcagtctctgaatgcaaagagctcccaggaagacgcataagaaacaaagatttaagatcgtgtatgttacagccaagtgggacagactgaagggactgagaatttggagacgagggaacagcgttatcagctgcggaggcacgggaaggcgtggtggagctgaacggtgaatgcagacaggagttcaggggaaagagaagccatgagtatctcaagtgagcagcagcaggaacaggacacacgtgaaaatctacgcatgctccttcagggaacgtttcctgaacaccttttctctaatgtattggtccttggcatgaaactccttttactacatgagcattcccccaaaaggtgtgaccacattagccctgcaaggtgcagcttgaaaaaaaacaattgtgctcaaagaggcctgagaatgctgtatataccgcgtcctcctctgaaggcctagctactgtctactagcctagtgaaggctccgagaagtcctgcagtaaagaaaccctttctgtgttgaatatcccaagcttcccgaatttactttaccactgagcaccctcctccctttttttggagacaggacaaggtctcactctgtggcctaagctggagtgcagtggcaaaatcatagctcatgcagcctaaattcctgggctcaagtgatcctcttggctcagcctcccaagtagctgggaccgcaggcacaggccaccaagcccagttaatttttaaaatttttttgtagagatgatgtcttgctacgatgaccaggctggtctggaaatcctagcctcaggcatccctcccacctcggccgcccacagcaccaggattacaggcgtgagccaccatgcccggccttctgtcaacttgatagatcacaagattctcagaaactttcaacaatatttggaaaatctccacatgccaagaagatacgctaaatggtttttgctcattccgaccaaaacaaatatatatgactagagtgcaatgtagtgtagaatcgccattgctaaaaccgtggtcactaaacccgtgagcatgtgatatggtgaactctgcgaccgcatcccctaacggacagaaacacacatatgtggaagctaaaatggcaaacacaacgaattatatatttttggctcggggctgtctttcacgacttaaatacagctcagtttgcaggctggaggaaacaattcttccccaaatagcaaaaccattcccgattccaccccacgccagcccctccctgcccgggtccgctgtctaggagcccagagctccattttctgactcctgcacaacgtcagcccaggcaaggcggctgtctctaaagtttgcaggcatccagggaatctcagatacatgagctttacacatgtgccaagagtacagggaagagagggtccaacaccactgtcccggtggttttcacccaggggtgactctgcacccccaggggacactgggccatgtctggagacatttttggttggcacagctggggagtagggtacgggtgggtatgctgccatctggcaggtggcggctagggatgctgccagccatctgacagtgcacaggacagccccacaacacatgactacctggtccaaaatgccagcggtgccaaggtgagaagccctgcattacactaacaaagcacccaacgaccgcgatccacgagcggagttgacagaacccgagtgcaatcattacgtgtaactgggcgacaggcactatgtattctgacccagtaagtaatctgcataccccagctgactgccacataatgaagactgttcctcgtaaataccaatagcggctttcaaacctgtgaatgaatgtggagaggcagggacgtattgggtgaagctgtaaccactggccgccatcctcacacataccccactgtgttatctgagaacacaaagcagcataggagagctgttttgattctctgtctcattttaagaatggagacagtagatgtttaaactataaaaataaacagaaggtaccagtggggaaactaaatcaaatgtgaaagcaaaggaacagctcataaactgaaatgatttcacacacccaaggtcgaccgcgccaattccctggtagtttatgatgacaggtcagtccagaaacgggcacttctaggcagctaccaggagatcccggttccaataatgaaatactacaatgttctcggcagcctgtcctctcagtgagctgtgtcctaggattcacccacaccaacatcatttcaagtaatcataaaatagtggatttcaagagacgtagaagtatttgagaaagtggtctctgaaatcagattatcaactagctctccacccaaggtgccaaggaaagccacctttactgtcatttatcaccagcttctagaaatcccaaaaggcaccacaggtcccaggaagagaaaataactaataattcaaatgagaagcatccttgtgcaatggaaaggcaatggaggtgcgtcatatgtcaaaaagcaaggatgttaaaaatgcagaatgctactaactttagactaaatattaaaatcgtgaaaaccaaatcgaaggtcattccaagttgtttgcctcagacctggaggctgcttattatttcacgtgctctactgcagaattaatagaaagttttagaagtaggaaaaaaaaaacaaaaaaactaaccttaaggttatcaaaggttttgacagtctgcgccaagtcactgacattccctgatgacgctgtcccctgtcccctagggcctgaggacacctgtgagccgtcaatgacctcaaagccagaaagcaaggcctctgcacagctgcagcgagactccttggctctctgacccgatatcaggtatgtcttcaaacctatgatggataaaagttacagtcagcacagattgaaagcaccgtctgttgaaacgcagctccgtcttgctctctggagaggactcactcctggaaagttgagagtaaagtgaaaatgtgaataggtcatagtttacgacggacgtccacgatctctccagagagatgcggcctcagggagaccgtgggcccccgagacacaccactcacccacgttacgttttcttggagtaatggctgcatgtttcatgttttaccttcagggttaaaataagcattaaaaagttcctccatgaaagggtcccaggacctccccgtgaaggcagcaaagcagattggttgaccctagacactgctttggtttatttccatctgtgaataccagtccagtgagtaccttcctaacggtcagtctagacgtcatggcagcttccggtactgaccatcttacctgtgtcagaggctgcaaaactaccccgaaaaacaagaccctaccagggaccaagaggccattaaaacctccccagactcagagctgttgagcatctatttcctgttggattcaaacactcaccccaggaacattcagcttttgttaagctgaggtccacatgcattttattgtctcacaaaatcccgcatatagaaaaaaaaaaaaaaggtggtcaaaaggacacttgacctgtatctttacaattctcctttgaggctgagctaacagccggacccacactgcgctggaaggagctgtgaacaggtgggtggatcctgccccgggaatctgctgggaagatggcaaaggagcagcttttctagaaagagcccaaggaatttttgaaaaagaagcaaactttatttaaagaaatccatcctttgacttcactggaatttaaccagatggcaaatgtatcggaaggagggacaatgtaatttaacatttaaataacatttatttcaggcctagtgtatgccacacaccgagaataaaatcatgaacaaagcagggtcccttcttttttttttttttaattgagatggagtctcactctctcacccaggatggagtgcaatggtgcgatctcagctcactgcagcctccacctcctgggttcaagcaattctcctgactcagcctgtgagcaggcaggtgtccaccaccacgcctggctaatttttgtatttttagtagagacagggtttctccatgtcggccagactggcctagaactcctagtgatctgcccaccttggcctcccaaagatgacaggtgtgagccactgcacccggtcgcagggacccttcttgaagggtttaagctccagcttcaggtcgtgaagggtgtggcatggaaagatgccatcgagaggcgacgtgtctacaacactgatcgactctggcttcttacgctgggtacatatttggtcagcgctttaaaattaattaatcagaaacctagggactacttcatcaataatcccgaatcattttataagtatggccccatctcatcacttcacctccctctctccttgtaaaaatactacgtggctaatctttttaagtcaactgttctgagaatttgccaagagtcctagaaacacgtaaagacagcctagaacgtagccaggtcatagctgagaatcaaaagacttagatatttttagatgccaactggccccaagaaactcttcatgttttgttttgttttgttttgttttgtttttcctttagagatagggtcttgctctgttgcccaggctggagcgcagtggtgcaaccatggctccctacagcccccacctcctatagcctcagcctcctgagtagctgggactacaaacgtccgccactatgtccaactatttctttctttcttttttgagatgggggtctcactgtgttggccaggctggtctcgaactcctagactcaagtgatccgcccatcttggcctcccaaagtgctgggattgcaggtgtgagccaccacacctggtccaatgaaaatctttcactcttacttagctcctgaacttttgtgcatttttttctccaacaaaaacccacatcccaatttatgcacaggatcaatcacgactgtaacatgtatacactgaaatggaaacgtgaactggaatacgacgcaggagtgaagccatctttatactaatttctcggacctgtcccaggcgacaccagactgactttgtaacttcactttgccagagttaaaaaatgcaacctatgtggactcaagagaggacaatgagctgccagggcttatacccgccttcatcaaagaagtacacgcaaggaggcctgtcctggggctgctctaagggtctccttcccatgactcctgagtgtggcccacaagtcaccaggtggcagggtggtgacaggagccactgacagccagtgtgactgtggatggccactctggagaccgcagtccccacatactgagagaggagggacatttttttgatgggaggtaggaaaagttgcggctgaaggatgaggttttccattatgtctgtggctggccctgcaaggtgctgttggctcagggtgcccctgcctgaggctacggctccccatgcacaagggctgccctgggagcatgaactgggctgcctctgaaacccaggaaggggccctcacccaggtgactgcgcacctgctccctgtgtggctccgggactgcaagagaaagtcaagatggcctctcctagaagtgcgtggcaactgaagctgagagaggctgagcagggaggcctgaagagctggagcacgacgggacagccagcacattcacagcgctcagcacggcagtccacggggagcacggagtggcagcggcggcctctgctcacaagctgggcacgtgcctcaagcacatctccaacgtctgctgttgcttttttgtactgggattactgagtcactcttaattcatcaaacatttattaagcacttcctgtttactacacactgatgggtgcagggacgatgtgtgactattttggccgagatcgtgacctgtgtggagcccattacctgaagaggggccaagaggacaagcaggtatgactatggtcaggcgtgccaagtcccaggacaaggaaggacgggtgctccaggaagcacaggagggggcatcttgagaagcctcaggaaggaaggggctgtggctcgaacgtgtcccctccaaagttcaggcgttgtggagtgagagtcttaaggaagcagggctttaagaggtgacgaggccaggagggctcctcccctgcgatgggatcaggcgcctgcataaaggggcttgctgtaaggggctctctcgcttgccctccagtttccttctcccttccagaagatgcagccctccccagacacctgaacctgctggtgccttgatcttggacttcccagcctcctgaagcatgaggacagaaatttccgtgctgtatagattacccagcctatgctgttctgttattgcttcacaagcagatggagacggacggatcagcaccctccacacggagaactgaaagacggggcgaggtcagcccggcaatagcaaaccaggccaggggcgggggtggctgacaccaggcaggggggttactagaacaggtcatgaaaggccctctacagaggtggcctgcagcaggcatagctaaaggatggcttggagctcagtgtggctggagcagagaacgtgtggagggaatggccagggctgagccacagcacctgtgcagggcactgtgtgggccatcctgggaagcctccattctggggccacgggcagcaggggggcgggaggagaaagaagagccacataggaggcatgaggcgtaggacaagccagggagccggtggaaatgccagccacagcgggtgggaagttgggaggcacgggagtcaggaaataacagtggaaacgggaaacctactccccacaaactgctggcgagaggcaaggctcccattacaagcaaccaagcgtgatgggcgagggcctggctgctggagggggcctcggagtcgggtccaggtccgccccctaatcccgtgatctaagtgagctgcttcatctctgcctctcagtttcctcatctctaaggggagggcaggagcagagctagtgagctgcttcatcgctgcctctcagtttcctcatctctaaggggaggacaggagcagggctagtgagctgtttcatcgctgcctctcagtttcctcatctctaaggggaggacaggagcagggctagtgagctgcttcatcgctgcctctcagtttcctcatctctaaggcgagggcaggaggagggcttaccacacagctcgcatgtgaggcttaaatgatcaacacgcacgcagcaagcactcgacattagctgtgattatcgacgcagtgtttgatctgcgtatcactggaatctttttcatgcaccttctacatacaaaagcatttgcaaaactgttaaatcaataattgctcctgatttgtttctgacttgagtttttctttaggaagcgctgaatgaccaacccatagtgataacatgatcctactagctttacgaaggtcaaacacacctccgtgtccacaacgagcaaaatcgggaagtaaattatctttttatttatgcttcaatatggaaagctaaatttaaagtgaaaccttttgtcagaaccagaagggttatcaccctgacaggtaaggcagagcccagctgcctaatcacaaacgcctgagaaatacatcaggacaggttactgagttcaagcccagcgaaagtcttaagtcaggagactctgcaggcgacatgatttaatgaataaccacacacatggaccctggggtccaagttcattagaatggctcttttgcagcagaaggtccaaaaaaaaaaaaaagacagctaaatgatttaagtgtagtgtaaacaggagaataattaatatgatttcttatattctttcctggttatccattgattttaaacctcaacaacagcgatgtcttttatcagcttaattttacaaaggctacagagaggggtgggcatttcctaatgggctcctgtctgacgggggaatttgtctatggctgtgtgcgtggaggttaacgcagttaacgttcttaagtattcttaagtatagtgtcacttctttgaaaactaaaactgcactttgcacatagtggtgatcaggtttggtgacccaagtataggaagagtgactgacaaagcccattttggaaaagagtgatgggcgaggcccatttctggcctcatttgtcccagtctctttctgtgggattcttgccttggactgagataccctcagccaccaagaatcaaggacctgactgccaactcaacagaaagagaacaacagcgaggcacggggatcacagctgtgaccccggcactctcggaggccgcggcaggaggatcacttgagcccaggagtttgagaccagcctggacaacatagcgagatcccatctctataaaaaatttaaaaatcagctgggtgtggtggcacctgtggtcccagctacccaggaggctaagatgggaggatcacttgagcccgggaggttgaggctgcagtgagctgtgagtgcgccgttgcactccagcctgggcaagagagtgagaccctgtctcaaaaaaaaaaagaaaaagaaaaacaagccaggcgtggcggcacacgcctgtaaatcccagctacttgggaggctgaggcaggagaatcgcttaaacttgagaggcggaggttgcagtgagctgagatcgtgccattgcacttcagcctgggcaacaagagtgaaactccgtctcaaaaaagaaaaaaaaattaaaagaaaaagaagaaaagaaaaacaagaaagagaagaataatcaggaaggaaagaatgttttaagacatgactttgggagccagccacatagcataacaaatgcctagaagcttacgtcacttatgacttaaaacaataaacagaaaagaggcaatcagcttgggctggttcagaaacattccaaaaacgtctttcactttgcattgcattcttcctcacgactaggtcggaaacgaccaagcggcatgagagttatttaaactaaactgtaatcagccaataagaaaaataaagataaaaatactcttaatctaccaaatagccaaagcctatggagtcatagatatattttataattatctattctttctgcgtaagaagaacaaaagttttggtacaaaagagagaatatctttcatatgttaacattaaaatgctctccggagggttgtaagtccttcctactcatatgcaccataaataatcataagaactgatttgttcttgttgtcccaatatttgatgataaatctcaagttcctactacaaatggctgctggtgaaacttaacctcttcttaacaaatgaagtcccaggtcaggcgcggtagctcactcctgtaatcccagcacttagggaggccgagacgggagcatcagttgtgctcaggagtttgagaccagcctggccaacatggcgaaatcccgtctctactaaaaatacaaaaattaactgggcgtggtggcacatgcctgtaatcccagctactcaggaggttgaggcaggagaattgcttgaacccaggaggcggaggttgcagtcagccgagatcgcaccattgcactccagcctgggtgacagagtgagactttgtctcaaaaaagaaaaaaaaaaaaaaagaagtcccaaataataaaatatgagatggatttatggaagaaagtgaaagaaacaaagggtaggcaccttgcctgtttaatttgatcttctgcttaaccaaaaaaaaatttttttgtttttttttgagacagagtcttgctctgttgcccaggctggagcgtagtggcgcgatctcagctcactgcaacctccgcctcccgggttcaaggaatactcctgcctcagcctcctgagtagctggaattacaggtgtgtgccaccatgcctggctaatttttgtgtttttagcagagagggggttttgccatgctggacaggctggtctcgaactcctgacctcaaatgatccgcctgcctctgtctcccaaagtgctgggattaaaggcgtgagccaccacacccagccagaaaataaaattttagagcatgtgcacgcattctctctctctctccctcccgcttccccacccctgcttctaaacaggtaccttctatacccagcttccctctctctcccagtaatggctaaacagctgccatcacagccaaatgggaatgacaggcatcccctgagtgaccacattcccctgttttggccttttttttttttttttttttgagacagagtctcgctgtgtggcccaggctggagtacagtggctccctcagctcactgcaagctctgcctcccgggttcacgccattctcctgcctcagcctcccgagcagctgggactacaggcacccaccactatgcctggctaattttttttgtatttttagtagagatggggtttcaccgtgttagccaggatggtctcgatctcctgacctcatgatccgcccacctcagcctcccaaagtgctgggattacaggcgtgagcgaccgtgcctggcttggcttcttatcttctgtattccgagttaataaatgccccactgctaaatgctacattccagaatgctaacatagggagagtccaggagtccacacacttcagagaccttcgcctcccacctctaagaaacctcttgaattagggtttactagcacgagccttcacaaagactgtagaaatgagtctctgagagacgacacccagcacacccagcacacccagcacaccagcgaacagcccaccaggtgctatcgctgtcattcatttgctcattcgctcgttcatgcacccagcagactaaatgtttactgagtacttaccgaaggttaggatctgggctaagggttgaaagaaataaataggttaaaaaagaaaaaaagccacctaggtgactttcactccaatgcttgacctcagttcccttgtctagataatggaaatgctggccggcgcggtgactcacgcctataatcccaggactttgagaggccgaggtgggcagatcacttgaggtcgggagttcaagaccagcttggccaacatggcaaaaccctgtctctactaaaactacaaaaattagccagctgtggtggcaggtgcctgtaagtcccagctactcgggaggctaaggcaggaaaatctctcgaacccgggaggcagaggttgcagatagccgagatcacgccactgcactctagcctgggtgacagaatgagaccctgtctcaaaaaaataaaagaaaaagaaaacgaaaatgctgtgatatgatggtcatatcatagcacagggctgttgtgaggattaaatgagttgattcaggtaaacagggacatccgaaaaagggaaagacggtgcttgtcctgagaacagctgtgaatgtgaggacagtcagtgagtgacgatctggacccacaagaagagagtcatatgcattcaagtccaagtgtctatgggctgttcagaagcaacaaatggcacttcaacaatgagttgcagacaacaaaatggaaatgaaggtctgcaataactattaagaatcctgtaacagagcagagtttaaataatgggaagaggctatgaaacaagagagctggggaaagataccagaactgaaacagaccaccagctgatcaccttttatttgtgaaatgacagcaccaaatgcaccagatgccacagacgggagggagggggataggtcacgtcggcagagggagggggtcaggtcacacctgcagcagggacgggggtcccagaccgtgttcttgtccctagagagctaacagctcatccgtaggtttctaagaggtgctgattcaagcacacagtgtagatgatgaaaaatagattatagaaagaagagaaaggaaaaactaaatttaaaatctgagactaggtagccactaaatacttgaaaacaaaaaaagggaatacactgaaaatggaaataaagctgtatgatgtttagttaaagaagccagtcccaaaaggccacgaactaggtgatcccctttatatgaaatgtctggcatagggagatctgtagacacagaaagcagatgagtggctgccatgggtttaggagagagagggtgtaactgctaacggatgcagggttactttttggggtgacgaaaatgtaaaattaggttgtggtgatggttgcacaacaccatgaatatactaaaaaccaccaaatcatacacttgagagggtgaattgcatcatatgtgaattatacgtcaataaagctgtttttttgaaaaagaaaaggaagctgggtgtggtggtgcatttctgtgatctcagctacttgggaggctgaggcaggaggactgcttgagcccaggaaatgaaggctgcagtgagctatgactgtgtcactatgctccagcctaggtgatagggtgagaccctgtctcaaatataataataatattaataatacaataaaataaactaaatacagtaatgtgaacatcaacaaggtgcaataattctgagatttagagaagaaataaaataaagctgggaagaaatacaccctccctgagaatacaaggtagagtgagcagtagcaggtaaatgaaaaatattaaaggcttagaaatagataatgtgggccaggcatggtggctcacacctgtaatcccagcactttgggaggccgaggcggggggttgcttgaggtcaggagttcaagaccagcctgaccaacatggtaaaaccctgtctctactgaaaatacgaaaattagccaggcgtggtgatgcacgcctgtaatcccagctacttgggaggctgaggcaggaggatcacttgaacccaggaggcagaggttgcagtgagccaagatcgcaccattgcactccagcctgggcagcagagtgaaactccttctcaaaaaaaaaaaaaaaaagataatgtggtagagctagggcagaaaaacatgcaagtcaagaataaggccaaataaccttgaagaactaaaaattcaacatagcaaaagttcagaagtctgggagagattaaataaaacaaaacaaaagaaaatttgaccttcatgaaatagctccaagaatcatccaatttgcagctctcactattgtagtccaacctaaaaacgccgggccgacacccacattgtcttcttcgagcacaaacacacttctcctgcagcaggtgtagcccgcacagcatggtgagcccagccacacccgcacgccagacgcttggccacagaaacgcagaagcggccactgtccttgcctggaacacagatgggccttttcatccaggaggagatttacttgcaaaggcattttcttctgacccacaggtggttatacctgcactgacacctcctgtgggcatcttcagctggaagaaaggccaccgaggctgcggagccacctcgcctgtaaacatcatatcatgcaaaggaaaagctctaagttgcggaatattcttctctttttttttttttttttgagatggagtctcgctctgttgcccaggcaggagtgcagtggcatgatctcggctcactgcaacctctgcctcccgggttcaagcaattctcttccacagcctcctgagtagctgggattacaggcacctgccaccatgcccggctaatttttgtgtttttagtacagttggggtttcaccatgttggccaggctggtcttgaactcctgacctcaagtgatccacccgcctcggcctcccaaagtgctggaattacaggcgtgagccaccgcgcccggctgatgctgaacatgcgtgactaaccttccgcgggagcagtcatgccgctgccttcaccacctgttgcttctgggaaatgtggatccaggctgctggctctctcccagatcgtatctgcagcacaggcacatgcttgctgtgaatttccacacttgtcagatcacccggttttcaacttgttttctagttttctctcttttgaagagtattttgcacactggctggggcagaggctgacagtttcccagactgtgttttcttgtttacagagcacatgcagacttgttcgagtcatctaacggagaaacccaaaaacctccattttctcctgagatatctctgctatctctaatttcacttcagcagcactggtggctgaaatactatggactatgtatttcggacttcctttttctgaacttttctggaagaatcgcagttgtgtgtgtgtgtgtgtgttttgttttgttttgtttttttaagagaaaaggtctttctctgtcacccaggctgcagtgcagtggcatgatcacggctcactgcagcctcgacgtcctgggctcaagtgatcctcccacctcatcttcccaagtagctgggatgacaggtgtgcaccaccaagcccaccttcttttaaaaaaaaatttttttttaaagatggaatctcactatgttgcccaggctgggcttgaactcctggcctgaagtgatcctccggcctcagcctgccaaagtgctggaattacaggcatgaaccaccatgcccagactcaggtatttattaataacctcaaggtgttgctgcacattccataagttgagagcaggtccactctgccacccagggatgtcccaggctgggcgatttgttctcccactgcacaccatgcaactgtcatttatgccttaagaaaatcccattgaagttgtggactcaatgcacaatcaaaactgaaagcaaaaccgaggcagtgagtagtgagtgcccaagcacgagaggaggggacaaaggctgggtccccggccatcaacaaacggagagctagctcataaaacagtgacctggagcttcagtcagcagccctcactcccaaaaggggtgaggagtcttcagaaactcccctgtcttatggcagaaagctgagctctgcacagaccctggaaaaaccactgttgtcaaaggagagatggaagtgggcagaaagcccaggaaggagggttccagactagtggaggtactagcctcaaacaagacagctgagtacttagagaagaagagatacatgccaggcatggtagctcatgcctataatcccagcactttgggaggccaaggtggaaggatcacgtgaggtcaagagtttgagaccagcctggccaacatggtgaaaccctgtctccactaaaaatacaaaaattaaccgggcgtggtggcgggagcctgtaatcccagctactcgggaggctgaggcataagaatcacttgaacccagtgggtgaaggctgcagtgagctgagatcgcgccactgcactccagcctgggcaacacagcagactccatctcaaaaaaagaaaaagaaaaagaaaaagaactttctatgaacttcccgtgatgatgggtacatcctgtagccgtccagttctgtggcctccaggcacatgtggctactgaccactcgaaatgtagctagtatgaacaaggaattaattttttaatgatttcaattataatttaaattttaaacagctacatgaggctggcagctatgtaggaagcagtgaagatccacatccttccttattggtgaaaggaatgaattggaaacagaaagttcttttttacctttattaaataaacgtgaagtcataagaactactaaaagaaaatgggtgggataaaagtaaaactaaatatgaaaccagtaagtattcactgttatttattatagatgacatttagacgcaaatacgagagggagagtaccctgtatattaatagcagggatagccaattacaaagtggaataagccaggcgtggtggctcacgtctgtaatcccagcactttgagaggctgaggcgggtggatcacttgaggccaggagttcgagaccagcctggccaacaaggtgaaaacccctctctactaaaaaatatacaaaaaattagctgggcttggtggcacacgtctgtagtcccagctgcttgggaggctgaggcaggagaatggcgtgaacccaggaggcggagcttgcagtgagctaagatcgcgccactgcactccagcctgggcgacagagcgagactccgtctcaaaaaaaaaaaaagaaagtggaatagaaacagttactctatcgaacaaaatagcagataatgttttagaataaagaaacaaaagagctggaaacatttgaacgttttcaaaaaaaaccctataagtgggatgagatactggttcacaactctaatttagagcctatataaacacattagcttgaccttgcttgacatacattatttctaaaaaatgttttaaatgtgaatatttagaagatacaccatattttctgctttttatatactataaattttactatgtgagtttaaaaagtggttggtaaaacacacacccaagctctctgatctttcacacccattaaaagcagcacatgtattaaacacactgctgcacaatgggcgtgccatgggtgctctccaaccgcattgggcttgaatgtttaactaggcctgaagccacagtgctaacaagatctggcagagacagacaaggccacgccggcagcaggtgtttcaggaaaggtattactccaccatcccttgcgctgaagccttagcctcaggcaaattcatgaaccaggtagaatctaattcaggtcactttggccaatctccactttctaccagcctcctccaggtccctactgcctcgggaggccccctacccacctgccaacctatcccctcaccatctaccggcaccaagtctgtgtgagcacactgtagatacacgagctccgtcccaactcagagctaggagagtatcagaggccaaacgcctgccccctgcttctgggctccaccagcagcctgggaggccaccccctgcagctgactcatctgcatactgagacttcctgacacaaatggaggtgacaatattcgttcccccatcatatcccagaaattcccttattgccgacatccattctgggtttttactgcgcttcacacgaggacaattccaggctgaagtggcaggtcccagcaccagactccacttcatcagaacacttctgttagagtctttgaaacgcatgaaatcccctttagggtccataataacgccttctggaaactcgacggcaagccactcaccctcagccctatcagaccccatggctccttacatttctgtgacatacttaatttgcaatgtcctcttttccatcatgaaataaaattaaattcatggacaacataacctttaatcactgagaccataaaggacacctccagcagctgactagccttccctcagccacctttgtgcccagcctaagggcagggtggcaccggagcctccatgcttcaaaggtggccaccagggcccatccccctttccatgcttctccctgcccagagagaaacagcctgaggacaggttaaagactaaatacaaccaggcatggtggctcatgcttgtaatcccagcaatttgggaggccgaggtgggaggatcacttgaggtcatgagtttgagaccagcctggccaacatggtgaaaccccatctctactaaaaacacaaaaattagccaggcctggtggcccatgctgtaatcacagttcctcaggaggctgaggcatgagaatggcgtgaacccgggaagcggagcttgcagtgagccgagattgcaccactgcactccagcctgggcaccagagcgagactccgtctcaaaaaaaaaaaaaaaaaaaaaaaagactaagactatgccacaattccgcatatgcatgtatttattatatacatatatgtataaggtacatatttgtatgtgtatatccgtgcatatgtgtatacctgcagcaattttttttaaaaggagaaaataggccagagccagtggctcatgcttgtaatccccgcaatttgggaggctgaagcagaaggattgcttgaacccaggaattcaaagcctcagtgagctgtgactgcaccattgcactccagcctgggtatcagagtaagaccctgtctctaaaatataaattaataaataaaaattaaacggagaaaatttcttaacaacttttatcctattcattctttcaacacataataagctcctgaaatccgttaagaatgagattagacctattctaaatcctactaacaccttacattgactctgtcttattaatctcagtactgtagtacctgggggaaggcgcagcaccgtggacactcagaaacgtcaagaatcaaatcacatctctacaacggtggtccatctgcaaacagcgtggagatcaaggaagggcagaacaaagtactgaaagtgctgtcatttctctggagggtgaattacacagaccaactttcttcacataataagaaacaagaagttgtttgtttatgggttctatgggagcacccgctgcaggccacgctagacgctggtgataaaactgtgaacatggcgtccatcacctgactcagtggtaggaaccagtggcagggagaatccacaagcaaggacccgagtcaccagctgtgattaagagccaggaagaaagcaaaagcttcctgcaatagagaatacccaacatgcggtttggacagagtcagggacgtcctttctgaagaaatgagactgaagtggagatatcacagtgagatggaggcaattgcggtggtgtaggtctggggaaggcacgagggatgcagggatcagcatggaaaggacggtcccagcatgctcacgtggctgaaaggtggcaactgttcccgatgcagactgagggaagaaagtgtggcatgagaggaggctggggaggtgggccaggccctgggagccattaagaggtttctgcctggccaggtgcagtgattcacacctgtaatcccagcactttgggaggccgaggtaggcggatcacttgaggtaaggagttcgagaccatcctggctagcatgatgaaaccccgtgtctactaaaaatacaaaaattagccaggcggggtacatgcctgtgatcccagctacttgggaggctgaggcacgagcatcgcttgaacccaggaggtggaggctgcagtgggccgagattacgccactgcactccagcctgggggacggtaggagactctgtctcaaaacgacaagaggcatctgacttacatgctaggcacacacaagagctctgcagtgttttaagtaagacagcacacagttcgattctttcttattttgcattttaattttttaactttttttttttctcttgagactgagtcttgctctgttgcccaggctggagtgcaatgacacaatctcggctcactgcaacctccgcctcctgggttcgagtgattctcctgcctcagcctcctgagtagctgggattacaggcaccaaccaccatgcctggctaatttttgtatttttagtagagacggggtttcaccatgttggtcaggctcgtctcaaagtcctgacctcatgatccggccacctcagcctcccaaagtgccgggattataggcataagccactgcacccatccaattttttaaaactttttaattcaaactaatgttaatcatataggaaagttacatatacggtacagggagttctcatatatccctcgctccacttctcctaacgtgaatgtcttattgtacgacgtcaagcacagcttgataatcaagaacaggaaattaactagacgatgaacttgatttgagtttcaccaatttttcacctgatttatgttccaggatcccatccaggatcccacgcggctggctggctctttttaaagcctacacagctctgggtggcgaatggctccggaggtgtcaggagtagaagcgggggctcactcctggccttttgctgtggtccaggcaaaagctggagtggccttaggtcaggttcatgatttaaggtctaggcagaaccgacaggatgtgaacaaagggaacaaggacacttcctgggttcctgggttctgccttcagtacgtggacggatgagtgagaccagaagaagtaaaagtttagggggcaaaatcaggagctcagttctggacctcccaagctgaagatgctggtgacacgctcaagcgatagggacaaggaggtggccataccatgaaatcagaagggagctcagggccagagatccactgtccataatatcaccagggagaagacagcaggtggggaggcctgggaagcagccttggagctgcaatgttttgaacggccagggaagtgggccagcagggctctgaggagggacaaaggggtagggaggggggctgggtgtgatggctaaagcctgtaatcccagcactttgagaggccgaggcgggtggatcacctgagctcaggagtttgagaccagcctggctaacatggtgaaacccccgtctctattaaaaaatatatatatacaaaaattagccaggcatggtggtgtatgactgtaatcccagctactcaggaggctgaggcaggagaattgccttgaacccgggaggtggaggttgcagtgagcggacattggtgccactgcactccagccagggcaacagagcaagactctgtctccaaaaaaaaaaaaaaagaagtggatcactgtgaacgctgcagagagaagatgaggccactagcaaagccagcctgggtttggccactggccacgcaaagactgtcagtgaccacaccagggagaggtgcgtttgggcggcgaagagcacaggccaggctggcaggttggtgtgcgagtgtgtgcaaggtggagaaggcacacgcggtcagtcctttggagaagtctggcacgaggcctgccgaggaaatggcccgggggtgtggcagggcggaggtcctgtgccatgtcctgcactgaccagggcagcccacgggaaggcagctgcagagaaggcagaacccgcagctccagaaggtttggggcatgaccagcagaggccaacttctattgtgaagaagaaaccgactcccagactttcagggaagggggtgtgtttggtctggtggcagtggggacagcaaagtaggacccttgggtgtggctacgattgagaggatgtcaggtagtgtgagattcaggctggtgtagaatcactcatgagaaagtatctaaaatcttccagatgacagtgctaccagctggacagctgacagtgggcgctggctctttcaaaacagtgctccaaaggcaaagaaatagcaaagacagaagtaaggcacttaactatttgttgggtgaatatagaaatgaatgaatgaatggatggatgagcagatacatcaagaagttaattcacaaattaaagcccattatgaaactaaagtagaggctgggcgcggtggatcacgcctataatcccagcactttgggaggtcaaggcaggtggatcacctgaggtcaggagtctgagaccagcgtaggcaacatggtgaaaccctgtctctactaaaaatacaaaaattagctgggcatggtggcgtcacctgtagtcccagctactcgggaggctgagacaggagaactacttgaacccgggaggcggacattgcagtgagctgagatcacgccattgcactccagcctgagccaacaacagcaagactccgtctcaaaaaaaaaaaaaaaaaaaaagttaatcctgcaatgaccatacacccagaaaccccaatcatggatatttaccctagagaaatcaaaccttatgtttacaaaaaacgctgtacgcaaatgtttgtagcggcactattcataattgccaaaacctggaaaccaacctaatgtccttcccaggatgaatggataaacacactgtggtccctccccacaatggggcactactcagcatcacaaggaatgaactagagacccatgcagcatccaggacgaatctcaatagctctagactaagtggaagaaaccagtcttcaaagggtacatgctgtgtggttccattttaatgacaggctcccaaaggcaaaactacagggaatggatagttgttgctgggtcggcaggggcctggaggcagggaacttaaggccgattcaccctgactttttagaactgaatcaaaaggaaaaccatacccaggtaacaaaaggatcagaggctactactccctttgcacctcgtggcagatgaaaaatggaaagtacctctgattggttccctcccgcaaccaaccagactggtcccaggccaggtcttcaggtgtaacgttgcaacttcacttcaacctctgattggtcgcctcctgcaaccaatcagactggtcacaggccactccttcacttacatagggtgtaaccaagtaaccaatggtaaacctctacagggtattaaggctccagaaaattctctaatcagccacttgctcctgctcgagcctgctcccactccgtggagtgtactttcatttcagtaaatctgtgcttcccttgcttcgttttctcgttgctttctttgtgcattttgtccaattctttgttcaaaatgccaagaatctggttaagaacccagacaacttgtagtcaagaccctccactggtaacacccataaagggtgtattagtctgttttcacactgttcataaagactttataattatccgagactgggtaattacgaaggaaaggtttaactggcttgcagttccccatggctagggaggcctcacaatcatggcagagggcaaggaggagcaagtcacgtcttccatgacggcagggaagagagagagtgtgtgcaggggaactcctctttataaaaccatcagatcaactggacgtggtggctcacgcctgtaatcccagcactgtgggaggccgaggtgggcatatcacctgagctcaagagttcgagaccagcctggccaacatggtgaaaccccatctctactagtaaaacaaaaattagctgggtgtggtggtccatgcctgtaatcccagctacttgggaggctgaggcaggagaatcgcttgaacccaggaggcagaggttgtggtgagccaagatcatgccattgcactccagcctgggtgacaagagcaaaattccgtttcaaaaaaaaaaaaaagaaaaaaaacccatcagatctcgtgagacttattcactatcacgagaacagcatgggaatgacctgcccccacgattcaattacctcccactgggtccctcccacaacatgtgggaattgtgggagtcacaattcaagatgagatttgggtggggacacagccaaatcatattaaaaggtcaacccttgggaaagatttttggggggtgattaaactgttctgtatcctgattgtactggtggctacaaaacctatacatgtgttatgatccttagaaccgtatagcaagagaaaaaagtcagttcacaaatgataattagcaaaataaaattatacgttaccatacaatcttgcaattccaatccaagcctctactcacgagaaatggaaacaactaagacttgcaagcgatgttcagagcagctctgtttattacagccaagacgtgggaataatccacgtgtccagcagctggtgaatggatggacacactgtgatatatccacaccaccgaatttaactcacgaaaaaggacctaaatacttgatctgtgctacaatacagaagaacctcaaaaacaataagctaattgagaagtcagctacaaaagactacaatagtgcatgattccaattatatgaaatgtctagaaaaagcaaatctatagacacagaaagtagatttgtggtttgggactggaagcaggtattgcctgaaaccagatatgatggacctcatgggatgatggaaatgttctaaaaccagatgataccctaaattttctaaaaataaaattgtatacttttcacagctgagcttcatagtgtgcaaatgataccttagtaaaactgtctttaataaaaagtgctcaattcgttatctattttctttttttcttttttttttctttgagatggagtcttgctctgtcacccaagctagagtgcagtggcgcgatctcggctcactgcaacctctgcctcccgggttcaagcaattctcctgcctcagtctcttgagtagctaggactacaggcacctgccactgcacgcggctaattttcgtatttttagtagagacggggtttcaccatcttggtcaggctggtctcgaactcctcacctcgtgatccaccctcctcggcctcccaaagtgctgggattacagacgtgagccactgcgcccggcctagctatatattttttaaagtaaaacttgatccctacctcatagtgtacacaaaaaatatcagttcacatttcacgtggattatagacataaatctgaaaagtgaaacaatagagtatctaggaaataatattatagtttcatgacctcagaagtagagaaataggacaaaaaaagtcctcacctaacaaagaaaaaaagtggatcaattttatggtaggctgaaccatatgccaattgccaatatttgaccatttcgatctacaaaaatggcaatttcgtagtaaaaaggcaaaactagagtgggagaaggtatttgcctcacatataactgacaaagggctggtagcctgaatataaagaactcctcaaaatcagtaagaggccaggcccgggggctcacacatgtaatctcagcactttaggaggccaaggttggtggaccacccgaggtcgggagttgaagagcagcctggccaacatggtgaaaccccatctctactaaaaatacaaaaattagctgggtgaggtggcacgtgcctgtaatcccagctactggggagactgaggcaaaagaatgttgaacccgggaggtggaggttgcaatgagccgagattgtgccactgcactccagcctgggcgacagagtgagactctgtctcaagacaatacaaaacaaaacaaaacaagcccaacaataagaaaacaaaaccagaccactcagtagaaaaatgtgtaagaaagctgaacaggcacttcactgaagagccaacccaggtggccagcagacatatgaaaagacactcagccagggaactgcaaatcaaatacagaatcacaaatgaaaattaccaaaagaaactgcacccacccaccagagtggctgcaattcaacagagtgacaagcgctggtgaggatgcagagccacccacaggaaccctcatactctgctgacgggtatgaggtgataacaatgttatcaccatttgttatcaccatttgtaaaacaagtcggtattaccgatggaagttgaagacactcacactctatggctcaataattccccttctagacattgatttcggccaaagaaatgcatgcaagtgtgcaccaggatacagtacgtaagtattcacagggattattgtaaaagtcaaagcccagaaacaacccatgtatccatcaagaggaggatcgatggatacgttgtgatatgaccgagaaggcacaacagcagtgacgatgaaggaaccccagcgtaagcaacaggcaacaggaatgaagctcacaaactttacactgagtgacagaggcagccacaaaagaatatatactgaccaggggcagtggctcaagtccgtaatcccagcactttgggaggcctaggcgggtggattacctgaggtcaggagtttgagaccaacctggccaacatggtgaaaccccgtctctactaaaaatacaaaaaatcagccaggcatggtggtgggtgcctgtagtcccagctcctcaggaagctgaggcaggagaatcacttgaacctgggaggtggaggttgcagtgagtcgaggtcatggcatcgcgctccagcctgggcaacaacagcaaaactcggtctcaaaaaaaaaaaaagaatacacactgcaggttccatttgtacgaaattcaaacacaggcaaacgcaatttatggtgccagaagtcaggacatggttacctttagaaggaggaagtgggtagcgttgggagggacacgagggaggcttctgggatattctgtttcatctgggtgctggtttagtggatgtgttccttttgtgataattcttcaaactgtacacttatgcattttatgtatgcatattacacttcaatgcaaaatttattttaagaaacaggaaaccaaactcttcaaaaatgccaatagcagtaaagaaaaaaaaatgtgcggaactgttctagatctagatcttgagtgtcctcttttaggaaaagatcatccctgattggatcctggatgaacaccataaaagctctaaaggatactgttagatgctggggaaatttgaacatgaactatatattttataagagtattctgtcaatgttatatttcttgagtaggataatttgttttgtctgtacaggagaatgtccttgttcataggagatacatgctgaagaatttaagggtgcagggccacaatgtctgcaatttagtcagttaacggttcaatggctcagcaaagaaaaaagaggacaaatatagatacacacacatacacatatgcacatacatatgtgtgtactgtattatatcccattcagggttcttgcacaaatgtgtgtataattatattcacacatacatatatacacacctacactgagacagccaaagaaatttggcaaaatgttaaccacgggtcaatcaggtgaagtgggatattagtgttcattatactattatttcaacttttctgtaggtttgaaatttatcaaaatgaaaagttgcgaaggccaggcacagtagctcacacctggaatcgcagcactttgggaggccgaggcgggtggattgtttgagcccaggagtttgagaccagcctgggtaacatggcgaaaccactggctaatacaaaaattaatcaggcatggtggtgcacacctgtagttccagttcctcagggggcagaggtgagaggatcatctgagcctgggaggtcgaggcagaggtgagccatcatcgtgccactacactccagcctgagtgacagactgagaccctgtctcaataaataaataaaattaattaattaaaattaaattaaaagttggagaaaaaagcaaaagcaagccaaaaaacagacaagccaaacacccgacgccaagtgttgaaggactcacagttggataagaaaaccaaaaagtccgggcgcagtggctcacacctccccagcactttgggaggccgagccgggcagatcacagggtcaggagttcgagaccagcctggccaacatggtgaaaccccatctctactaaaaatacaaaaattagccaggcatggtggcccgtgcctgtaatcccagctactcgggaggctgaggcaatagaattgcttgaacccagcaggtggaggttgtggtgagcagagatggcaccactgcactccagcctgggcaacagagcaagactccatctcaaaaaaaaaaagaaagaacgaaagaaagaaaaccaagaagagcagagacgggaccaccaggaatggcaagatctggccccctgcggcaggtggagggcaggacggctgctgggtggctggctgtgctctcctgcaacctgcctggtagatatgcaaaggcggtcaccttataacaatcagattgtacatttattttacgtggtcttccatctatatcacacaatttttttttttttttgagatggagttttgctcttgttgcccaggctggagtgcaatggtgagatctcggctcactgcaacctctgcctccctggttcaagagattctcgtgcctcagcctcccatgtagctgggattacaggtgcccaccaccatgcccggctaattttttgtatttttagtacaggtgaggtttcaccatgttggccaggctggtcttgaactcctgacctcaagtgatccacctgccttggcttcccaaagtgctcggattacaggcatgagccaccgtgcccagcctgtatcatatacttttttaaaaagagactttacagaaaaacagactgagcaaacagagctgcatgccggtgcatgagcaacaagttataatcgcacgctggaggaagaaagaggaagccgtcggccacacagctccgctctgccaaggctctgctgccgtccctcacccgccccaccacgtggcaacccaatcacaacaatgccgccgtcccccagctgctaaatgctctcaccatttggttgctgtgcaaacacacctaacttagacttcagactgatgtcctggaggtgctacaagatggccattctttatgagtaaggctgccttccagggtaaaaattatgattttcccataaatcacatataagcacttagcaaaaaatatttaaaactctcataagttttggtcctaaattcttttctcttgctgttactacaaaaatgacagagacaaaaaatttattatttataacggcttggaatctaattccaaatgagttgcttccgtagattcacgtaatactgcagaactaaatatgcaagattcccgattccaaatggaggccaaattccatccacacaggagacagaggaaccctcagcagtctctccttgaagtaattttttttttttttttttttgagacggagtcttgctctgtcgccaggccagagtgcagtggtgtaatcttggctcactgcaacttccaccaccgaggttcaagcgactcccctgcctcagcctcctgagtagctgggactacagacgctaattttttatgatttagtagagatagggtttcaccatggtggccaggatggtctcaatctcctgaccttgtgatccacccgcctcggcctcccaaagtgctgggattacaggcatgagccttgacaagctgacaacagttatctatgttcttcgtcagttcatggactcgacaccaaaatgcctgggttcagatcccaattcctgtgaaggcttaagcaattacttaacctctttgtgcctcagtttctgagtctgacagattatggcaacatcagtgactttacagggttttgaggattaaatgagtaaatactctaaagggctcagatctgtgcctggcacatattagcaccgatgctggcctgttcaaaaattctattattatttgctcaacaattgcctgaaaacatagaaaaactgtctgccacatacgcagatgaggggaacaacgaaagatttggtgggtttcagaagaggtacaggcctgatggctgccgtgcgccaacaaggtgagcctgcagatcagagaccacgtgcatgagccacagtgcatgtggctgctgtgtcccctctgccttctcggtcttacacaaatggtctcttgtggctcaagttacatacagagctccaacttagccaaggtgacgcaaaacgaactcactacacgtaccccttgtcaacttggtgtccatatctactcctcttttcaaccgtacttaacttccaaatcaagtaaatagcaactaggcttccatgccatataatgctactatccgtcttacaaccaaaaccatgctaaccctctccccagaagaggagccaaagtccttttatgaactttttttgagacaaggtctcactctgtcacccaggctggagtgcactggtacgatttcggctcactgcaacctccgcctcccaggttcaagagtttctcctgcctcagcctcctgagtagctgggattacaggcacctgccaccaggcccagctaatttttgtattattagtaggggtttattagatggggtttcaccatattggccaggctggtgtcaaactcctgacctcaagtgatctgcctacctcagcctcccaaagcgctgggattacaggcatgagccactgcacctggcccaaagtccttttacattctatctgagtggttatccgttggcaccccatggaatgaagaaggagactgaagtgataacataaggctggtagctgacagacccctgaagtgtaactatgaaggcgggctgtggaccttgccggctggaagcaagacccttctggtcatctttactaccaggtagagaaggagaagacactcaccgcataccaggtaccaggaaatgtgttgatttgttccagcaacaaaaacacatctggcacagcagctgtaactgcagtcaccgcctagtttaagtttatgacaacctgctgtcattctctaagatccatccgtcttctagacaagccaaatatggattaaacggagatgtgacacgatcaccacccttgcatctttcaagtccctgatggtggcactaatctctgccatcctcccaggaatgtgataattgctttgggttgactattttggtagacagaggcagttctggcagcttccacttggcctttgctaccacaacagccctcactccagggaaccagtgtcagaattctgccaggtgctaagtagatatatatttacttatgcattgcagaactgcagaaagaaccacaggacagctattatatcttaataattacttaatatataatacacaatgatatgtgggtattaaatattatgagtcattactctgaaatggattaaagttaatataagtgtaattgccatacagagtgattatgggtgcccactcaaaagtcagccatactcaattatacacaaaaacacaaaacacacgtgcacacatgcttagattgcctcgcaaagcctatatgcatgggaagccaatgacacacacgaggaaagatgggaacacagagctgcttcttggtttcagggaatcctcacttctttcttccttctcagggaaatttcgctttgtttcatgctcgacctccagcctcccaggtcttggccttaaagattccaagggggccgggcacggtggctcacacctggaatcccagcactttgggatgccgaggcaggcggatcacctgaggtcgggagttttgagaccagcctgaccaacatggaaaaaccccgtctctactaaaaatacaaaattagacaggcgtggtggcacatgattgtaatcccagctacttgggaggctgagggtggagaatcacttgaacccggaaggcggaggttgtggtgagcccaaatcgtgccattgcactccagcctgggcaaatgagtgaaactccatctcaaaaaaaaaaaaaaaaaaaaaaaaaaagattccaaggggccccagcccccctcccttcactaaagacaagccagctccttagatcccatgatgccagagctgtgatcttccagtacactggagaagctccttgtatcttcctatctcctagtaggctgatttcatccaccaacagccacagcaccttgaagcaacccaggagctgctgtttcccgtgatcatgtggtcaaccctggtccttcaaacttctttcagaactcacacacacaccacgtccccttatgagttttgagcagaatgctttttctttgaaagtctgtattcaacaccccctttttatttatacaaacttggagggtatgtgagaaattttatggcatgtatataatgcgcagtgatgaagtcagggcattcagggtgcccatcactcaaatacaatacattttggttttggggtttgtttgttttttttttttttttttttgagacaatctcgctctgtcacccaggctggagtgcagtggtgcaatctcggctcactgcaacctccgcctcccaggttcaagcaattctcctgcctcagcctccagagtagctgggattacaggcacccaccaaccacccggctaatttttgtatttttagtagagaaagggtttcgccatgttggccaggctggtctcgaactcctgacctcaggtgatctgcctgtcttggcctcccaaagtgctgggattataggcgggagccaccatgcccagccacaatacattttttgttaggtgagaatatatataatattagaataatattactctgctctcaagccttgaacttattccttctacgttactgcatgatggtaccctttaaccgacttctcttgacccttctcctccccgccactcacccttcccagcctctgttacccttcttgccactctctacctccatgtgatcaaaccttttagctcccacatataagaacatgcaatatgtcttttgtgtctggcttccttcacttaatgacttccaagctgggcatggtggctcatgcctgtaactccagaacttcgagaggccaaggtgggacaatcgcttgagccccaggagttcaagaccagcctgggcaacatagtgagaccccatgtctacaaaaaataaacaaaattagacaggcatggtggtacatgcctgtggtcccaactactcgtgtggctgaggtgggaggatcatttgagcccaggaggtcaaggctgcagtgagctatgattgtgccactgcactctaacctgggcaacagagcaagactcttctctaaaaaataaaaataaaaaataatcataataataatgaccttcagttccatccatgttattgtaaataacagggttttgttccccttgatggctggacagtatcccactgcatatacatataccacagtttctttacccatccattcgatgatggccacattgattccatacctttgctattgccaacattgctgtgatgaacatacaagtgcaggtatccctttgatagatcgatttcttttcctctgggtagatatctagtagtgggattaataatagccattgtgcccagtaagaccccacttcttaatattattctcatataattctaatagccattctgactggcataaggtgatatttccttctggttttgatttgcatttctctgtgatgagtgatgctgagcattttttattgtaatgctcttgactaactgtgccacgtttacaactgtctttgagcggagacctgtactacagagtcctacacagggttaaggaggagcatcagaaggcagtgaacagacgtgaggcctatcagctggtactagaaaagagacaatccatttaaggctttgactcatttttgaaacctatgtgctatggtctaaatgtcccccaaaattgacgtgtttaaacttcatcacgaagggatggtattaagtggggtcttactggcacagtggctcaacacctgtaatcccaacagtttgggaggctgaggtggaagaatcacttgagtccaggagtccaagaccagcctaggcaacacagcgaagactccgtctctacaaaaacaaaattgtttttaatgagccagacgtggtggcacacgcctgtggtctcagctacaagggaggctgaggtggggggatcgcctgagcccaggaggtccaggctgcagtgagccgtgattgcacccctgcactccagcttgggcgacagagtacgattctgtctcaaaaaaaaaaaaaaaggcagtggggtctttaggaggtaaggaagaagtcatgagtgctccaccttctcaaatgggatgaagaccctaatacgagagggcttaggggtgagcaaccgcatgaaaggcctgagggaacgagtccgtagcctttgctcttctgtcatgtgaggacatggcaccagacacccaatgccaaggcctcgatcctggacttctcggcctccagaactgcctccagaactgtaagaaataaatttctattgtttggaaatcacccagttgcaggtattttgttgcagcagtaaaacggactgagataccgtgtcgctgtacactctttgcagtatgaagtcagcatggtttcagttgagaaaagaggaacagagtagttgggtctcatcctcacaaccctgtttctctcctctcttctctcggggtcatcactccccaaccatccaaaccagaagcctccaggtcactttcttctccttcctttccctcaccatcaagccctgccaagtctcgctgtggaatccactactttccttccactcccactgcctgaaccctgaatgtctctcgggccccagcaaagagcttccaaaccattctccaggcttccagtttctcctcttccaattcatcctccattatattatcaccccataagccttgctctgaaactcgtaatgcttgcccttttataaaaataatagcaacaacatctcctacaactaagatttagagaatacggattatgtgtcaaacactgttctaagcaccttacacgcattaccctcacagttaacccgcaccagtctgtgaataggtactactacaaactcctgctaacagaacagagcagagactctaacgtggcatgcaaagtctttcactaccaggccccaagcccctttccacccccatctcccatgtcctccatctttgccgcttccccacgtacttgcggtgctgtttctcaaacacccacccctttctgtgttacacgccctcatgccgtttccttgccattttaggtgttctgctactgttttaattcttgtctttttaagtgttccaacgacactttaaaaatgctttaaatgcaggattgcaggccaggtgcggtggctcacgcctgtaatcccagcactttgggaggctgaggcaggcagatgttctgaggtcaggagttcgaggccagcctgaccaataagatgaaactccatctctactaaaaatacaaaaattagccaggcacggtggcatgtatctgtaatctcaactactcgggacgctgagataggagaatcacttgaacctgggaggcagaggttgcagtgagccgagatcgcaccatttcattccagcctgggcaacaagagtgaaactctgtctcaaaaaaaaaaaaaaaaaaaaaagcaggattgcacccttgaaagttaaaattttacttttgctgaaaggaacaattgaggtcaggtgcagggactcacgcctgtaatcccagccctttgggaggtcgaggcaggcggatcgtttgagctcgggtgttcaagaccagcctgggtaacatagtgagatcccatctctacgaaaaatgcaaaaattagctgggcatgatggtgcacacctgtagtcccagctacttgggaggctgaagtgggaggatcacctgagcccaggaggtaggggctgcggtgacccatgattgcaccactgcactccaggctgggtggcagagcaaaaccctgtctcaaatccaaaagaaaagaaaacaagagaagagaagagaagaccattgagcttaacacgccttttcatataaataactccaatggcggcattcatctaggctaaaattttggtttctgagaacaaatcattttgctaataattcagtggacatttatactcaaagataggcagagcccctaaatctgcaggtgcatgaaaaattcaggtgtagggacattacactacacaattacctcagactagggtagtttgttgcggtgaggttgggtttttctttccttccttttaaatttttacttaatcaagaaagcttcttttaagacaaacacttggtgaggtggccaagcactatcatatttcctggtttcctcttcttctttacttaacaaagaactgctcattaaaatgacatcttcttaattttttttttttttttgagatagagtctcgctctgtcacccaagctagagtgcagtggcgcaatctcggctcactgcaatctccacctcctgggttcatgcgatcctcccacttcggcctcccgagtagctaggattacaggcagccgccaccacacctggttaatttttgtatttttagtagagacgagatttcaccatgttggccagactggtctcgaactcctgacctcaggtgatccacccgccttggcctcccacagtgctggtattataggagtaatgacatctttaaactcacatctaaggagtgtctactgagtataagacattgattccaggttaaataaagtatctacacgagtcttttcacctattgactgaactgtctttaataatcacacttgtgtagtacttttcatttccattacctcatttgattttccaacgagacaggtgaaacaattctgcttccagtagacatgggagggtggaaacagcagggccactacttacctgtagtagtcagttttaagttgaaggtaaataccccttcaaaatttctggatggaaaagaccacaggagataaagcagagaatcaaagcccagggaggaaaatcatataggggacattaaagaccagcagggtcataagacttcccaagaaatggcatattctagaaatagagcaaggaagccactccacactcatccttctctgaatttctacccttattttttccttctaaagagctagacttgggctgggcatggtggctcacgcctgtaatcccagcactgtgggaggccaaggcaggtggatcacctgaggtcaggagtttgagaccagcctggccaatatggtgacacctccgtctctactaaaaacacaaaatgtagctgggcgtagtggtttacgcctgtcatcccagctacttgggagcctgaagcaggaggatcacttaaacccaggaggcagaagttgcagtgagctgagatcactgggcgatcgagcaagggcgacaaagcaaggccccgtattaaaaccaaaaaaaaaaaaaaaaaaaaaagaggctctttctaaacttttaaatctattgctaaattcaaggaagacttgattgcagtagcatttaactctggaatcacaaataaagtactagcaaattccatcttcatatactactgctttaatgccaagctaatacttaaaaaagaaaatgggcaaagaaaaagaaaaagttgatgattcatgagtctaaacaattttttgtttttatttatctgattttttttgttttttttttttttgagacaaggtttcaccgtgttgcccatgctggagtacggtggagtaatcacagctcactaaagcctcgatcacctgggcccaagccatcttcccacctcggcctcccaagtagctgggacctcagggatgtgccactgcccccagctaagttttttttttttttttttttttgagacggagtcttgctctgtcgcccaggctgaagtgtactggtgtgatttcgactcactgcaacctctgcctcccgggttcaagcagatctcctgcctcatcctcctgagtagctgggactacaggcgtccgccaccactcctggctaatttttgtttttttagcagagacgggggtttcaccatgttggccaggctggtctcaaactcctgaccttatgatccatccacctcagcctccgaaagtgctgggattacaagcgtgagccacggcgcccagctgactcagctgtttttaaattcttttgtagagacagggttttcctatgttgcacaggctggtctcaaactcttgggcttaagcaattctcccgcttggcctctcaaagtgctgggattacatgtgaaccagcatgtctggccttcaattcatttctaaaaagagaggaaaaatatatggcttcttccccgccccattgttatttgattcaattatttacaaaatgaattcttaggatattttgcatttttatttccttctgaaaaatcagtttttacaccatgaccttaatctagctaattctgttaaaataggatttaattttagataagttcccagaggacctgcattccattcaattgttggttgaactatatttcctagtgactaggatttataaatattaattatctgaaagagtggaaatgaacatatagttatttttagaatatactgtgataacaacaacaaaaaatcctgcaaaacggagctagaccagcgctgacatgaaaatccaacagccacctggcgaactctgtgttccaagaggtttttatttacagtgtaggatgtgactttacctataaaatgctttctggctgccactccgtttggacgattccggttttggtctgctaacttatcaactgtatgatttgggcaagttcctaaacttctctgtgcttcgtttctcccctttgtaaaacaggactaaaaatattaaaactcggccgggcgcagtggctcacgcctgtaatcccagcactttgggaggccgaggcgggcagatcacgaggtcaggagatcgagaccatcctgactaacatgctgaaacctcatctctactaaaaatacaaaaaattagccgggcgtggtggcgggcgactgaagtcccagctacttgggaggctgaggcaggagaatggcgtgaacccgggaggcggagcttgcagtgagcccagatggcgccactgcactccagcctgggcgacagagcaagactctgtctcaaaaacaaacaaacaaaaaattaaaactcttccctgtggggttgctttaaaaatcgtataatgtgttatatgtaaacataaagcattataacaagacagaggaatacaccactggagcaaaatcagaagcggttccctcgttttttcacaatgtggagtctggcccggcgcggtggctcacacctataatcccagcactttgggaagccgaggcaggaggatcacttgaggtcaggagttcgagaccagcctggccaacatggtgaaaccccatctctactaaaaatacaaaaattagccaggcatggtggcacgtgcctgtaatctcagctgcccgtaatctcatctacttgggaggccgaggcaggagactcacttgaacatgagaggcagaggttgcagtgaaccaagattccgccactgcattccaacctgagcaacagagcaagactacatctcaaaaataataataataaacaatgtggagtcttttattctttgcctagaattttctgtgcattgctggaatgagtatatccagaattcattccaaagttaattaagaaaagtacagttaggctttggtaaaacagtctgccaaaatttaacaaaaaagagaaggagaagaaaagttcattaaaaaataacatcactaggaactctgcaaccttgagtggggcacttaagtgccacagacctcagtttcttccttttttgttgtttttttatttttgttttctaggcagacattgaatgctagtttcttcctttttaaaaaaatgaaatagcttaactagaaccatctaaactacaaagaatctttttaaaattctaggccaggcacggtggctcatgcctgtaatcccagcactttgggagacccaggtgggcggatcacctgagatcaggagttcgacaccagtctagccaacatggtgcaaccccatctctactaaaaatacaaaaattagccaggtgtggtggtgtgtgcctgtaatcccagctactccggaggctgaagcaggagaatcgcttgaacccaggaggcggaggttgcagtgggctgagatcgcaccactgcactccatcctgagcaacagagtgagactccatctcaaaaaaaacaaaaaaacaaaaaaacaaaaaaaaaattctaaaacactaggtttatgaagtaaataataaaattctgtgataggacggagccattttcttccaggctatttaccaaacacagcaaaggaaatcaaaaaaaggcttcccatatagtaaaacttacattttggagatctggatttctccattataaacctatggaatcaaatcatttaaaatctagttaccagagaaacctcggtttaatattaacaaacatacttcctttaaccacgagccactttaatgtatatcagttttatctctggagcttcatagatcccaacagagaaggctgatctattttcagagaaacatagcaagagagtgtcacttctgaaccattatacatttaaacaatctctctacatgtagagcctgcatctaaatcccagcaatttttcaggacctagctctgaggccacatcagcactccaggcaggcggagggactctccaccccgcctcttttgcccccagaaaataaatctttccccagaccaacaatccacttcccggcctcacagcaacgggctcccggctcccgcacgtgactgccaactctttacgagatgaggctgtgctggctcggtatggttgataagacaagcatgcaagaaatatttattaatgcaaactcgtataaattcgtatcatctgagtttatgggaatgaggataaatcacaaaagcattataaagtgaggctttggacaaagtcctgaatggaagagtctagtaccatttttagagcctcttttgttttttaaactccttttactatcattcccagccttggtagacacttgacaaatatttgaggggaagctgaggacaaagagatgaaaataaagtgactgctatgaaaaaatgaaagcccaggtaacaataaacagtttaatctctgtttagttaggaaggagccaaacgcggctgggcacggtggttcacgcctgtaatcccagcactttcagaggccaagacgggcagatcacaaggtcaggagttcgcgaccagcctgactaacatggtgaaaccctgtctctactaaaaatacaaaaattagccaggtgtggtggcgtgtacctgtaatcccagctactcaggaggctgaggcaggagaattgcttgaatccaggaggctgaggttgcagtgagctgagatcggaccactgcactccagcctgggcaacagagcaagactctgccttaaaaaaaaaaaaaaaaaaaaaaaaagagccaaataattttgcctcccaatttgctgcatccatccaagaggggaagatggtctcaggcagtaactagctttgaaaacccttgtgaattttttgagatagggtctcactctgttgcccaggctgcagtacagtggcgcgatcttggctcactgcagcctcgacctccttggctcaagtgatcctttcacctcagccgcccgagtagctgggactacagacatgcaccaccatgctttttttctttctttttttttttttttttttttgtagagatgaggtttcatcatgttgcccaggctggtcttgaactcctaggctcaagcgatcctcccatttcagcctccccagtagctgggactacagttgcataccaccacacctggctaaactttttttcatattttttgtagagttgggggtcttcctatgtttcccgggctggcctccaaatcctgggctcaagtgatactcctgcctcggcctcccaaagtgctgggatcacaggtgtgagccacggcaccaggtctgaatttgtgattcgtgttaatgacgaacctgagctgagccttaagtatctgtccggagtcgcagaagcaatcagcacagtgcccagcactgaaccacggcacacagtgcccagcactgaaccacaacacccagtgcccagcactgaaccatagcacatgcgcattccccccacgcccccgaacttatattcgtcaccatatgttgtgcagatccacgaatgggcagagtcacaattctcacatgagctttgtaaataaggaaaaactgcatgggccagcacacgttgcttgtgtgtgtgtgtcctaagcactgatgacaaatgcagaaccaacaacattcccactcatccagaggaaatcgtgagttctcaatgagcaggctgggagtagcttagtagtcatttccaaagcactgtgaaacttgtctacttcatgaaaaagtactgaggctgttttacagccctttaacttaaatctagtaattgtgcctatcagagttctgaagaaaataagactcaataatctaagctactagttcacgcagatcatcttaaagcaagattttccacagacctcacatatcgaggtgacatgatccttttctaaaatgaaagagcttcgctagagcccagaagttcgagaccagcctgggcaacataagtgagaccccgtctcaacaaaacaacaaaaaaaaagttttttttttaaattatccaagtgtgctggcatgcacctgcagtcccagctacttgggaggctgaggtaggaggactgactgagctctggaggtcgaggctgcagtaagctataagtacgccactggactccagcctggtcaacagagcaagacccaatctaaaacaaaaaacaaaaaactacgaaaacatattccacaaaaaagatttgtacataaggactgtatataagattgtttctaggcagacattgaatgctaatttcttcgttttttaaaaaaaatgaaatagcttaactataaccatctaaactacaaagtatcttttttaagttctaaaatattaggatttataaagtaaataaaattctatgacagcatggagccattttcatccaggatgtttggacacccttctcctttttttgagactccatcaaagaaagaaagaaaagagagaaaggaagagataaaaagaaagagagagctagcttagcaaaaatcatctaaactacaaattatcttaattctaaaatattagaatttataaagtaaataaaattctgtgatgtggtttctctagttaagggcctgggggacttacacagctgttacgaagacattatttaaaaaaatcttcagttctccctggggggcaattggattgacaattgcaattcctttgtaaccaatgggcttctgtgtgagctgttagacgcacactggtattcgttcaagatggaaaaccaaacaacatggacacaacccatgacagccttcaaagttctgtctgcatgaccaatcaggtcctttggttgaaatccatgaccaatcaggtcctttggttgaaatccatgaccaatcaggtccttcggttgaaatctatgaccaagcaggtccttggttgaaatccacgttggccaggctgatctcgaactcctgacctcaggtgatccgcccgcctcggcctcccaaagtgctgggattacaggcgtgagccaccgcatccggccagagtgtgttgttttctcattgcagtccctaacttgccctgaaccctcccttacccaggtagccacgaagcatctggtgactgaggcctgggagtgagccctggaggttctggctgacgctctgccgtgacccacttggggcttctgtgacgtccccttcagcctgacaagaggacccagttctcctctgtgctcaccctgaacaaaacaggtcctagtctgggaagggcgccaaagagagatcttttcactggtttctgttccctgtcatttttgggggagggtgggctggggaacacaaacacccaataattggaaattgtcagacatacaaaaaagaaatgtaattagtcataaaccctattttaaggttatatttgcactgccattttaaaatgagaaaacactaataacattaaaatgaagtctttgttaaaagtaaccatgcattgttcaaatttccatttgttctttgtttgacaatgaaaaatcattctaaattagttccatacacttactgtgaaacacaacagtttattcctgggtcacattctcccccttctgtggtttatataacttctctttgttccgcaaatggcagtacaatggcaaacaaaataaaatggagtttattatgaaaatggatccattaagctacctaagaataacatagccctacaactcctgcacttgtagagggacacgggtgagatgaaacggacgtcagtacccctgcaagaatcacacagataggcccctcggtgcacctggagagggaggccacaatggcaaataataggagacacagcgatgccccactcccttctttcccaagagctgccatttctgcccttgctggataagctcagtgtctcacacagcgtgagcgtccactagatgctggcttggacaggcgatgctgagggttcccatagacggcactctagtagggctgctcaagtccctcctcacaatccagaggatctcacctaggcagggcccatggtcactccccaggagaagagccaggaatgtccccatcaagcaaaacccctggtctccagctcacaactcaaaacccaagcaaatgaaggaaaagctcctgggaccatcaggactcataacgaccaagggtcagtcatggtatcaggaaatcgtaatcctggctcagaaaggttttaaatacagggaagcagaaggctggggcagcaaaggacactactaagagcaagcgactcacagggctcacccggaaggcattacaaactggaattcctaaaagagtggttgccaagctcacccagaagaggaggtcccactggtccctgagtctgctccaaacggccacgcacagcgtgggcatcctctcccctgctttccattgctgtacagaacctgacctgggaccagagagaagagggtccagggaaatgctgctgaaggcttcgtctctgcagtggagagaaagtcggaaggggcagcacccacccctagctgcccatagatgaccaggcacaggcacccaccaccgacactggcacaatcccccaacatgttctcagaccagaccaagaccctagccgagcccaaggatgctggctaatcaaatagtaaacacctttggccagattatccttaaaaagtctctggaatgtcaccttcagtctctgtagtctactttctaacatacttctgagccgaaaccacgtgaaaagatttttcttctgactacaaggcagaacaataaaagtgaccctctgagtcaaaaacaccacatgaaactcacctcccgcctccaacccatcccttccgcatccttcatgtccaccgtccctttaccaacaaccagctgattcttccagacttcaaaatctttcagattaacccagaaatatcgataagggaggcctttttcttagcttatgttgtatatgtttttctgtttaggctactgctataaagaactatccaccagcctgggcaacaaggtaagaccgaccctgtttctacaaaaaatacaaaagtagacgggcatgatggtgtacacctgtagtccctgctactcaggaagctagggtgggaggactgcttgaacccaggagttagtggctgcagtgagccgagatcacaccactatactccagcctgggtgacagagtgagactgtgtctcaaaaaaaaaaaaagaactatcccgagagtccactgttgggggccgaagtgggggtggggacccttggctgccatgttcctgggccaggaacatggactggatggcctgcatgtcagaagactggtgacatacaagggtcaataaataaaaacagttaatatgataagagctgttactgttattgttagaaaagaggggcacagccaaggaaaggggagaaagctgaaacaaaccatttgacttggatggtatcatgatttttatatgagatgaatggatacatagatacgagcgggacagatggatacaaagaactacaaacgcatgtgtgcccgtgtgtgtatgtacaaacatatgtgtacgtgtagggaagtacatgcatatgtttaatttcctagctatgccaggcgcggtggctcatgcctgtaatcccagcactctgggaagccaagatggatgggtcacctgaggtcaggagtttgagacccagcctgaccaacatggtgaaaccccgtctctactaaaaatacaaaattagccggacgtggtggcgcatgcctgtaatcccagctactagggaggctgaggcaggagaactgcttgaaccgggaggcagaggttgcggtgagccaagttcctgccactgcatgccagtcttggcaacaagagtgaaactccgtctcaaaaaaaaaaaaaaaaaaaaaaaattcctaactacgctgcttgagaagtccttgtagccgtaatagcccagtagcgtgaacacacctaatacttagatcctggtttctaaaaaccactttctactaaaaggaaccagggcttattggagaaatggctgattccagggctggagcaaggaaagttccgggtgagcctagaaccaagaactaaacatgtggccgggagcagtggctcacacctgtcatcccagcactttgggaggacgaggcaggcagatcacctgaggttacaagttggagatcagcctggccaacatggtgaaaccccatctctactaaatatacaaaaattagctgggtgtggtggcgcacgcctgtaatcccagctacatgggaggctgaggcaggagaattgcatggacccaggaggcagaggtttcagtgagccatgatcacgccattgcactccagccggggcaacagagtgagattccatctcaaaaaaaacaaaaacaaaaacgaaaaaacctggccaggcatggtggctctcacctgtaatcccaacactttgggaggctgaggcaggcagatcacgaggtcaggggattgagaccatcctggttaacacagtgaaaccccgtctctactaaaaatacaaaaattagccgggcgtggtggcgggcgcctgtagtcccagctactcgggagactgaggcgggagaatggcgtgaacccgggaggcggagcttgcaatgagcagagatcacgccactgaactcccacctgggcaacagagcaagactccatctaaaaaaaaaaaaaaaagaagaagaagtaaagatgtgctcaaagaatgacatgaacacatcaaaagaacacaggggccagcttggaggcgctgcttttggccaaatctgggacaatctgggtatcgaagcaaatgataatggtaatgaattataacccaatgggtaaaataggagtctatgagtgtattgataggaaggagagaaagacagcaggcaagctccagcttgcagtggaatgccaactaatcaatgcaaaagaaacaatgcaactagaaacatcaccatttggcaatgctcatactaattccctcaggcaagaatcatcccaggatgctaaaacaaatgggcaaaaagcttaatgagaaacaggatattttccgagtccccaaaaaatctccccaccagaaacagtactttttaactgataattacaaaataccaacaaattaattttacagtggagaaacctggtagacaccacctcaaccaaatgataagttaacttctccagaaatgggactgatcagacctgtgtgcgttcctgtcgtgacaaccctgcagggactctcctgccaggaacctaccacctgattctcatcatgaaggaatatgagaccagcccaaaccgagggacattctacaaagtaactggcctgttctcttaaaaaaatgtcaaggtcgtgaaagacagagacgaaggaacagccccagattgaaggagactcgagagccattgacacagacggcgcctgtggtcctgggcgggctccggggcctctgcatttggtggcatggtgtgacagtgcccacgtcctgatttgggcaggtcggtgcaggctatccgggacagcgtccttgtttttaggaaacccacacaggagaatctagaggcactctctgcagtctattctcaaattattccggaaaaaagggatgtgtgtatgtggagagacagacagacaaacatgtcggaatgttaattcagggaatctgggtgaagagtatttgggaattctttatactgtttgggagcatctctgtaaatttaaacttacttcaaaattagaatataacgccaccaaaaccccctctatcactcactccgcattcctagataacaactagtgtggaattctgttctttgaatcactagatatcaactagcgtgtaactctgttgtttgaagccacctggtttgaggtactttggtacagtagccctaggaaataaatatgctactcaaagaatattgaatgtggctttttctacaatactaaaatctgacctaccatgttaacttagtaaggcaaactgctggggcggggtcccgtttcagccgaacgcatctgacaatgccttaagtcacacattgcataatcacaagttgcttcttgacatgagcggctcttcaagtgcacggggaacaacagattctttgtcagggactcacaagagtcacatgctgttattcttttctccttaagagacaaactgattttttaatcactgagagcctattacatgcgtggcatagttttaagatgttttgacatgtcacacgtaaacgatagtaaacatgtcttggaagaggggctaagatgtgggacgaacgtgattattcaatgggcatgcgcttccggccacgcatcacacgcacatacaccagcgcggttatccataactctaccatttcaagtgagccgcaagagactgtaaatcgcagtgaagtgggccgtcaggcaatgattactaaataagcatgggaaacatctaagattaacagtgaagagagaagatgcgtttggaatggaatcctggagacagttaagttaccaggtgctttcacagtcgttttttcaaattcagtcactgagacataaaataatattgatctttgagaagagctctcgacggaaacagcagttggcagtgtccccagagcacttgcccttcctctggagcgcttcacgtgcgagcccgccgtctatttataacagttgggcacttgtcgccacaatggctgattgtgtggcccagctgtctgtgtctatcaagaagggcaggagtggacagcctgcactttgatgtttcccttttttggagactgaaaataacatttttaaaaaactgccaaccggcaaggtcacaaaatatttttggatggcacggggacccgattgcaaagctgtggttcacatcagatgcggaggcctgggaagaagccagtgagccccattgcacaatatcctgctcatgccaacttcaaaagttatttgcctcggagagctcccagacgactctttctcggtaataaaacacagcattttagaaatttgcaagggtcttctggatagggcattacccagaggagcaaggatttccctggccactctggttacagttgcaaccagcagccccaggcctcttgccacccttgccccgccccaccccacatccctcacccccactccacaaactcctgcccttccctgatgagctctcaagcacttaccagcgacacgctacatatttttctaatgcatgtgtcaatttcttgactcgcccattctattatagatggctcacgaaagcaggattagcgtctgttttgttcactgatgcaaccacagagccgagaatagtgcctggctcacaatatttactgagtgcatacttgtggaattaattaatttaaatagcagagacaatgggatcaggaaacacatggaaataccgatgaccagtattagatgtcagggttctgtcgcccttccctccgcccccgacgaagatcccagctttgtttacatatttgtggtgcacaaaaatagaaatggactaaacaaaattcccgattttcccaaactgtggtggattgcagaaaccaagacttcgcagggctcggttctgaaatgattttcactcaaaccatcttcctgaaactcttcctattactctctgcccatttcgcaaaccttcttgctggaggtattagatacgggaagcacctgtagtaatcaacaagtatggctctgattaaatggatttttttctttttttttttttgagacggactctcgctctgtcacccaggctggagtgcagtggcacaatctcggctcactgcaagctacgcctcccgggttcaagcaattctcctgcttcagcctcccgagtagctgggactacaggtgcccgccaccatgcccggctaattttgtattgttagtagagacgggtttcactgtgttagccaggatggtctaaatctcctgacctcgtgatccacctgcctcgacctcccaaagtgctgggattacaggtgtgagccactgtgcccagccgaaatggatattttgaaaatcatcaagttatacaaaagaatcccacatgctgtacaacaccactcgagattttagggtttttgcgggttttacatcagtagatcatgaaaccctgactctttaattattatgtaaatgaaattcaacaacacactcacacctcaaaaactctggaaggtcagaaagaggcagagagcagggcccccgcggaaggggaggcacacaaggcagacagaggcagaggaggtgggagtacaggccccagcactgtggtagccaacagcagagccattcttccacaccgggaagggcccccaggcctcaggaagccagctctattcagcagatttcacaagtgaaaaagcctttttagatgtcttttggggtcaggcgtggtggcttacacctgtaatcccagtactttgggaggctgaggcgagcagatcacttgaggtcaggagttcaagaccaacctggccaacatggtgaaaccctgtctctactaaacatacaaaaaattagctgggcatagtggcacacacctataatcccagctactcgggaggctgagacaggagaattgcttgaacccaggaggtagaggttgcagtgagtcaagatcaggccattgtactccagcctgggcagcagagcaagactctgtctcaaaaaggaaaaaaaaaaaggccagacgcggtggctcacacctacaatcccagcactttgggaggccggggtggggggatcacgaggtcaggagatcgagaccatcccggctaacacggtgaaaccccgtctctactaaaaatacaaaaaaattagccaggcgtggcgccgggcgcctgtagtcccagctacttgggaggctgaggcaggagaacggcatgaacccagaaggcagagcttgcagtgagccgagatggtgccactgcactccagcgtgggcgacagagcgaggatccgtttcaaaaaaaaaaaaagataccttttgggaacaattccccagcagaacaaaggtgccacttctaagtatgaggaattccttatcaaagatgcctgagcctgcaagacagctcccacaagtacaagcgctgcaacgactgggtgactgcgcgtctctggcaagcggttttgaagccacttccttagctcccatagacaggcagtgctggaaacacacatgcagggagctcccagccggtgttgtgcgatacagaacccgaaagctgcgccctccccgcaaggaggttgtctatagaaaattctgtgacatcaggattcttcaataatctcttcaacatcagctctcaacatatttatagaagatctccaggcccagcagttttcctacctgtgcaaaatgctgtggcttcaaagtaatgttttgttgtgttttgttttgtttttgagacgagtctcactctgtcatccaggctggagtgcagtgatgcaatctcagctcactgtaacctccgctcccgggctccagggattctcctgcctcagcctcccaagtagctgggacgataggcgtgcaccaccacacttaggtaatttttgtatttttagtagagatggtgtttcaccatgttggccaggctggtctgaaaatgctgacctcaagtgatccacccacctcggcctcccagagtgctgggattacagccgtgagccaccacacccagccaaagtaaatttaaaaggggctttcgtcctcctaggagtcagaatcagtcctcactgtaagaagcagaattctaacctcaaaactggtctcctgggaacactggaaagcagtgcgtgatccgaaggggcagaaatgactgacactctcaaattcccctctgcatcatgggcactcagcactgtgcctagtgcatagtaagacttcaacaaatatgtgctgttgttataattcggcatgacgatggaggtgcagaggtttacctgtgtttttattatctctggttgacaaggcggccacacccaggttgcctgttctgaagctgtctcaagacagtgaccatcacccaggctgaggtccaggatgatgtgagtgcaaattgctaaagctctccttcaggtgccaggcctgccatgacacatggcgagtcctagcagaggtcagaccaacaactcagttctttcaggtaacctgtactgatgaaaccgccccccccccccccgccaatcttactcttctgttatttcatgtctatgaagggttttggcataaaaaaaacaaaaagcctcattttaaaaaaatctacaattgtttaggtttttgtttaaagagaagcgtctggttctgttgcctaggctggagtgccgtggtgcaatctcggctcactgcagcctccaacccctggcctcaagcaatactcctgcctcagcttcctgagtagctgggactgtccatcttttttttaataacagctttattgagatataattcacataccgtacaattcatctgtttccagggtacaattcagtggtgtctagcatattcacacagggctgtgcaaccatcaccaccatcaacctagaacactttcatcaccccagaaagaaactccgcacccggctgcagtgacaccatcatcctggcttattgtcgtttgtccgccggccaccgttctgtctctgtttctttcccaacaccagcctctcttttcacgcactatctccccgccagccctgctccctgcattctgtaggaaatgcttggctcctacagtggttgacgaataccaaagcttctgtgagcacgccagagggcccccacaaagctctctcctctgtctgaaacattactctgaaggagtgatttcttgttcattctgaataaggatgacgacaccaggaagcggaggcccggggagcatttacggcgtgttctcgatgtgtgagcactgtggccagcacgttccaacccagtgctgcaagagttgctcccagccccacttcagagatgagaaaaccaaggcccagggaacccaaggtcacaaaggactctaagaaggagagttgagtaatcccagcactttgggaggccaaggtgggcagatcgcttcaggtcaagagttcgagaccagcctggccaacatagtgaaaccccatctctactaaaaatacaaaaattagccaggcgtggtggtgggcacctgtaatcccagctacttgggaggtcgaggcagaagaatcgcttgaacccaggaggtggaggttgcagtgagccgagatcatgccactgcactccagcctgagtgacagagtgagactctgtctaaaaaaaaaaaaaaagagagttgaggctgggcgcagtggctcatgcctgtaatcccaacactttgggaggccaaggtggcaagatcacttgaggtcaggggttcaaaaccaccctggccaacacggtaaaacccccgtctctactaaaaatacaaaaattagccaggcatggtggcgtgcacctgtagtaccagctactcaggaggctgaggcaggagaatcacttgaacctgggaggcagaggttgcagtgagccaagatcgccccactgcactccagcctgggaaacagagaaactcttgtctccaagaaaaaaaaaaaaaaaagaagaagaattgaaatttgaactccaagcaatgtgacaccagagctcaggcccggaaccccatgctacactgactcttgttgagagaacactccaagatgtaatcatgcctacaatgacgttgcagggggaagtgactgatccactactttcctggagaacctgggaaggtatgtgtgatcaggaggataaaaggccagggaacaagaaaactgcagagaggagacccagcaggcaagatgctgcaaaaggtgcagcggaactgagtccaccgaggagctaaaaatccctccgtcttagaattctgtccttgccaggaaagggctcctcatctcctgattgctaattaactttatctccttgaatcaagggagctaaaggaagtctctgaattagaaacctttgtggtgaggggtaaaggaactttggtaagaggatataatcaaaaatatgatgattaaagaaagatgattaaagcttggaaagcaagtcactaacttattaacagtggctatctttaagggatgggattagtaaagattttcatttccattttatacatttctatattgccaaattttacaacaagcttatagtacttagaaagttggaagaaaaaccggccgtgcacgatggctcacgcctttaatcccagcactctgggaggccgaggtgggcagatcacctgaggtcaggagttcgagaccagcctggccaacatgatgaaactccatctctactaaaaaatacaaaaattagctggtggcgggtgcctgtaatcccagcaacctgggaggctgaggcaggagaagtgctagaacctggaaggcagaggctgcagtgagccgagatcatgccactgcactccagcctgggcgacacagcgagaatccatcgaaaaaaaaaaaaaaagaaaaaaaaagaaagaaagaaagttagaagaaaaaaccaaaaagatgacctggggagaggggaagaacttctggaataatgaagtgagaagcttggcaaaacctctcctcaaaaagtaacaacaaaactagacaagtcggtcaaaaacaaccaccacagggttggaaatcaaccaaagacatacaaaaaattgaaaaatgtttattcaagaaaaactacgcagctgggcatggtggctcccacctgcaattgtagcactttgggaggccgaggcaggaggattgcttgaggctgggagtcagagaccagcctgggcaacatatcaagaccccgtctcaacgaaaaacaaaaaagtcagcctggcgtggtgatgcacacctgtagtctcagccactcaggaggctgaggtgggaaaatctcttgagcctgggagcttgaggttacagtgaactatgattgtgccactgcacgccagcttgagtgacagaggaaggcctcatctcaagaattaaaaaataaaatgaagaagaaaaatgaccaaatcttgagttagagcggtggtgttctgtgatgctttggcttgaggggctcccctccttcccctcagctcacccatgctgctacatctaccagggtgggacgagctgtgaaaattggtggctccactgctggaggggttgacttgatttggaggagagcacatgcccaaaggcactgacataaaccacggtgatttcctgtaaacaacaggaaatgtacagaaggtcaacatctcagccaccctgagcctgcaatgccggttgtggcaaccaacagatcaggagaccagccaaaaacctagccggaagatacagagaataagggagctatcacgggcagtggtaaagtccctgaagtcccacacattcttcgtgctctggaaggctgcacacaggcaggaaagactgaagagggccctggttatccactcatccttggctaaagtgaggcctaccccacgcacaaaggaggccagaaaaggcctggcaaaaaggaaaaaccaagacaggctcgtataatatatgcctgaattctgaacatgtccctaaacgtacacacatatccaccgcaaactgtgaaaagcattagtagctcaaggtgtttcagcacacctctgaataatcattgcctgaccactaagctatgctgacctgggttaacccctgcaaagccaggcttaaacacattttaaaaataagaaaaaaaaaatgagcaggatcatcagcagctgctacagagacagacttcacagaattaatccaggcaagtcacaaacaaaaagaaataaacaacaaacctgcgttttgccaaaggtgatcataatccagagttgctacaacgtattaactaaaatacagagcttaaaaaaataaaatataagacatgcaaagaaacataaagtattgtgaattatactcaggcaagagtcataactggaaactctaagggggcccagatattggacttaacaaagatttcaaagttataagaaactactgtaagaatggaactgaaggaattcatgtttaaagaactaaaggaaagtatgtaacaatgactcatcaaatagagaatactaataaagagacagaaattataaaaagaaaccaaacagaaattctagagttcaaaagtataataactgtaatgaaaagttcactagaggggctcaacaacagagttgacatgggagaagaaagaatcagtgaacttaaaattatccaatctgaagaagaaataaaaaagcataaagaaaaataaaaagaacctcagaaacacagggataccatcaagcatgccaacatatatataaaggaagtttcaaaagaaaacgaagcaaaaggaagcagaaaaaattttttgaaaaactaatggcataaacttctcacatttgattttaaaaaattaatgttcacatccaacaaactcaaagtaagctcaaaaaactccaactcaataaagtgagccaccatgacacatcatagccaaactgctggaagccaaaaacaaagagaaaatcttgactgcatgaagacaaaatggttcttcatgaaaaggagcactaccataagattaacagctgacttcacgttagaaattaacagagaccagaaaacagtaaaatgacatattcaaagcactgaaagaaaaacttccaatcaagaattccatatccatcaaaaccataccccaaaactaacaagtagaaataaagatattcctagataaacaaagacagaaaatttgttactggcagaccctacttacaagaaatactaaaggaagcccttcaagatgaaagaaaaaaacaccagattatatcctgaatccacatgaagaaataaagaatgctagtaatactaattacataggcaaatatacagcagatttataaatagtctcttttttacacttaactgatttaaaagacaagtacatataacaataactacagacttttactactgggcttatgacatacaaagatatcatatacatgacataataccacagaggaggtagatagacatagacatttaatggaacaaagtttctatattttattgaaaatgaattagcattaatctacagtagactgtgagctctaggcacagtggctcatgcctgtaatcccagcactttgggaggctgagatggaaggatcacttgaatccaggagtttgaaaccagcctgggcaacatggcaaaaccccatctctactttttaaaagctatatatagatctttaaaaagtagactgtgatgagatgcatattgcaatccttagagtaaccactaaaaatataaccaaaaaatattaaaaacctcaccaaacagatgaaaacagaacactagaaaatatctatttaacacaaaagaaaacagtaaggagaaacagaacaaaaagatgtgagacagagaaaacatagcaaaatgttagatgtaatccaagcatatcaataattgcattaaatgtaaatggattaaacactccaataaaaggtgaagactgtcagattaaattttttagaagttctaaccatgtgctgtctgcaagagatgcagatggagaaaaatgtactatgcaaacaaaaccataagaaagttgcagtggctataataatatcaaagtaagtatgggaggctgtggcaggtggattgcttgagtacaggaattcaaggttatagtgagctatgattgtgccactgcactccagcctgggtgacagagtgataccctgtctcaaaacaaacaaacaaaaacacaaaaaaatcccacagactgaataaactttaagacaaaaaagttataagagaaaaagaaattttgtaacaataaaagggtcaactcatgaggaatatataaaaacataaatacataagcacttaatagcagagcacaaaatacaataaagcaaacactgactgaaccaaagggagaaataggcaattcacaataatgtttggagacttcaatatcccactctcaataattgacataatagttaaacagaaaatcagcaaggatatacagactttgaacagcattgtcaaccaacctgacgtaactaacatctgtagaccatgtcaagcaacaacaaatagaatatatattcttttcaagtgtacatatcgcattgtctagaatgaatcatgggctaggtcataaaacaagtatcaataaatttaaaagaattaaaatcatataaagcatgttctctaccaaaatgaaatttttaaaaatcaagaacagaaataaatttgtggactccccaactacttagaaattagaaaacatatctaaaggattcaaaggtcaaagaagaaatcacaagggaagtttaaaaatacttcaaactggatgaaaagaaaaacacagcagatcaaaatttaggatgcagctatgagaagtacttagggagaaatttataatgttaaaagcctgtatcaggaaaaaaaaaagaaaagtctcaagttaataaactgagcatcagcagggaacagtggctcacacctgtaatctcaacactttggaaggccaagctgggacgatcgctcaagcccaggagttgaagaagagccttggtaatatagtgagaccctgtgtctacaaaaaataaaaataaaaattagctggcccaatggtacacacctgtagcctcagctccttggggggctgaggtgagagaatctcttgagcctggaaggtggaagctgcagtgagccagtatcgcaccactgcactccagcctgggccacggggcgagatcatgtctcaaaaaaaaaaaacacaaacctgagtttccaccttaagaaactataaaaaggagagtaaactaaatcccaaaaaaagcagaaggaaggcaataataaatactagaccagaaatcaatgaattagggaaagtaatagagaaaactgatgaaaccaaaagttggttctttgttcagaaacaaaacaaggatgtctactctcaccatttctactcaacattgtactggaggtgctatccagaacaataaggcaggaaaaagaaatttaaaagacacagattggaaaacaagtaaaactcttcatattcactagctctatatatagaaaatcttcaggagtctacaaaaaactactagaactaataagcaagtttaacatgttcataagatacaaaatcaatatcaggaaatcaactgttttgtgtataccagcaatgaacaatccaaaaacaaaattaagaaataattccatttgtaatagcatcaaaattagtaagttaaaattacaaaactttgttgatacattaaataatatctaaataaatgtaaggagataccaggttcttggattgaaggactcagtattgttaagatggcatttcttcccaaattgatcaacagattcaacaagacccagcaagctttttgtagaaattaacaagaaaggttatgagtgggtaactgaagctgggtaacgtgtacctgagagttgattatactactctcttcacttttgtttatgtttgaaatcatccataataaagtgttgttttttgtttttgagagacagggtctcactctgtcactcgggctggagtacaatggcacaatcagagctcactgcagcctcagtttcctgggctcaagcaatcctcccacctcagtctccccattagctgggactccaggtgggtaccactatgcccagctaatttttttaatttatttgtttatagagacagggtctcaccatgttgcccaggctggtctcaaactcctggactcaagcaatcctcccacctggacctcccaaagtgctgggatcacaggcatgagccactacatttggccagcaacgtggtttttgtttgcttacaaaaaaaaaagaagactacacaaaagaaaaaaatgtacaactaattcaagggctgccttaattattcctcactctttaccctcggcccacatcatttccctacaggctgatccttgcccagtccactcctgattcatggctggtgaataggtgagggaggaaaatggagagagcgaatacacagagtgacagagggaggagaagtgaaaggtcataggcattcgctgcagccatgcctgtagtacgtccatcaccaggcttcaatttatagcagctacatgactgcgtgtgtcaatctctaactggctcatgtgccagaccagaagctactattggaaaatgcccctctctcgtcatgtcgtttgcacagtaattcacttagatctgaactgagtacaaatgagtggtgctctaagatcaaagcaccagggtctttaaaatgatcttcactctccccgcaacctgccccgaacacgtgcatgctcctttcactttcaattccaaactgcacccttctaacgctggccgaaagggaaagtaagccctgttttcgtttcctttcaaatacttgatgctttccaattttattcctattttccctaatggaataatacttactacttggaaagcatcattcatctcctctcaagatcctcacagcaacaccatgttgccagaagggcaggtgcgaaatctgaaataatggcagaagtcgaatgtcgcacgtcaatgtacagcctcccatcgaggcccatggctttatttttatgtatttatttatttattgagacggagtctcactctgtcacccaggctgcagggcaatggcgctattttggctcactgcaacctccacctcccggatttaagcaattctgcctcagcctcccgaacagctgggattacaggcatgagccaccacacctggctaatttttgtatttttagtagaggcggggtttcgccatgttggccaggctgatctcgaactcctgacctcaggtgatctgcccgcctcggcctcccaaagtcctgggattacaggcgcccactgccacacccggctcagttttgtatttttagtagagactgggtctcaccatgttggccaggctggtctcgaactcctgacctcaggtgatctgcccgccttggcctcccaaagtgctgggattacaggcgtgagcctccgcgcctggactaaggcccatgactttagcaagcgggatgttgttttccacctcctgctgctgcctcttaaggaacaggggcgcttcttcaccgcagaggagacggttctccattctaggaatgggtatgaacttgcctgaatagtctatgatgggcaatggggacgttccatctacatctcattatgaaaatccccaaaaaccttacaaaaccatataatcgtgaagttttaagaagtcttaaatagttctaatatataattctccacaaatcttttctctctaaaaaacacttatttttctcattttgatatgccacttcaaagcttttcccactccttgagtatatttacttttctctctcctctctctagtgactgagcagtgattttacctttacctatttatttagagatggaggtctcactctgttgcccaggctggagtgcaggggcacgatcagggctcactgcaggctccacctctcaggttcaaacaatcctcctacctcagcctccagagtagcttggaccaaagatgcatgtcaccacacccagctaatgtttttattatttgtagaaatgaggtctcgctgttgcccaggctggtctcaaatgcctgggctcaggtgatcctcccgcctcagcctcccaaagtgctggaattataagtgtgagccacagcttcccactaacaatttcactttttaaagagatgggtcatattgtccagtaacatttacatgagatccatgaaaaaaaagtgaatattattctttagaataataaacaattcatatcacaaaattagctttaaaagattcccgcttgtaggagctattagaatttcaaaactgcccagttaaacataacctggttcatcccaacgttttcatttacatataattcaaaaagatttacttttccataaatttcaaatgctcttcagatgaaggaaacattcatcattacatcaaagcaagtgcaacttcaatactaaatttcctgatcttttatacaattagactgcaagtgctcatctgagacagatttagagaaaattgcggctgatgcccagctctatgaaagagttttaagaactgaaataacttaaaaaaaattagaatcacagaatggggggagatgagaaaaaattcatcctaaattagaaatacgaactcctgcccaaagtgcagggtttttaaaaaatggaattgttaaacagattgaaataatatttagaaacaacaccagctcacaagggtagtaaaatactaattcttaaaatcgttaaacagattgaaataatgtttgtcaataacaccagctcacaaggatagtaaaatactaattcttaaaatcctccctcttgcgctatgcctgcttctgagttggctgagcaagttccttcccttccccaggcttctaacagtgaacatgatctggcagcattagacacaccacaactccactccagaccaagatgggtctgggtcaaacccaggacttctgcttcaaattaggagagttaccaaattaagacaattctgcctcaactgagtcaccctccagggacagctgagtccatttccagggtaagtactggggtagctctacccaccccagagagatgtattttatggtctgtcctaaacagaactggacccccagagaagttccgagatcagcacagcctgcagctgaccctcgggagagggtcaattcagggcatttgctgaccaaaaggatggatctccctcaccgggaggtggactgcaacctcccaaacactttgccactgtagctaatgtgtgcaaacatttactttgtgaatttgtatcttagtagcttcactaagtcagcaaaatccaatctctgaatctttttgtggtgactgaactaactctatgttgcacttttggtgaaaaactgcaacatagaatttaattaattctttaattaaatgggttaagggaaaaaccgtggcaataattttttttttcctctttcacttttgggatttgaggtcttcaaataagtttttctaattgtagggaaaacaaagtcttttaataattaccattaatgatttataatttaagcagtttaggaaataaaaaatgcatagaacatgatattctcatacccagacaagctcatatcccacctgcacccctttacagtcaaggatgattttgcatctcctttcctcacttaagtgccttttttgccaactaggataactcatataatgaatttttgccaactaggaaaactcatataatggctttttttaaatctggtttttctaataataaaatcatatctgttgcaaaaaaaaaacaaagcaaaaaaaatattagtacaagttcctctaatcccactgtaaagaacacgcgctatatataaatttgtatatatccttcaatgcatgtattattatctctctagacccacattattaaacacgctattttatggaaaatgagatcatgttttacatatggtacagttgcttgcttttttcaattcacagttcatggccgggcacggtggctcacacctgtaatcccggcactttgggaggcctagatgagcggatcatgaggtcaggagatcgagaccatcctggctaacacggtgaaaccccgtctctactaaaaatacaaaaaaaaattagctgggcatggtggcgggcgcctgtagtcccagctactcaggaggctgaggcaggagaatggtgtgaacccaggaggcggagcttgcagtgagccaagatcgagccactgcactccagcatgagtgacaaagcgagactccatctcaaaaaaaaaaaaaaacaattcacggtggctcttttgcacatatgggtacacgcagatctatctcattcttacaaatggttacaactattccaccataaggacagaccataatttccacctaatagatgttcaagtgatttcccactttctgctattacaagaaagacagtaaccaagattctcatacatacatttttgtacttgtgcaaatattgccatagggtaaatccctaaaagtgaaaggacttggtcaaatggcatgacatgtgaaattctgaagatatgcaaaatgtcctcaaaaaggtttctgcaattcgtagtcccaccaacagtgtttcagagggcctgcgttccctttcctctcaccaccaacaactagaatcaattttttcatctttacgaatcaaagagatttttcaaattttttttcttatttcaatatgctgttgttgtaagttattattattattattattattattattagggggattgtacatttagcccaccgcacactagctgcatgacctagagaagtaatttaatatcccggttccttggttgtaaaatgcagataatgaaagtaacatctacttctcgggggagccgtgaagatgtaatgagcgaaggcatctcagacacttggtgccgagtctgacagagtggggcttcaacaaaggttggaagaacaacgaataaatagaatatattctatgaacaatgaataaatggaatatattctatcagggtgacttaccagagttacctcactcatcaccaatttggctgctgttcaatttttgctattctcaattatattcgtatcattgagtaaattattctcttgtatctacaggaccatcttctaaggcgactctcccaggattcggacagtgttacagttcttacttctgttctttagaagaagtgaaccagcaacaacaggccacccatcaagttttagaaaattttctctgccttaaaaagtatataatgcggccaggcatggtggctcacacttgtaatcccagcactttgggaggctgaggcaggtggatcacttgagggcaggagtttgagaccagtctgcccaagatggtgaaaccctgtctctactaaaagtacaaaaaaattagccaggcgtggtggcacatgcctgtaatcccagccactcaggagggtgaggcacaagaattgcttgaacccgggaggcaaaggttgcagtgagttaagattgcgctactgcactccagcctcggcaacagagtgagactctgtctcaaaaaaatatgtatgtgtgtgtatgtgtgtgtgtgtgtgtgtgtgtgtacttttaaggcattctcttttgtacttttaaaattactagtaaggacatacatttccatatcactcactgtttgttgtatagaaaataagctttatcgttataattttcacgcatatatttttctccaaattatgacctggaaaaaaaacttgcagctagtaactggaaaactgggtaacatatatttataaaagacaaacacacatgtatttcttatatgtggcttttctctaccagtaaagaataggatgtggatgaaagtttcaaataatattatgttataaaccttatataattactgaactcaacaaaacttttgaaaaataaccaagtagaagttatttttagaaacctggaatgtcattccacctaacagaaattaaaactggctgggcctggtggctcacacctgtaatcccagtgctttcgaagaccaaggcaggaggatcgcttgagtccaggagttcaagtccagcctgggcaacatagagagatcctttctctttaaaaagaaaaaagcgaagtgcagtggctcacacctgtaatcctatcactttgggaggccgaggcaggaggactacttgaccccaggagttccagaccagcctgagtaacataagaccccatctacacacaaaaatacataaaaatgagctgggtgtgatgatgcatgcatgtagtcctagctactcaggagtctgagatgggaggattactttgagcccagaaggtcaaggcttcagtgagccatgatcagaccactgcactccagtcttggcaacagagagagtctccgtctcaaaaaataaaataataataataataaaaaccaagataaataatataaccacaacttttcttgacccatcaaagaggcggggttacaaagtaaccaagtagtagccaggcgtggtggctcacacctgtaatcccggcactttgggaggcccaggtgggcagatcacttgaggccaggagttcgaggccagcctggccaatatggtaatatcccatctctcctaaaaatacaaaaatcagccagccatggtgatccatgtctgtaatcctagctactcgggaggctgaggcgggagaatcaattgaacccgggaagcggaggttgcagtgagcagagatggtgctacttgcactccagcctgggcaacaaaagcgaaactcagtctccaaaaaaaaaaaaaaaaaaaaaaaaaaaaaaaatcaaaaaagttgaaaacagatcaatatctggcattgaggcttttaaaaagtcaaatccaaaattccttataaaggttcctgcaaagccaacttaaaaagggtccgtatggtggatcacaattcttgctacatttgatgcaaatcttcaggccaagtataaagcaactaaaatttgttttgcaaataaattggtcttactattatatatataatttatccctggtagaaatggggaaactggagaaagaaaaatttagattctagccttaaccattgtttgtgagtttttattatctgcctacaatttgggctaatcctgaaccatttcctggctgcaacaagtctctaaagaagaaccgagttttaattttcatcatgatgcattttagttggcttcttaacagaatacgttcttttttcattgttgttctggcccacgaattctgggtttttttgtttggtttttgagacagagtctcactgtcatccaggcgggagtgcggtggtgcggtctcggctccctgcaacctccacctcccgggttcaagcgattctcgcgcctcagcctcctgagtagctgggattacaggcgattctctttctattgcaatctctgtgtgcacagaattctactatccgagtgatcgatgttatatatctcacattgttttgcctattctgacagaaccaaagccactgcattctgaagactgaagacgatttaaaagcctgtgaatctcccttgtttggaatcccactgggcccgatctgttttccatgaccaaggcactgctgctaaagctatacagtatcaagcaccctccttaaaggctcagggaccatgaaggaagaagagggcatgtgagattacaagagctggattacaagagtggactgtggaggctgaagtagctccatcgtggatgctactccgccatgtggcttctgattaaccccagttccaggaaaccctctgagatttccagcttatgcgctgttcctcgtgtaagaccaagaacttaccataaagcctgaccttaggtcaaacaactttgatgttattgtactcacactgacctacacatccctctgaatcaccccttccctacggtatacaagccctgggaccaggggataatggtgcagggatccactgtctcttctcgctgcagccccagttcacagactaatgaacagaagcttgagaacagacatagcttctgtgcataagcccctattaaatgtttctaagaaaaaagaaaatgcttgaagaagaaagaaaggatagaaggaaatatttgaagagataatggccaataattttttaaacataataaaagacatcaaagcacagatccaagaagtttagaggactccaaaaaagagaaataccaaaacaacatcatgtccaaattgtcgaaaactaaaaataaagagaaaatcttaaaagctgccggggtgacagtgggaattgggaaacatattacattcagaggaacaaagaaaagaattatagcagacttctcaccaaaacaacaaaagccagaaggcagtggtgtgatatctttaaagtactaaaagaataagttgcaaaaaaaatttttcaacacaaaccttcatatcctaaaagaaaaaaaaaaaaaaaagaaacaaacaaaaccaaaaaaaagaaaaaaccgactcttaaaaatgagtgtctcttggatctccttggtatgaaatttttctttaaacattttcttttttttcagaaagagtctcactctattgcccaggctggaatgcagtgacgtgatctcagctctctgcaacctccgcctcctgggttcaagtaattctcctgcctcggcctcccaagtagctggaactacaggcatgcgccaccatgcccagctaatttttggtagagacggggtttcgccttgtcagccaggcaggtctccaactcctggcctcaagtgatcaactctcctcagcctcccaaagtgctggaattacaagcatgagtcaccgcacccagccctctttaaaaacttttttttttttttgagacaaaagtctcactcagttgcccagactggaatgcaatggcgcgatctcagctcactgcaacctccacctcctgggttcaaatgactctcctgcctcagcctcccaagtagctgggatgacaggctctcaccaccatatccagctaatttttgtatttttagtagagacagggttttgccatgttggccaggctggtcttgaactcctgactgcaggtgatccacctacctcggcttcccaaagtgctgggaataacaggcatgagccattgtgcccggcctaaaaacattttctaatgggagggaaataaaaactttttcagacagacaaaggctgagatcatttattcccagaagacctgtagcataaaaaatgttaaaggaagtttttcagtcgggagatgagacagaaacctatagatctacacaaagaaacgaagagttcctgaagtggcctaaaaagaagaaagattttcaaaataattttcaaaagtattttgaaaatcttccattgttctaaaactacactgtctatatggcagccgcttaaatttaaattacttaaattaaactagtttatttaaaattcagttgttttcaggtactcaatggtcacacatggatagtagctaccatattgtatagtctagatataaaacatttccatcattgcaggaagtttcatcaaacagcattgctctaaaaggtaattttctgtaaaaataacatgttatgaggtttataatatatataaaatacattattatgacactattagcatcataaacatttacaaggttctcatagaaccttgtagtaacttacagttatgaagaattcttacgaggttcttatataataaatggtataatatttggaggcagactgataaaaaatgtactttgtaaatttcgggcaatgacttaaaataagtgagaaaaaatatataagaaataaatcgatagaagagataaaaatagaatcatgacaaaaatctggctgggcacagtggctcatgcctgtaatcccagcactttgggaggtagaggtgggaggagcacttgaggccaggagttcaagaccacgctgggcaacatagtgaggatctgcctccgcaaaaaaaaaaaaacaaaatttaaattaaaaaaacaattagccgggcatggtggtgtacgcctatattcccagctacttgggcgacagaggcgggtgggtcgcttgagcccaggaggtcgaggcttcagtgagctacgatcatgccattgtaccccagtctggatgacagggcaatacccagtggcaaaaaaaaaaaaaaatagaaaacacactagcaaattgtctacaaagtggaaggttaaaaagtgatcgaggggaaaaaaaagcagttcggtatttctttacatagacaattcaaaaggttgttctgaatctcacaaagatttattgaaagttgttacacttttaagtactactttatggccgggtatagtggctcacacctgtaatcccaatacttttgagaggctgaggcaggaggatcgcttgagcccaggagttcaaggccagcctgggcaacatggtgagaccccgtctccacaaaaaaatagaaaaattagccagctatggtggtgcatgcctgtagtcccagctactcaggaagctgaggtaggaggatcacttcagcccaggaagctgaggctacagtgagctgtgatcatgccactccactccagcctgggtgacaaggtgagacctgttactatatatatatggagtgcagtggcaccatcttggctcactgcaacctccgcctcccgggttcaagcaattctcctgtcccagcctcccaagtagctgggattacaggcatgtgccaccacgcccagataatttttgtatttttagtagagatggggttttgccatgttggccaggctagtctcgaactcctgacctctggtgatctgtccacatcagcctcccaaagtgctgggattacaggcatgagccaccgtgcctggccagtgcctaattttaatctcttactaaattaaccactaaattaattttttaaaccccagaggaacattaatttacagcagaagaggtaagggaaaactggatgtactggcaagaaatgtacccggtcccatgtgtgcaatctgtcaacatgtaaatactgagcgtctgctaaacaccatacaccagggacacaaaaatgttgcaaaatgtgtcctggagagctcagtgaaggggagacacaactccaaagacccattaacgcaaaaggaggtaaaaagagacctggcaaggaatggcggctggggcagcgggggggccaggcgggagggctcaggaaaagctttccaacggagatgctactggatcttgtaaggtgggcaggggtccaacctgcacagatacctggctgagagtatctggcttatttgggaaaaatgcaggcagtgttttttggagaaacagataaattttaagtctggaagagttcataggggttctattatcctgaaatgcatcgctgttatttctttaagtgacagatatctagttaatgaggagaaaaggcaggcacaaaagcacaacgtgatgacagagcaaatgcaaaataacagctgggtggcgtagcacatgcctgtggtcccagctacttgggaggctgaggtgggaggatcacttgagcccacgagttcgaggctgcagtgcgctaccatcacacctgtgaacagccactgtactgcagcctgtgcaacacagcaagacccccgtcttacaaaacaaaaatgcaaaacaaaattagtgcccaatttctcaggtttatgcctagttgctaatctgtgacatctctgttagaaaagctaacaagagcctaaaagaaaaattcaagtcagctccaggactgatggtggcaaatctacaactccttccacttaaaaattcaacaaaataagagatttagatttttgcatttttgtgtgcccaaagaaaaaggctccagttttctgtttcgtgttccatcagcttacataacctaactcgtcccacacaaagacagacgaatgatttttcttgcagatgaaatattcccaagctctcacctctaaggtctaagtggatcttgtgataaccagcacaaagtgaggctggggatttgaaaagaaaataccagaaatggttaccaaaaactgacaagagcacccaaacagcatctgtgatcgctagaagatagacgcactgacaaattaaggagccattaattagtttcaaagagaaccaaatggcatcaataattttttttttagacaaggtcttgctctgttgcccaggctgcagtgcatcaataattaagaatcagcctcctggctgggggcggtggctcacgcctgtaatcccagcactttgggaggccaagggaggaggatcacctgaggtgaggagtccgagaccagcttggccaacatggtgaaaccccgtctctactaaaaatacaaaaattagccgggcatggtggcaggcacctgtaatcccagctactcagggggctgaagaaggagaatcgcttgaacctcagaggtggacgttgcagtgagccgagatcacgccattgcattccagcctgggggacaaggttgagacttcgtctcaaaaaaaaaaaaaaagaatcagcctcctttctgtacacgctttccacagctagcatgcggactcactggactacagggtgtaagatgaggccaactgtaagccctatacagggaagttacagttttgttcaaaactcactcacaattgggaacagcctgagaccatgcctgcatggaacagcacagccttgtccccccccgaggacacttcctgtgacatctggagagatgagcagattcacgaggcccaggagggttttcaggtggtctttctggctgtagagagatcaaacacacccttccccaacgtcctttaggagtaaatgaccaatttagcaacaatgagcactcaagaagtacgccagcattctctttattatgattatttcctgcacattacatcatgccttcttttcttacagcgggaaaacacccacacacacgcacacaggtatatgcacacacacacatcaaaagttactgtaactcctaagcagagaataggcatatttttggcctttacctttcagtccaattttttaaaatgagatataaaaactgaaaaggaggggattttaaatttatatgattttctgccaagaaaaatctaaggctatctgatttttaaaaatcagacacaggccaggcgcggtgactcacacctgtaatcccaacactttggaaggctgaggtgggtggattacttgaggtcaggagtttgagaccagcctggccagcatggcaaaacgccatctctactaaaaatacaaaagaaattagccaggcgtggtggtgcacacctgtaatcctagtacttgggagtcttcggcagaattgcttgaacccaggaggcagaggtggtagtgagccaagatggtgccactgcactccagcctgggcaataaagtgagactctgcttcagaaaaaaaaaaaaaattcagacacaataagcattcaattaagtgtccagttacaaagaaaaataacatgttcagcttcatagtttcttataaagttaaacacactcatcatacaacccagtcactccactcctatgcatttaaccgaaacaaataaaaatatacatccacggaagacttgtgaatgttcacagcaactctattcataatagccaagaactgcaagcaactcaaatattcatcaactgataaactgattttttaaaatggtggtatatccagtccaggcacaatggttcatgcttgttatcccaacactttgggaggccaaggtgggaggattgcttgaactcagaagtttgagaccagactgggcaatataatgagacctccatctctacaaaatacttaaaaattagccaggtgtggtggtgtacacctgtagtcccagctacttgggaggctgaggtgggaagatcacctaagcctaggaggtcaaagctgcagtgagatcacgccactgcactccagcctgcctagagtgagaccctgtctcaaaaaaagaaaaaaaaaaaagaaaacaaaaacataaaagtattagaagaaaatataggttaatattttacatagtcctcaggtggggaaggcttttctaaccatgatactaaaggtagaaaccataaacaatgattgatagataagaccaacataaagattttaaatttccacatatcaagaaatatcacgattgaaagacaaattagaaaatgggaggcattttacaacatatatggaagacaaagatttaagatacttacataaataaagaactttcacaaatcagtaaggaaaagacaaccaattcacaagcaactcatgaagaaatacaaaagggcaacacacatatgaaaaagagatttggccccactactaattatcgtgggcaaagacaacggcaaataaggatattcatcacactgttataattgacaatattatatttcatcgagtctaagatgccaatgatgatgtttcattactttttgttctattaaaatataatgcaaagtgctgccaattaaactatgacataccattaaattatacaatgcatcctgatgtgagggatggctggattattaacagtttcatattgtgatatacaatgattcaaagctggaaacaatctacatttccaacaagagatatttcctgaataaattatagtacatccccagaataaaatctaagtcatttaaaatgatgatacagatgtatgtacagacttggccaggcatggtggctcacgcatgtaatcccagcactttgggaggccaaggtgggtggatcacctgaggtcaggagttggagaccatcctggccaacatgttgaaaccccgtctctactaaaaatacaaaaattagctgggtgtggtggcggacgcctgtagtcccagctactggggagtctgaggcaggagaatctcttgaacccgggaggcagaggttgcagtgagccgagatcatgcccctgcacttcagcctggatgacagagcaagactctgtctcaaaaaaataaaataaaataaaataaacaaagatgtacatacagatttaagtggaaaggtattcatgatccatgaatggtgtttaatggtgttaatggtgtttaatggtgttaatggtgtttaatggtgttaatggtgtttcatatgacaccattatatctatatatatttatatgcattgatatatatttgattttgaataaatatttgatatatatcgtatatgcactgaaaaagtctaaaaacctcatgttgaaacattcaaaatggctatctctagttggtaaatgtttttttaatcttctttttgcttatctgtcttttctaaaacaccaaaaacatgttttacttttataataaaaaattaataaaaataagatggtcaccccctttgccatctgccaaaacagagagcttcaaaagtcacacattccttaaagctgcagtatttacaaaggaaagaaaaaccttcaagcaatctaaaaagctcaaacaggaaatgattaaactatggcatattaattcaaagaaatactatattatgtagatgcacaggaaaatccccatgaaatagcaacagaaaactcaaacacaaaatgaccaacatcaattttaacaaagaaaaaaattaccacctgtacctaagaatttaaagaagttaacagaggtaatttttcttttctttactttttttttgagacagtcttgctctgttgcccaggctctagtgcagtggcatgctcttggttcactgcaacctccatctcccaggctcaagtgattctcctgccttagcctcccgagtagctgagactacaggcgtgcgccaccacacccgattaatttttgtatatatatatacattttttgatagaaatggggttttgccacgttggccaggctagtctcaaactcttggcctcaagagtgatcctcccgcctcaacctcccaaagtgctgggatttcaggcatgacccaccgttcccagcccaacggaagaaatttttctaataggcttcagagaattatgtgttttgacctttccattaatgtcttatataaaattagtttgacagaaacaataaaaaatatatacaccttcagaatcatgacggcgttctccaggcctctaccagaaacatttttttcgtttttttttttttgtaaaaatatcaattttatgctccaaaaacattccacatggcaaccaaggtcccgtagagagcactttttcccccttgcctcttctttaaactcctaattcaaaattttggtttctgataacctgctcaggataaaaagaaaatctcacatagaaatgcctttactacagggaaatggagcaagaaatttcccttgtctctgggattgcttttttctgttttctggttaaggaaaacatttcaaagttcataaaaacaaggaactaaaattagagagatgagaactgaaccttgactcgaggtagggaaaacactatttttaaaccgagaaatatttctaggtctgtgctttatgagaaaggaagacgagcgtgctcatgtgtgtggatggtgtggcctggggagggacggtggcaggagaaaaccatctcccgcagcggggcattccctgcacctcacacacatctgctctcgtggaacacaaactggaactaatcagcaggcggcacctgggaattctagtcacttaacagcagggagaaggttgcacgttgctcacagcagatcatgaagccatctccacctcctgctgtcaccatcctcagaaccagcagtggctccatggctccctgactccagaggagctggccgcacaggagaccctctgtcattcctgcagaacagctaatgctttgcagagctccagatgtaagtttaagaaatacgtttgttataaggtttcttaacaagacacatcagtgatatctaagactcttaacaggtgactattaaagaaataaatctcttccacatattaaaaccacattcatcctgacagtcatagcccagctcgaaagccttcgagagtgcttttacctcccaccacatcaaatctagatttcttcctttcatcctgacacccacatgttcaacatcacagcacatgcggggagcccccagggtgcaggaggggaggagggcgctgtgtctgcaggggcgtgtgggtaaaagcaagagagggtgtaacggtgggtggggggagggtgctgtgtctgcaggggcgtgtgggtaagagcaagaggggggcagcaggggaggagggcgctgtgtctgcagtggcgtgtgggtaagagcaagaaagggggcggcgggggagtcttggagaagggaggggtgcggaggggcactgccttgtgaggtcactggtggtgatgtgggttccaagcagcaagaaaaagggattgaggccaagctggagaactgaaggcaagtcacgcacaggcagagttggttaaatgatccaatttcacaagtttctcctagaacaagcagctacattttcattttttaaaatgctgcatgaaggttgggcagtggctcacacctgtaatcccagcactttgggagactgaggcaagagtgtcacttgacaccaggagttaaagaccagcctcggcaacatagcgagaccctgtctctacaaaaaaaaaattgaaaattagccaggcatggtggtacacgactgtattcccagatactcaagaggctgaggcaggaggatggctagagcccaggagatcaaggctacagtgagccactattgccactgcacaccagccagggcaacagaacaggaccctgtctcaaaagaaaaaaaacaaacaaaattctatgttttaactaaagtcacagccactaatgcattgcatccctaagaatcattttctttcttcatgtcctccccgttcccacacacctaccttccttaccagcagaagcctgattctgcttggggtatctcccttctacctgcttaggaaggagatgcacacacgcacacacacacatgcatgcatgcacacaggcacacccatgcaagcacgcacacacacatgcaggcacacccacgcatgcacgcacacatatatgcacacccatgcacacccatgcatgcatgcacacatatatgcacacccacgcatgcacgcacacacatgcacacccacgcatggacgcacacgcacacacaccatgcatgcgcacacacagcccacccgcagtaagtagctggagcagggtaagttcaccccaatggggcttccctcccctttccagtaactaaggaggatgtggcacatggccccgccttggccaaagggagctgagagatgtctgcttagtttccatgccagtaaaataagacatgcaggattggaaaagcccctcttctttactagatatcactgtgtcattcggaatggctgcagccactttgtgccacaagggaagacatctcccacgtggcaaagacagcagagagcaaagatgaaaagcacctggggtcctggaaatgtcatcacacctctgaattaatcaaccctggaactgccatacttcttgttacatgagatagtaaatgcgtttttttgtttgtttgttttaggtaattttagttaggttttcgttaactcacaacaaaaaccatcttaaccaatataacatgcttattttatcaaaacataaagtcttttttttagaaaaatcacctatacataagttttctgtttgtgtgggatacaaaagtgtctttccactagtgtggctataataaaaaagacgaacagcagcaagtgtttatggagacgtggggaaatcagggcccgcacacactctggtgggaagagaaaatggcatagccactttaaaacaaactccagacattcctcaaaaagttaaacagagttaccatatgacccagcaattccactcctaggtacatacccaagagaaatgaaaacatatgtccacaggaaaacgtgtctgccaacattcatagaaacactattcatcatagtcaaaaagtgaaacaacccaaatatccatcaactgaggaatggataatcaacaaagataaacaaaacgcaatggaatattattcagccatgaaaaggaagaaagcactaatacatgctacaccatgggtgaacccagaaaacattaggctcagtgagagaagccagtcatgaagggccacatatgatgtgattccatttttatgaaatgtccagaacaggcaaatgcaaagagacagaaagcagcttaggggctgccaggggctgggagcactgggggtggcagctcgggtgtgccgggcttctctgtcgagtgaagaaaacgtccccaaattgtctgtagtgatggatgtcaaagtataggaactgtacacttaaactgctgaattgtgtgacatgtgaattacatctcaataaagctttcttttgtttgttttgtgtttttctttttgacacagggtctcaccctgtcacccaggctgggtgacaggtgaattacatctcaataaagctttcttttgtttgttttgttttgtttttgtttttgacacagggtctcaccctgtcacccaggctggaatgcagtggcacaatctcggctcacagcaacctccgcctcctgggttcaagtgattctcctgcctcagcctcccaagtagctgggattacaggcacccaccaccacgcccagctaatttttatatttttagtagagacagggttttaccatgttggccaggctggtctcgaactcctgacctcaagtgatctgcctgcctcagcctcccaaagtgctgggtttacaggcctgagccaccgggcccagcctcaataaagcattttttaaaaaatgaaatgttggctgggcacggtggctcacacctgtaatctcaacactctgggaggccaaggtgggggtattgcttgaggccaggagattgaaaccagactggacaacacagtgagaccccatctctacaaaaaattcagaaagtttaaaaattaggtggtgcacacctctagctccagctactcaggaggctgaggtggaaggatcacttgagcctgggtggtcgaggcttcagtgagccatgattgcaccactgcactccagcctggatgacagagtgagactgtctcaaaaacaaaaacaaaaacaaacaaacaggaaatgtgatagaatcagtggcaatctctgtgtttctgttattaacatagccaaactgagccgcctgctagttatcagaaacccaacaaggaacgacccatattcctgtgacttcttaagtaactacttaacttgcgcatttatgatactcatatcaacttcaactcccggccttctaactggtttagctacagccaaataaagtacacatttttaaaagtcttcagacgcctgtctctccatttacccattggtgccttaggtataaacagtgctgagtggtggcactggctggcaacacccagaggctgaaagggaggacactggaagctggacgcagtggctcacgcctgtaatcccagcactttgggaggtcaaggtgggcagatcgcttgaggtcaggagttcgagaccagcctggccaacatggccaaaccctgtctctactaaaaatacaaaaattagcggggcatggtggcgcatacctataatcccagctacttgggaagctgaggtggaagaatcacttaagcctgggacgcagagattgccatgagccgagatcgcaccactgcactccagcctgggcgacagagcaagactctgcctcaaaaatgaaggagagagagaaggcaccaggttccaaaagagagccgcaccaagtgtgtgcacccagcccccaggagccctccgtaaatgtgtgttaaatgaatgtgtgtgtgaacaccatcagctgaggtggtatagaaaaagcaactcctggtcagagcagggaggaactcatctaaaggggaggctcccaagagctgcagcagagggtcaccaaaggaggggaactccatgtgggattccaaccctgactggttacatggaagtgaacaggacctcgtcgaagagggagaggtctgcgttgcctccaagcagtgcttcttgaaatggtatccccccagcagccgcctcagtatcacctgggaacttgcaggaatgcacattcttgccccaccctggacccgctgagccagactctctagggtggggcccagacgtctgtgttttgactcagatgacatcggtgcaggctcgagagtgagctactcttccagggacaaccagtgtggtccttccacccatgcgtgtccagggatgaccagtgggtgctggtgttcagggtggtgtgcggacatccattcatttattgcataattattaaaaaaaaaacaacactcgctgagtatctactgtgccctaaaaaatgagaaagactccgctaatgtgtaggcagtcaaccagccctggtcagcgtactcacaggtaggcagacggccgcgcggagagcaccaaggggcagaaggatgctgcttgggggtggggaaggtggcgacgcaatgaaaacagatgaaggacaaggagaaaaaaaatcaagtgctgccagacactggcacaaagctggaagggaggtcacatctatcgagggggaggagggcaacacaggaggagaagagacagggaaaccgcctctccggtgccttccacagagggtccattgcaagcaagtggagaatcagccacatgccatgtactacgtggcaggggtggcagcccgagccctgagatcggagagcctatcccatgtgacgcatgtcagccacacatcacccaggcctgtgatgaaggacaagcgcacgctccgctctgatgacacgcgcagctggcacggacccaggagggatcatggacgtgaggagacgtcagtgtccaaagagggcccatcagcccagagaaagttgacacagaatcatgaaacataatctacttaggggacagctcactctcagcaccagtacaaaatgtagattttatccattaatacttccataattagctcaaaaaaattggactgtgttttttatttttattaatttttttaagacagggtcttactctgtcacccaggctgaagtgcaatggcatgatcttggctcactgcaacctctgcctcctgggttcaaacgatcctcctgcctcagcctctctagtagctggaattacaggcatgcgccaccacgcccggctaatttttgtatttttagtagagatggggtttcaccatgtttcccaagctgatctcaaacccctgacctcaggtgatccgcccacctaggcctcccagagtgctggaattacaggcgtgagccaccacgcccagccctccaaagcttcttcattctcccctaatcaaggtgctgctccttcttcaaatcctgccatcctaggagctcacctgaaccctattccattctgatactgcgccctacatcccaacaagttatgtcttttacctgcattctattaatgtgaaatccactctggctttcttggtgagcgtttctacatttacctgcacccctcatgaagcagggagtttcctcttttatggtgaggttttgttttgtatggagattcgtttgttctgtaacatctccttctttaagaacaaggaaggccgggcacggtggctcacgtctgtcatcccagcactttgggaggctgaggcaggcagactggttgagaccaggagttcgagaccagcctggccaacacagcaaaaccctgtctctattaaaaatacaaaaaattagccacatgtggtggcacatgcctgtaatcccagcttcttgggaggccgagacatgagaattgtttgaacccaagaggtggatgctgtagtgagctatgatcacattgctgcactccagcctgggcaacagagcgagattccatctcaaaaagataaaaaaaaaaaaaaaaaaaagaagaacaacaacagctaagagtttggcagagtttactctgcacagttcagggagggcactgagtctgtgggcataaacactcagtccctcgtgggatgtgctggatcaaatcagatcctttgctcagatactacagtcctgaagcaatcctgttactatttgctcggatactacagtcctgaagcaatcctgttactatttgctcggatactacagtcctgaagcaatcctgttactatttattttctttctttctctctctctcttccttccttccttctttctcttttctttgtttctctttgtttctgtctctctcgctctctccctctctttctccctttctttcgtttctttcttcctttcttcttctttttttttgtttttttgcgacagagtctcactctgtcacccaggctggtgtgcagcagtgtgagctcaagcaatgctcctgcctcaacctccccagtagctgagactacaggtatgtgccaccatgcccggctaacttgttactattaatgaggcctcacagataccttgatctcatggaggaactgccttgggaagtagatattaatattccagccactggaaaagtacatcatattccccaaagtaacttaatacactggcacctgctttatacatcggtctcatggtcagcatgaatcacaactcctaaactcacacagttctgaagactgatggaaatgaagattctggtttgtttttgtctttgttttagatagggtcttgctgtgctgcccaggctggagtgcagcagcatgatctcagctcactgtagcctcaacttcccaggctcaagcgaccctcccacctcagcctccagagtagttgggactacaggcacgtgccaccattcccatctagtttttgcattttgcagcgacaggatttcaccatgtgaaccaggctggtcttgaactcctgagctcaagcgatctgcccaccttggcctcccgaagtgctgggatgacaggcatgggattccaaaccaagattcttaatctcaaaattatgaacaagatcctgaagctcggtgatcacctcaggatctctgtccctcctaagaggctgtaacagcaccgtccacctcatccctctccgctccacaatctacaaaatctctatgtccaatcttatcttgccaatctacaactgtcttgtactacaatatactctaattgttaatgttggtctggtaggttcgcttttcataacagctttatatagagagaattcatatactgtgtaattctctcgtttatagtttataattcagggaggtttcgcacacagagttgtgcaaccatcaccatagcccattcgagaacattttcatcaccccgaaaggaaaccccatccatacccatcggcggtcacctcccatttcccttcagtttccccagccctggccatcactaatctactttgtgtgtatggatttgcctgtagttctagagttcctagaaatggaatcatataaaacgtggcatttgggtttttgttttgttttgttttgagacagagattgctctgtcacccaggcaatctcagctcactgcaacctccacctcctgggctcaggtgatcctcccgcctcagcctcccgaggggctgggaccacaggtgcatgccaccatgcctggctaatttttgagttgacaggattttgacatgttgcccaggctggtctcgaactcctgggctcaagcgatcgaaacgtggcctttgtggtctggcttttttcactgggcatgttttcagtattcgtccacgttgtcacatgtatcagaactccattcctttttaaggctgaatcgtatgctatcctacagaggtgctacgttttgttgatgtgttacttgttttgtttatgtgttcatcagcagacaggcatttgggctgtttccactttttggcaattgtggataatgttgctatgaacattcctataagtttttgtgtggatgtgtgtttttcacctcttaggcacaaacccaggagtggcatggctgggccctacggtagctccgtgcttaaccttttggggacctgccagactgtcttctgcagcaagtgaaccatttcacgttctcaccagccgtaaaggggaaagtctgggaggctcccgagacaagaccatggtttcttcgtgctcacatcttcaacctccagcaggtactccaaaattttccaccagtgcctgcgtgccaaggtggcttccaaagagagagcaaatcaagcctggccacaggggaccagggcacttcccagaacagtcctctccctggtgggatccttttgttccctggaaaagccaaccccccttaatcctgggtagttttacctacccacaggcttgaattacatcctaacaaacagtaaaccacacttgctgggactccgtgggcccgagggctgcttaacagcttggcaggcatccccggcagccactgtgacccagctgccctacaggccattccaagctcccccaacaagggcacttttcaggtgaactcatacaaatgtgtgccgagcgatacccctgacttggaggggactccagctgaggtcagccctggagcaggccccccacgccctatggatacttccaagcccaacttagcaaatacagctggaggcgtccaacctcacccagttgttcaaggagggaccttgccccttcctttgcctttaaggatgaacagattttttttctacttagaaactcaatgtgttcctcttctatcctaaacactactgatgttcggtaatgcagacatgtttacatgctatttcttgttttaacaacatgaaaacaaaataaaaatgaactatgaactgatgacagtgtttgggagttgagctttttctgtggccaacgctgcttttaaaaacgttctatattaaggaagtgctgtgggaacactgctggccgtggaaaccgtcccacctccctgtgctccgaagccagccagcaggcagagtcctggctgggcacgagacgctcagggctcactcgaccccacggaaaccagagggaagcctaattttatcacgctgtatttagacggtgtggattcatttgaacaaggaagttcctagagttgttgagattttttttttttggtcaatgtttaaatactacttttttttcaagcttgccctagataccaactgtttatctaacacacaattccagtgttgccaagcctcatgccaatttgaagggaacagccaaaacttatgcattcatataaaaagagtctctaggctcttatatctacattataatttttatcctaatcacaaaactattccgaatggtagtgaacaaagtaattatttcaatcaagaaacataatggccagccacatctatgaccaaattgacctaagctttcagatgttttccaaaacatcggactgccacaggtaactttttacagggtcttcatataagttcctattttattattttattttattttattattttttgagacagagtctcactctgtcacccaggctggagcgcagtggcatgacctcggctcactgcaacctctgccttccaggttcaagcgattctcctgcctcagcctcccgagtagctgggattataagcacgcgccatgatgcgcagctgatttttctatttttagtagacacggggtttcaccctgttggccaggctggtctcgaactcctgacctcaagtgatcctcctgcctcagcctcccaaagtgttgggattacaggcgtgagccactgcacccagcccaagttcctcattttaaaagtggcagaggtttgtcaaaaagttaaacagagttaccgcgtgacccagcaactccatgcccaggtatgtgccccaaagaactgagaaaacagatactcaaacaaaaacgtgtacacgagtgttcccagcagcaccatccacaatagccaagaggcagaaacaaccctaatgtccatcaatggaagaatggaaaaacaaaatgtggtttatccatacaatggaattttatgcacccataacaaaaaggaggtactactccatgccacaacatgaatgaaccttggaaacatgctgagcgagagaatccagacacacaaagccacgtatcctacgattccaagtataagaaacgcccagactcggtaaatcctgcagatgcaaagtgcagcacagcggctgccaggtgctagggcttgggagctgggaagtggctgcttagtgggtgtagggtttccttctaggggtgatgaaaacgcttcggaattagacccaggggatggttgcacaacactgtgaatgtgcgatatgccactgaactgttcaccttaaaaatcattaagttatgtgaatttagcttcaattaaaaataaagcaggctgggtactgtggctcacgcctgtaatcccagcactccgggaggccgaggcgggcagatcatctgaagccaggagtacaaggccagcctggccaacatggtgaaaccctgtctctactaaaaatacaaaaaattagacaggtgtggtggcgggtgcctgtaatcaccggtacttgggaggctgaggcacgagaattgcctgaatccaggaaacggaggttgcagtgagctgagatcgtgccactgcactccggtctaggcaacagagcaagaccctgtctcaaaaaacaaacaaacaaaagaaccaagtaggaagaaatgtggccagttcctcctgggcagtgttgtacagaacacaccaaatttctacagtgactcctaccagacgtttcttgggaaagtaagcaaagtcctttcctgaaattctggtaaattttcataaaaatcaatacttccctaatttaacattcacattttagcttacagtataactagttatagaattgttcattaattctaattgactttcgattatacaatctaatatctaatttccattttctatttctagtacataagcaaaagaaatgcccttttggtcttatggaaaacgtgtcctatttaataagacacaaatttgattcaaatttctctttctcctcctcccccttaataatacactaaaaataactgtaataacatcttacacatcctgaacgcctgtacctagcaacctcacttactcagactatagctgacaactaaaaacctgcacaaaggctgactccttagccctttccatcaaacgatatctgcaggctgaacgagcttaattacttgttggtttggttttttaatgtaacgaagtaaaaaccaggagcaaatgtgatacaggaaagcacaccaacagctacatacatggatagcaaaagaagccaaaaaaattattttttaaaatgtaagaactggaaaaacagaatgatctcagtttttttaaaaaagcaaagattcctatttttatagagaaattgctatattagtaaaagccaaataacaagaggcaaaaataactgagtcatcaagaaaattacctcttatttggcacagtccatttttatgaaagtgctttatctatttcagaaacataaaatcaaatgtttgaattggttaaaacagaaaattatctgattgattaaaagagaaaatcctctgctcttcagaaaactcaaccatccagaaagtgctatcactgacatttatatctaacaacatggcaaatgaggttggtttcatattcaaccatttgctgtccccgaagctctctattaaggatctggctgatcagaaaacttaatatttaatcaacctagagcaggcctagaaaagaggctactgtttaaaaacaaacaactgattatataaaacatttacatcaaattataattcagtattaaatctcatggaatcacgcctttcaggaaaacgtctggacactagtgaaaatgaaatggctaaatctcaatcaaagtatattattaagtaataaaagattttatcattcaactttttttttgtctctacataaaaaaagtatttttgtctctacaaaaaatacaaaaattagtcagtcgtgttggcatgcgcctgcagtcccagctactcaggaggctgaagctggagaatatcacttgagcccaggaggcggaggctgcaatgagctgagatcacgtcactgcactccagcctgggcgacagagccagacgctgtctcaaaataattaattaattaattgtttaaaaaatcaaagaatagcttaaaattattactaagctaagaaccttgctgctattacttgttcaggaaagctccacacaccataggcagtggtgctaaatgcaacagaagccttagtgcgaactggaacttctcccaggagtctatggaattggaaacttaatagctactaaatacagtaacatcatgactggagctatgaaagcaaacatttccatttgaacttcaagtggcagaagggacaaagttgataccttagactcatcagccctgaaagtgttcctaatcacaatttctttcaggagccagaaagaacacagcgttaattatgttaatccagctgagacgttcactatgaaatgtgtgttagagaaaagtcctttgaaatttcttatttgcatggtagttctgaaagtttttaacctcctgcagttcctggcacacggagtcagtcactcacttgtcctcaggaagcacaggacagcagcaggttcggaatcacactttctctgtgtgatttcacaactcgggtctttgtccaggtgagattctcactcgggtcagagggcaaaggtatccaatgacaaccctgtccttcagaaccaagtagtgttttcccatcagccgtgcaaatcacagcaaatgtcatgtggctttccagcagcctctttgctgtttgttgaggaaggataagaaaaccatggaggattaaaatcaccacattcaaattactataaagaaaaggaggccaggcgctgtggctcacgcccgtaatcctagcactttgggaggccaaagtgggacgatcgctcgaggccccgcaacacagcaagacccccatctctaataagaaaaaaaaaagggagaagaaagaaaaggaaaaatgcagacaagccagaaaataaaattgaggagattaatacaatataataatcaggcactgcagatcacacctggaacaccgcctcacccaggcaaaggaggaaaagctttcatgtgtgctcatcatttgagcaaaaaggaagaaaacacacacagaaactcaggagatccagaagagacactctgaacaaagaaaatggaaatgacagggaaccaaatgatccacatcagggattttaagagggaaattatgcttctgaatgaaaaaaataaaatcattcaaaactttttataaatctttgacaaaatccaagagtttcctttcaatgttgatgacatttaatttttttttttttttttttgagacagtctctgtcacctaggctggagtgcaatggcgcaatctcagctcactgcaacctctacttaccaggttcaagcgattctcctgtctcagcctctgagtaactgggattacaggtgcgcaccaccatgcccggctaatttttgtatttttagtagagacagggtttcggacgttggccaggctgatctcgaactcctgatctcaggtgatccacatgcctcagcctcccaaagtgctgcgattacaggcgtgagccaccgcgcccagccctctaatttctaattacaacatctaaggtagacactttccagatgcattaatgtgggggacaactagaggactaacacgtccccttgcacactcaatatagggccagtagatccagaagctcaccgtcaagagcaacaagagcaagcaagtccttcctcaacagaatcatcggtaagaacactgtcagtccaggattcactcagtcctacgagtgaaaaacttgccaacacagtgaaattcattttactggcaactaaccttccaatctctctctaaaataatgttcacatgggaactgaagcacattaaaaaaataataattattcacttcacattttctccaagccatttcaaaagtgtttctcagactttcaaaatcaaacaggattcccagaccaggcaccatgggtcacgcctgtaatcacagcactttaggaggccaaggcagctggattgcttgagctcaggagttcaagaccagcctgggcaacatgatgaaaccccatctctacaaaatacacaaaaattagacgggcatgatgttgcatgactatagtcccagctactcgagaggctgaggcacaagactcacttgaacccaggaggcggagtttgcagtgagctgagatcacgccactgcactctaccctgggtgacagagcaagactctatctcaaaaaaaaaaaaaaaaaaaaaatcaaatggggttcctctaacgataccctgctttattcaggaaacgtgatcctcaggaaaccatgtgtaaattatacttctagaactcaatcttacgtatttatatttaaaggaagtaaagaatcttttatgaagttacaaatctcacacacgccctgcaatttagtggctctataaatcggagcttccctatgctaaatgtgtctaaatgagagttcgtagttgaaacaagaggacaaagaaaaaaacacttttcaaattaagaatgagcactatgtcccaatcacgtgagaatctcagctatacttagacaatggtggagattttaagcatatctatctcaaactttatattttaccaatatgaaaaaagcagaaccagagagattaaattatttgcccaaaagtgcttgttagtggaggaaatgtattaagaccaaaagctaatttacaaaaacaaattaaattttcaaataagatcatgctataaaagtgcttccctttcagaaaccaccctcaccacacccagtttttaggcagctcattcacacacacaaaaatcacattaatgaacatcagaagcagtggcctttccttatgggaaaaagaactcatttatgaagttccagaatgcgatgcaatccacactttaaatagtaacacaatagggtacgaactaactgaatcaacatgcaataaacactttcacttaaagtgtcatagccttaatggtatattgcatttaatatccatacacaaggaaataaatcacacgcatgtggggtttcttcctttctccaggctagagtgttagaaaatgtagttaatatttcccaaacaactcaaacacgaaaataaatgattcaaaagctgctttttccccgctttggaagggggaaaaaaaaaagaacagattttaatagcattacataaaaatcctggaaattatgcacaaagactaccctggagctttgccagaaacaggcatgctggttttccatgtgtataaatggtaatcaaataagaattaccaggagctacaatattattaagataaatatacttcttgaaatctccatcttacaaagcttaaaaacaattgccagaactaggccgttcaaccccacatttcctgggcctcccctaagcactcagtcctctgtgtttctgccctgcgccccacgccctcagcgcagcacctcggagcccacagtcccaagctgtccacactctggcgcccctgggcccattcacattcccaggcaccatgcgctggtcagccctctcggccaccacctttgctagagcctatcaagaccctccggagcctctatttaatgaaccactcagtcattccagcaaagcggttactgcctttcctctacctggaggcttgttctgtgtagatgtttggggtgtggtttcacacataacagggtactcacatgtggagttacatatatatatatatatatatatatatatatatatacacacacacacactatatatatgtataaatacatatgtacatatatatatatatatatatatatattttttttttttttttttaagacagagtcttgctctgtcatccaggctggagtgcaggggcgcaatctcagcaacctccatctcctgggttcaagagattctcctgcctcagcttcccgagtagctgggattacaggtgcccaccaccatgcccagctgatttttgtatttttaatagagatggcatttctccacgttggccaggctgttcttgaactcctgacctcagctgatctgcctgccttggcctcccaaagtgctgggattacaggcatgagccaccataccaggcttatatttacttatttattcattcatttatcagcaaatattatcacacatatattatatgcctggctatattcccagcgctaggaacacagcaggaagtaaaacatggaaaattcctgctcttaagatgcattccagtggcgtggaaacagattataaacaaaattaagtcaaatacatatgatgcaagctggaaaagagagtggctggcccatagctccaggaggcactgttgaaagcaaggctcctactaagggaattcctggagttgggccttctggaatgttccacagcggtcctgagggatggggtttgctgggctgggggaggactcctcagtctgcaaacatgtcatctacgttttggtttgggattttttgttttgttttgtttttgtttttggtttttttttttgagacagaatctcactctgtcacccaggctggaatgtagtggtgcaatctcagcaacctctgcctcccgggttcaagtgattctcctgtctcaatttcccgagtagctgggactacaggtgcacgccaccaagcccggctaatttttgtatttttagtagagatggggtttcaccatgttggccaggttggtctcaaactcccgacctcaggtgatccgcccgcctcggccttccaaagtgctgggattacaggcatgagccactgtgtctggcctgtaatattcattcatttattcattcattcattcagccaatattatcaggcatgtattatatgcctggctatattcccagcactaggaacacagcaggaagtaaaacatggaaaattcctgctcttaagatacattccagtggcgtggaaacagattataaacaaaataagtcaaatacatatgatgcaagatggaaaagagagtggccggcccatcgttccaggaggcactgttgagagcaaggctcctactaagggatttcctagagttgggccttctagaacattccgcagctgtcctgggggatggagtttgctgcaggactcctcagtctgcaaacaggtcatctacattttggtttgggatttttttttattgttttggttttgttttgttttgctttgttttgtttttggagacagagttctcaccgtgtcacccaggctggagtgcagtggtgtgatctcagctcactgcaacctctgcctcccaggttgaaacaattctcctgcctcagtttcccgagtagctgggattacaggtgtgcgccacgacacccggctaatttttgtatttccagtacagacagggtttccccatgttggccaggctggtctcaaactcctgacctcaagtgatccacccgcctcagcttcccaaagtgctgggattacagacgtgaaccaccacgcccggcctttttattgtttttttatcacgatttacctacattcacagacacctgcccctcaacaggcattagtgggaagatacagaaagaaattctacattgctctcaattgtaggaatgcaaattaaagcttccaaggaactcgaagatgcacaaaccgtttcttgggtggcattatttcctcatagaaacatgcatatactattcattttcttttcaaaaaagatgagggtaaactttagctcagtctctctgaataaacatatcagacaaacagaattaatgagattttaatacctataatttctcaactctttaaaaaggttactaaaagggtatgaaagttatcaaagaccactggggttgcatgaagaggactcagcagccaacttaaaggggctcccatgggccccaaatgggacaatctgagcatcaaaaatcatgtatctgtaatggaatgaaatacatcaaataagctaaaatccaagagtttatattgattcttgaaaaaaatcacctttggaggacgttaagaaaccatctcagctgggtgccttggctcacgcctgtaatcccaacacttcgggaggccaaggcaggaggatggcttgagcccaggagtttgagaccagcctaggcaacatggcaagaccctgtctctctcaaaaatttgaaaaaatcagctgggcgtggtggtgcacatgtgcagtcacagggaggctgaggtacgaggagcacttgaccctgggaggttgatatagtttagctctgtgtccccacccaaatctcatcttgaattgtaatccccatgtgtcgagggagggacctggtgggaggggactagatcatgggggtggtttcccccatgctgttctcgtgagagtgagggagttctcacgagacctgatggtttaaaagtggcagttcccccttcgcatgctctctctctcactctctctctctcctgacaccatttaagatgcgccttgtttctccttcatcttctgccatgattgtaagtttcctgacgcctccccagccatgcagaactgtgccaattaaacctgctttctttataaattactcagtctcaggtagcatcttttttgtttgtttgtttctgagatggggtctcactctgttgcccaggctggagtacagtggcgcgatctgggctcactgcaacctccaccttctaggttccagcgattctcctgcctcagcctcccaagtagctgaaattagaggcgtatgccaccacgcctggctaattttttgtatttttagtagacacggggttttgccatgtcggacaggctggtctcgaactcctgagctcaagtgatccgcccgcctcagcctccgaaagtgctgggattacaggcgtgagccatgcacctggcctcaggtagcaactttatagcagtgttagaatggtctgatacaggtggaagctacagtgagccgagattatgccactgcactccaacctgggcaaaggagtgagactcttgtctcaaaaaaaaaaaaaaagaaaagaaaaaaacaaactcagtctgtaaatggtatagaaagggaaagaaccaagcaaataaaagcatctaaacacacacggctcccaggatcctaggatttcacagtggctgagacagcaggatacgtgagggcagggtacatgacagcagggtaaatgcagagagctaaagacaggtatcgttgttttggctgttgctgccactgctaagaaaattattccaactttcagtaacactagctcttctctactgacaggtattatgtgccaagaacttttctaagaacttgtattttctcatttaatcctcgcagcaattctgtgagatgggtactagtgttttctaatacagcctttgggtttaaatactggctccaccatttagtatccctttctggctgtgtgatcatcacaagttacctaacctctctgtgcttcagtcttctcatctataaaatagagatcatctcaaccctatctgtaatacagtcaggaagtctagtacaatatttgttcaggtgatttttttttttttttttgagacagagtcttgctctgtcacccaggctgagtacagtggtgcaatcacagctcactgcagcctcgaccacctgggctcaaacgatcctcccatctcagtctgccaagtagcttggaatacaggcacatgccaccatgcacggctaattatttattatttttagagacagggtctcactatgttgcccagactggtctcgagctcctggactcaagcgatcctcctaccttggccttccaaagtgctgggattatagacatgaccactgcacctggcctgtacagattatttgatcactgtctacttccctttctaggcgtcatgccccaagagggcaggggccacccctctatctccagaacctagtcctcgccttgccaatggtaggaacccattcaatatttaatgaataaacaaatgagtttacagtaggatacagtacagttgaaaaaaaccactctagttcaaaccacggccaatagctggagttgcacagctgaagatctgcttataattcctcaaccatcgaggggcccatcatcttaagaacctccaggctctggggaactgaagcagcctaggaacgagcctgctgaacccccgagggttttcagtaaagaggctgccaagttcggcagctagagtttaaccagggcgagctatcagtattttgtattttggacacttgccctttttattacgagaaactgacacaatcacagtccctagtgtgttctaggtttcggtactgaacgacacaagatgtgcgccagattgagcgcaggaagaaagaaacaccctttagtgcaatacgaaatgtgactcagccagcggggagcgttagttattgatggaatggctgtccaccatcgagtcactatgcaaataagtgcttttcttgcattatcccagttgattctcccaacgaccctctgacagagacaccatcattcctataaattgcagcgcccctaggtagcttgcccaaagtcccacagttaggaaaccatacaaccgagaattaagcccgaatgtatcagaaatcaaaatccaagcacccaaccattcaagggtgagcccttccaaaaaaaatttacagaaacaaagttgatggttgtttctttgtttgtttgtttgtttttgagatggagtttcgctcttgttgcccaggctagagagcagtggcatgatctcagctcaccgcaacctccgcctcctggattcaagcaattctcctacctcagccgcccgagtagctgggaccacaggcatgtgccaccatgcctggctaattttgtgtttttagtagagacggggtttctccatgttggtcaggctggtctcgaactcccgacctcaggtgatccgcccgcctcggcctcccaaagtactgggattacaggcgtgactcactgcgcccagccatgtgtttgttttttgaggcagagtctcgctctgtcgcccaggctggaatgcagtggtgccatctcggctcactgcagcctccgcctcccaggttcaagtgattctcctgcctcaacctcctgagtagctgggattacaggtgcccaccaccacgcctggctaattatagtatttttaggagagacggagcttcaccgtgttggccaggctggtctccaactcttgacctcaggtgatccacccacctcggcctcccaaagcgctggtattacaggcacgagccatggccagctcgaagttgatggtctttatcacacactttgaacatgagcaacaaagatttaccagaatcacaaaagatttttaaggattttgtaagaaaaggtcaatgtatgaactaaggtcacttgctatttccacaggcaatatgtaatgggtgtgacaactccaattggcgttgtttcacacacatgagaatgcgtgtttgggtggcacatacaaaaccctcagtcttcccatcttgcagcccagctagcgaagcagtactcaaagtgtgatccgcagatccctagaggtccttgaggcctttgcaaggcatctgtggagtctaaactatttgcacaatgacactaagacagcatttgccttcttcagtgttgacacttgcagtgacagtgcagaagaagccatgggtgaaactgctagtgcctgagcaggtcccgatgcagggaaaccaaactgcactagccctcagcttgtccttcactaccccacacttacgaaaggaaaggcagacagcttcacttaagaatgtccctgatgggccgggcatagtggctcacgcctgtaatcccagcattttgtgaggccgaggtagggagatcacctgaggtcaggagttcaagaccagcctggccaatatggcgaaaccccgtctctaccataaagacaaaaattagccgggcgtggtggcacacatctgtaaatcccagctacttgggaggctgaggcaggagaatcacttgaacccaggaggcggaggttgcagtgagccaagatcacaccactgcactccagcccgggcgacagagcgagactctgtcacaaaaacagaaaaaagaaaaaaaagaatgtcccagatgaagctgtcaacatgaatgattggttaaatcgcaagcttgagtaggtgtcttctgaatagtctgagtgatgaaatgagaagcacgcctacgacgacgctgctgcccatcaaagcacagcggtcctggagaaaagcagctgtgcagctgtttggattgcaagctgaactggccacctttttggtagcacattatttacacgtgacctacagacaaaccacggtcgttcaggcttgagtacgggcagaccattcctgggaatatgaatgagtctgtcgcttcaaggaaaataactgacagtatttgccgccaatgataaaaaattccagttttcaagtagagttttggaaaacttacatcagccactgtgatgaactcaacatcttcagactattagactttactgacgtcaacatgtggaagagctgcatcattcaagagaccaatattttccaaatgactagtgcatgacgttataaaatcacacctgggtaaaaacccaacagcatttaatataatagtgtacaaaaaaagataataaaatttcagattccatattgcaactaacatttaagaaactaccactcaaaataaaaaatcagcggggtgtggtggtgcatgcctgtagtcccagctacttggtaggccaaggcagaaggatcacttgagcccaggaggtcaaggctggagtgagctatggtagcaccactgcactccagcctgggtgacagagtaggaccccatctcagaaaaagaaaaagaaactactactcacttgttgaatgtttctacagaatcaaagaaaaatatccagaatcacataaaaaggctatgaaaatgctcttccaactaaagccagattttctacacatttttcaacatattgcaacaaattgaatgccaaagcggttaagaaaattcagcgaacacacttaaaagtgttttaacacggtagatttctgttgtgtacattttatcactcaaaaaacctcagccgtgggtcgggcgcagtggctaacatgctgaaaccctgtttctactaaaaatacaaaaaattagccgggtgtggtggtgcgtgcctgtaatcccagctactcgagaggctgaggcaggagaatcgcttgaacccaggaggcagaggttgcagtaagccgagatcgtgccactgcactccaatgtgggcaacaagagggaaaaaaatccaccaaaaaaaaaacaaaaaacttcaaccgtttattaatccagacattaaagagatttgcaaaaatgtatggcagtgccacccttctcatcaaattttttcattttacaaaatatagttacttttataaaaatgttacttacattaacatgcaatgggtgaaatgaattactattttgaaataaatttagaaaagatttttaagcttctcagtttgtttcaatttctaatactgtaaatatcaatagacaacctatataaataatgcacataagcctgggaaacatagggagacgtcatctctacaaataatttttaaaattaggccgggcatggtggctcacacctataatcccagcactttgagaggctgaggcgggcagatcacttgaggccaagattttgacaccagcctggccaacatggtcaaacaccatttctactaaaaatacaaaaaaaaaaaaattggccgggcatggtggcatgcatctgtaatcccagccacacgggagactgagacacgagaattccttgcacccaggaggcagaggttgcagtaagttaagatcacaccactgctctccagcctgggcaagagtgagactccgtctcaaaaaaaaaaaaaaaaaaaaattagttggatgtggtggcatgcgcctgtgtcctagctactgaagaggctgacatggaaggatcatctgagtgcaggaggtcgaggctgcagtgaactgtgactgcacactgtactccagcctgggcaacagaggaagaccctgtctcaaaaagaaaagaaaaaaaacctacagaaacaacaatttctactggattagaggaaggcatataagctaggtgcagctatccctgactgtcggggcccagcatttcaccctgtttcccagcttctgccctctaggtcacactactgccaccactactgctacaactcattctgcctccactgccaccagcagcctctagcgggtttgatgttcccacctatcccagaacattgagccttcccacttaactccgcagaaaggatgccaggaattttttacaagtgcaatgctagcaaaggctggggaaaatgagacaaaaaacctgatttccaagagcagacaagttttacaaggggcagtcttcttcgctgaagttgactaaaatttagccacgggttggcttggctggtgtggttcactgggtacatccacaagactacaagaatatcactgctgtctgcagtcttcccaggggaggaccaccctacccttggcccacaccacggatggcggccccacatccaccctctgatgcagcccagtcccttcccttctgttccgcggcagcaccggtgcctggccacttcccttgccagttcccttcctgtttcaaaaactctcatctcttcacaaaattccctccagggatgctagttcctgttggaaaaggtcttgaggtgtgtcacaggcaaagtacaaatgatatgcccagggccagatggatgacaggcccctaagctcagctagtccagagtcaggaggggacctgcagaattctaatggtgaatgattacactcttacagttttggaattccagcaaaaacaccaatactaaaatcaccaaccaagacaaagacgagacttacggcccacgcaggcttctgcacactctgtgcccagacatggacagattaatgtgggttggttggttggtttttttccaagattactattccacagcaaagtacataggcaacgctgaccaatatgcagaaacataattactatctcaccaagctggccagaagacaaaaatcttgaaacttcttgacttgctctaattgttccttctccatgtttcccttccttaggcattctacctgaaaagacagccctcccttccttcttcatcccattggcaattcagcaaaccttaaccttctcttgctttaccagaggttacttctactcgaaagcttgtcttcagaattaacagctgtgtccttgtcactgtaagccaggtctcaaagagcctgaacaaatggtcactgggggcagcttgagtgtcgactctactgctgttttctgtctcccaccccagctgtggaggggaactgtgtgcctcatctcatctctgccatttgctatctgagaggctgtatttccacgtgcataacagatcctgctcaagaatgcaggtcaaggctgggcgtggtggctcacgcctgtaatcccagccctttgggaggctgaggctggtggatcacctgaggtcaggagttcaagaccggcctggcctacatggtgaaaccccatctctactaaaaatacaaaaattagccgggcgtggtggcgcacacctgtaatcccagctatttgggaggctgaggcaggagaaccgcttgaacctgggaggcagaggttgcagtaagctgagatcacgccatggcattccagcctgggtgacacagccagactctgtctcaaaaaaaaaaaaaaaaaaaaaaaaaaaagaatgcagtgcaggtcaacacagaatttccaagcaaggagactgagctctgctaacgggttagcatcccagtggcaagggttgcaggcttaggtggggacaagctaacgggggaaggaaggggaacacctgagcatgcaactgaaccccaaaccaacacctggctagggttctgtcagctggcaggcccgtgctcagggttaatggggcgcccagatttccggcatgagacaggtgtttgtttgcagaggctaacgcatacagaatgcctccgtccactgtcggtctgtcggcccaccagacagggtctacataggaactcctctaaggcaaaggtctcgatcacagaggtggccaacaggtgacaatctgcccaaatgcataccagcgggtctcctccccaagttgctccacaagcataaagtttggctggggaaaaaagcttttttaatttctgcatctgacaatgtgatcactccctggtattcccctcttcagagatatgaccatgggtgtggatgagagcggaggagcatcttcattctgtcttcctaatatttacacgggaaaagaagatgcctgtagatattttctaacagtttcattttctgtctttgtgaccctgtatctatgacaggaaaagccaacagctcgagataacacgtctcaccattttttgcttgtggcccaaggcagaatacaacagccacggttccctcaggcctagcggtttcatcccaaatgctgtggaaggtccctcaccttaatcagaccgtttcttcattttttttttttttttttttttttttttttggcgacaaagtctcgccctatcgcccaggctggagtgcaatggcacgatctcggctcactgcaaactccacctcctgggttcgaacgattctcctgcctcagcttcccaagtggctgggactaaaggcgcctgcgaccacacccagccaatttttgcattttcagtagagacagggtttcaccatgttggtcaggctggtctcaaactcctgacctcctgatctgcccacctcggtctcccaaagtgctgggattacaggcatgagccaccacgcccggcccatttctccatatctttaataactgtccctcacacttttttttttttttttgagacagggtctcattcttgtcgcccaggctggagtgcaatggtgcaatcttggctcactgcaacctccgtctcccaggttcaagcaattctcctgcctcagcatcccgagtagctgggattacaggtacctgccaccacacctggttaatttttgtatttttagtaaatatggggtttcaccacgttggccaggctggtctcaaactcctgacctcaggtgatccgcctacctcggcctcccaaagtgttgagattacaggcatgagccaccatgcctggcccctcactttttagattatttccaaaatcctagcagtatgctaaaaattcctgcaaccttctcccagtgactggccaccctagataagatttctcacactcgtacaccccatctgctgtatccccttcctgctttatgtttgttcacaaaacactttttctattttacttatttatggtttgactcccctgttgtcccctctattagatctcccctatttgaaggcctggtttttgtttcttagagacagggtctcactctgtcgcccaggctggaatgcagtggtgcaatcacggctctctgcaacctcgacctcgtgggctccagcgatcctcctatattattgacttaaaaattcttgtcccctattacaagagcaggaattgttgtctgttttgtttacggctgtattgccagaacccagaaccgtgcctggcacggagtaaatgatttgctgaatgagtaagcaagccaggggttccgggcctctgtactctgcaagtccatcctgcattctccattcataccatagcaacttcaaaggcccctcacccattcctgactccacattgtcgccaagtcacttccagaaacttaaaatgccatttcccattcacatggtcaagcccttcccctcctgccagtcgtttgtttaaatctggcttgcagtcccatcaagctgctcttcctaatgccactcagatcccatcacctccatcactgctactgtaactttggattgggccaccatcacccctacctgggatttactcgacacctcattaatctctttccaacccacactcactagctctgaaagagtgaactttctaaaactgcaagtcagatcacctaagccccctgttgagtggttccctgacacctatggggtcaaatgcaaactccttcccacgctacccatggccttccttgtcctgatgaacaactaacaatcgtccgcccccacagagaagcacagggcccagccatacccacctctccgctctgccctggtgctcttctgtccacctggagagccacagcctgatctcaggacccagctccagcaggagccccctctaaagcgctccccactcccgaacatactccacaacatttttaactgtgagctcacggaggttgggaactattaacgcaggtcagacgcgccccaaagtggggccgagcccaagagggttcttggctttgcccaggaaataattcaagggtgagccggtggcaggaaagaaaacacctttattgaagaggcaggcagtgttatacggctccatgactgctcctgcagagctgggctttcccaaaggcggaaagtagcagctcagggcagttttgcaatcatacttatacctacttttttttttttttttttttttttttgagacgcagtctcgcctaggctgtcgcccaggctggagtgcagtggacatgatcacagctcactgcaacctccacctcctgggttcaagcgattcttctgcctcagcctcccgagcacctgggattacaggcgcacaccaccacaccaggctaatttttgtatttttagtagagacggggtttcactatattggccacactggtctccaactcatgaccacaggtgatccacccgccttggcctcccaaagtgctgggattacaggcatgagccactgcgcccagccttaccttatacctacttttaatttcctgtagagtaaaggtaggcttaggcagacacttctaggaaaagggtggtggcttttgggttgtcaggtcacggccatggaaagaggcagtaactccgggtgtggccatggcgacagtaaactaacaaggcacactggtgggcgtgccttgcagaacgctgcttctgccccatccctgtatcagctagtcctcaattcggtctggcatctgaaccccgcctctggagtcgagtcccacctcctacctcacgatcacggatcctgctccacgatcacggatcctgctccacatccacagtgccaggtgcacagtcagtgccaggggcacgacacagatttcagagtgaaggaatgtgcagaaatcatgaaactacccttctgcaaagcctgttcggataaatttgaatgagaggagcttccttctgtgctcccaggctagttctagaagccccttctcattctatggatgcccattcctgcagggccgctactggctgctttttaaccctgggatcagaaaagggggtaagagggaaaggctaatacacccagtattggggttttttttgtttttgttgttgttgttttttaagacagagttgctctgtcgcccaggctggtgtgcagtggcgcagcctcggctcactacaaccttctcttcccgggttcaaacaattctcctgcctcagcctcccgtaatacccaatattgtatagagaaaacatctgccaccagcccaaaggcagaggctaaaatcgatcttacatgtagataagcttaactatgtgtgtgaaagggtcttctacaaactgtgctgtcatctcaatttagctttgtaaggacagtttccaaaagggccaggaagttgtgtagacatactctattcctggagtcctatccacaaaggtttgtaaaatgagctcaagaaaacaaaatcgtggtctcagagaaagagctaaaggaaagaatatcacttttaaaaaatcagcagctaagctaagccttctatcttccctactccctacagtactaaaacttttataaatatacaatgtacacaaatgtcaagaaaagttaatttaccaaatttacactatttgaggtttaaaaaaaaaaaaacacaaactcactctagcattttttttttttggctctgtgtctgagacccctgatctacaaacttaaaaataaaactactcataaattcacaaaataggtattcaatgacttggcaatttccaaacatatttaataattacaccctcttcatttttgaaattcgagtaatacagcatacaaagtacagcttacaaaacgttctcattgtcctctgggccaacatatttaatttaacgtactgccgcccagctccaccgtcccacagtctccaaggacagagctcacaacacctgggccctaaaaatgccaaggtggcaagcagggggttacacccacagccccgtccactgacaccttcagactcaagagcgagtgccaccgccctaaacggaaagacactcatcacggcagcatctttcaagtgaacagaaagtgtagtttctgaccttgttaacatagtccttaaagtgctctaggttaggggaattctcgggtgaaaatagttttcgtctacatccataaaatcttcaacagcaaagttagtaaaataaagaaaaatcagaagaaagatgatgttcccttgccagagaacaaatacataaaagatacaggagctcagatcacaagccagagaaagagaatgccaactggacacataggatgatctcacaccaacgacctatgcaggccctacctcaaccactggacgtctctgactgacactattacttctgccgtctctgattgaaactattacttctgccatctctgattggaactattaattacttcttccgaggattccctttcctgaggcttttaactgtttaagtatgcagtgtgtggggaccacaaaatacaatacagcttcacaaaagcaggcttttaaaaaaaatcagtgttattttctctacatacttccacaacagatgttcccctcaatcctgaagattttagtaaaacataaggactgtttaaaaaggaggaagtgggggaagaaatgtagcagattacttaaaatctttctttttcgtcctacttattttaatatcattttccagatctcaaagacttttgtcctatattagaaaaaacaagcagcccagtaaaaacatcaagaatagcagtaaggagcttcaaaccagggaccaggcaccagatccaaacctgagaggatgagggaggggaataccagctctccggcaggtacgtttctcccttccaaatcacctggtggctggagaagctcaatatgaagctcttcacttaaggcaaatactatgataataaaatatccttaaacaaatgatggctgaaagctgaaaatgcaaactttttttaaaaaaaaaaaaagacctagataaaagacagtgtgtactcagaggtaagtaactccgtctaattctccagagacctgcaggactgcgccgacttcctatccctattttgaggataagcaaagtgaggcctagagaggagaaagattttattctccacgttttcgcaaaaagggcagagagaaacatttggatgggacttcagggtgaccaaatgaatgcaaaggcaatttccttaagtgctaaacagtgctgaatgctgaagggctccatacccttacattcaccggacgtgcccccacatttcagccaaccagtggttatgcacgttcaaagttctccttccttctaaaggtcgcgtctaggtcatctctgcacagcgtccctttctgcagtgtgaacagatctgtgatatttgacccgctgaaagaaaagtcacactgaccctgagatccccccatggtaaggcattctgagatacctgagctgtctgcagacactgaggctggaagcttttttttttaatttaatacaatcaggatcagggaggggggatgccgaggtaaagcagtgcacatacctttcaactggtcagcaaccacgctctggcccagccgttcaataactttcccatcttccatttcgtaccggtcatctaagtattttgcggtggcctcagaaatgtgaactttgccggccactcccagctgctccatgagattggccaggttcacatcgttggaccacacgtcaaatttaaacctcctcatgcccaggatgccgcaaaggacggtgcccgtgtgcaccccgactctcatgttcaccatctccttcttctcctggcagaactgctcgatggccttgatcatgcccaggcccatctcgatgcagcagtaggcatggtcggcccggggctcgggacagcccgccacgcagtagtaacagtctcccagggtgctgattttctcacacttggtctcctcacacaggcggtcgaagcgaccgaacagatcgttcaggagacccaccagggcgtgggcagacttgttggcactcatcttggtgaagcccacgatatctgcaaataaaatactgacttcttcgatctgctgcatcttaaaagggcggaaggctataggagctttttggatggaagactttttcttcctgttcttggggctcgaggtggcatgcctcttgacagaattctcactctcctcatctccctgcttcattaagtcatcggctatgattcttggcatcacggaatgaatcatcctctctttgagggctttttccacttccaggtccttcccgtgcataatggattgccccaccttgaggaaggtgctcctggacctcacctgggacatgacgaacaggtggaccccgatggcgtggatgcagccgtggagcagccccctgctcagcagctcccagtgcagggccccggctccgggcgaggggaagcaggcttcatcccggaaatggtagccaaaggtctcgaaaaggacagagtaggccacccccagacacaaactcaggtacaaaggtaagtgcatgacggtatagagcaaaaagagcacttcgatgcacatggagaagctccccacttgagataagcaagtatctgtgggccgggctgtggccgtaaggttggagctgtcgccgcgtcctgagacaggcgtcaagacctggaactgcgcagccagggtcagggcgaacaccagcagggtgagagccagcgaggtccacgcgtaatgccgggcgtacagcttggtgaaggtaaacagaaagaagcccacacacaccaggaggaagcacagcgcgggggcgaccatgacgatcagtctggatctcatgtggaccgcaaaatagatgctccacagaaggcaggcgaagccgatgtagaagagcgcataccggaaccggcgctgggtctgcgggaagcagcgctccaggcaggcctcctccaggttcaccgagtcgaacttggggtcccaccagcggctggaggccctctcgaacagctggggcagcttcttctgcctgcgcagccggcctccgccgcccactcgccgggggacgcccccggagtccccagagctgctgcagctagaggagatgctgtatttgcagtgcttggggtggctgttggaggacagctgcttggggttgatcttgacgcgcacgctgttgctgtccccgctggagtcgcagctcacctcggtgctgtggtgatgcagcagctgctggtggggtggggaagccatgttgtcgagtcccggggcctgccccggccggggtcaccagtacctgccagcaaaacggggagagttagcggcgctcccacctaggcatgcacgcctagaggcccgggacctgctcctgtcctaaggggcggctccagcacgcgacctggacaggcaccatctgttcctgtggttcccggctcagcggtgctcccaccgcccccaccgcccccaccttcgaggcgcacgagaaccgctcgggacggacctagaacgcccgggggtccccgccgcgtggccgccgtggctccgggaccgctttgctcgctcgccttccgcgcctctcgccccgagggtggcctccgcgccgcgcggcttctcctcctcgcgcgctcgcctcctccagctgcggctccggagggaagttcagaccttgagcgctcccagccccgcgagccgcctgcgcacaaacaactccgctggcggcgcggagccctccatcctgcaggagccgcgctccgatgcgtcaaaggcggcgcgcggccggccccgggcccggaccccgacccggagcagcgagcttcggcgggcgcccccggctcgcgctccccggccgccccccgcgctccgggccggccctgcccgcggcggcgggcgctgggggtgggggcgccccgggctgcgagtgcgcggagcccgtcggcgcggcccgtctagtggggcctgcttccccccgagtgcgccgccgctcccgccgcggccgcagctgtcccgggaccgagcgcgtggaaccacggacgcgggcccctcgccgggcggcggtgcagacgctgccgcagagccgggctcccgcgacgccggccgggacgcccgcccgcccgcgcccacgccgggggccgcctccccgagctagagatgcggccgccgccgcgcccgccgccgtgtcccccgcggccgctgcctcatgtcggaagagctgccgccgccaccatctccggcccctgccccgcccgctgtcactgacagacgcgcgcccgcgccgcccctcgcccagccgcagcgcgcacgcgcggcccgcgctcgccgccaccgcctcctggccccggacacgcgcacgggccgcgcgccgccccgccttggtgcgcgcgctgggctggggctgcggggcggggcggggcggggcggggcgcgcgctcggctccgccccccgccccgggcggcgccgcttctaggcggcgggctgtggccgctgtccgcgctccgggcgctgtgggcccgccctccctcggcgtcccagaggccgcgcgccgcccggggtcccgaccctgcggagagacctgaaggcgcctgccgtggaagaagccgctggccgcaacgtttgggaaatcaaaatgttgccttcccactcggcacgcctttgggataaatcgaagtttccaaccgttggatttccctcccgggaggctccccttgctctgtaagcaatgaatgcgggccccggggcactcggcctgccctggacctgctcacggggcgaccttcacgggcctagcctccaaagctgggcccaccgacgaccacgttcccccgccccaggggtagtttaccttgctgtccttgagcccttctccccctcctcatgaactactgcttttccttttacacaaatgagactttcaaaggagtccgcgtcccataatggcagttgtgcattggcctccataaacattgccacgtgtaaataaaatcctattctctctagcatgcagatcccgaccccttctccccacactccacagtgcctcctgccagtcacggggctctcttccatcccctccctcgcctcccaggcccagcgccggggcccacaccaggtctcactgttgaattagaaaataaaagtaaaatgtgatctgtccatgcaatggaatattattcggctacaaaaaggaatggagcaccgatgcatgctgcagtgtggaggaacccgggaaacgttatgctagtgaaagaagccaaacaaaaaaggccacatagcgtatgattccatccagatgaaatgtctcgaattggcaaatccgtagaggcgacacagattggaggttgccaggtgctaggggaggaagataagcagcttggggtttcgttttaggatgatgaaaaagtctagaaatgatccaacaggatgaatctacatactgcccttgaatcatacactttaaagtggtttaggccgggagcggtggctcacgcctgtaatcccagcactttgggaggccgaggtgggcggatcacctgaggtcgggagttcgagaccagcctgaccaacacggagaaaccccatctctactaaaaatacaaaaattagccggacgtggtggcacatgcctgtaatcccagctactcgagaggccgaggcaggagaattgcttgaacccgggaggcggaggttgtggtgagctgagttcgcaccattacactccagcctgggcaacaagagtgaaactccatctcaaaaaataataataaaataaaataaagtggtttaaatggtaaatgttatgttgagtgtattttaccacaataaaggaggaaaaaactaaaagcaacatattgtggtggtattcctgcagaagtgtgtaatctcaatccaatcgcaagaaaacaccagacaaacccagattgagacctgttctacaaagtgattaaccagtacccatcaaaagtgtccttggacactttgggtcttgaaagacaaagactgagaaactgtcacaatctaggaatcgtccctaaggggatagatacaacaactaaatggaacatgggatgctggttgggaacatggaacaggaaaggacagtagcaggagagcgggcaaaattcacataagatctgcaatttcctggttctgatcctcttactatggttaggtaagacgttaacatttttaggggaagctgggccctgtgcagtggctcacacctgtaatcccagcactttgggaggctgaggcagacagaccacctgaggttaggagttcaagaccagcctggccagcatggtgaaacccccgtctctactaaaaatacagaaattagttgggcatggtggtgtgcgcctgtaatcccagctactcaggaggctgaggcacaagaatcacttgaatccaggagacggagtttgcagtgaaccgagatcatgccactgcactccagcctgggcaacagagcaggactccatcttgggggaaaaaaaattaggggaagctggatgtaggatacagggaaactcgctagtatttctgcaactcttcaagtctaaaactatttcaaaataagtttatctaaaaatttaaaaaataaacctttaatgaacatcaattctatgccaggcactctcacatacgaggttcagaaacgcatggtgtgtcacatgcattcgcttagtaaatgggataacaatagtgaactaacattgaccgaacacgtcataaatgccagaaactactggacattttcacctgtgacacatttggtcattgccacaaccctctgaggtagatactattgtcccttgtttagagaggtgaaacccaggattgaagagaaacgcaccctaggtctcccactaagggtgatgagttcagatggaaaaccaggtctcagaattctgaggccatgacgccttgtgtgaccctggcactaccctctgcaagcctcacgatggcccagcacagactgtacctgtctcatccatcagcccaactggatgggaggccctcagagccaggactcacagcttccgtcttcccttgctggctgcaacgctgtgctccctgcttcctggtttcctgaaacgatctgaaagcttgcctgtctgcacttctttcctcctccctaaatcatttgtggtaacttatgtgtttgtaagttagtcacgtcggatttttagacacaagtaatggtcatactcacctccctacttctctggaagcaattcggccacattgcctgctgtggaaacctataagctgacaagcctccccagtctccaggtcagggagtgaatcatgccatcaaccccgggggactggggctgtggtgccagcactgtgtgtcaggccctggaggtacaaggatatgccatccatatcttttcttttcttttctttttttttttttttgagacggagtctcgctttgtcacccagactagagtgcaatggtgcgatctcggatcactgcaacctttgcctcccggggttcaagcaattctcctacctcagcctccagtggagctgggattaccaccatgcccagctgatttttgtatttttagtagagacagggtttcaccatattggccaggctggtctcgaactcctgacctcatgattcacatgccttggcctcccaaaagtgctgggattacaggcgtgagccaccgtgcccagccgccatctgtttctttaaggggcttaggaacgatgtccaggggaggggttgggttaagaagatgggatcaattaggctttctgaaggattggatgtgaaggagagttctataaaggaggttaaccatcttctcataatgccaagacccaaagggaagtcactggagggttctgggttcttcttgacctcccagaagcataaaggtacccgattcacagaagatacggggcagatgcaatagctttcttcaaacatccaatccagggtgctgccaaatccacagagagtttcttttttccatctgtgatgtgtacagaactcccacctggacacagtgggaatcagaatgtgtccatgaaaactctgcaaaagcttgcagaatgccttgcctgcctcagtgtctcctcctcaccctccctcacatgcaaattcacatgatgggtgaggaccttggctccaggatatcagaggtcagactgggtggcaaccatgacaggctttgagataagttgcataatgattgagttgtagccattctcatcacaccggcccctgaggactcggcagtgcctacgtgatttcatttgtcaggtggaccacaatcttggagaaccatctgctggaagatgggattccctgctatggcctgatcatgcgtccaaaactgcagttacaagctttgagtctttttctctttcaactgatgagggtgagtttgtaggaacgtacctgcttttttttttttttttttttttttttttttgagatggagtctcactctgtcacccaggctagagtgtagtagcatgatctcagctcactgcaacttccatttcccaggttcaggcaattgtcctgcctcagcctcccaagtagctgagactatgagcatatgccaccacacccagctaatttttgtatttttagtagaggcagggtttcaccatgttggccaggctggtcttgaactcctgacctcaagtgatcctcctgcctcggcctcccaaagtgctgggattatagatgtgagccacacgcttggcctttacccacattttttctctaccattgactgctgttcacaagcctccagcagctaccttcacattgacaggaagatcaggcgtctcagcaaagcaaaagatcctttggagaagatcaccaaaatacctgcaggtgcctccataaccaggtgtattccatctagccacatccatagattctacatccagccatgcccagtttagaggccaatacaaattcattgaatgactgcatatgggagttatattaatatatttttatttttttttaatgggttcaaccaggaggcggagcttgcaatgagccgagatctcgccactgcactccagcctgggcgacagagactccacctcaaaaaaaaaaaaaaaaaaaggtttcaagaaattctcctgcctcagtctccaagtagctgggaatataggcatgcgcccacacacccagctaatttttgtatttttagtagagacaaggtttcaccatgttggccaggctggtctcaaactcctgacttcaagtgatccacctgtctccgcctcccaaagtgctgggattacaggtgtgagcacccagctggcaatcacattttaaggcaaggaggtgccgattggtggccccaacaagatgagcttggttgaaagagcagatgggagattcgaagtaaagcatggtgtctgtcactcagctttgtcacctggcacagctcctgctggagcttccatcccatctgtgtggaataatggtgaggagcccaggattgggtgtaggaaaaactctgcaggagctgtgaagtgggttgaacggagtcccctcaaaattcaggtccaccaggatcctcagaatgtggccttatttggaaatgggcttttgcacacataattagttaagaaacagttgtactggaccacgatggcctaaatctgatgactggcatcattttaagaagaggaaccgggcacagtggctcatgcctataaccccaaggctttgggaggccaagacaggaggatcacttgagcccaagagttggagaccaacccagacaacagagtgagccctgcgcttttttttttttttaatttgagatgaggccttgctctgttgcccaggctggagcgcagtggcgtgatcttggctcacggcaacgtcctcctcccaggctcaagtgatccctccacctcagcctcctgagcagctgggaccacaggcaggcaccaccatgcctggctaatttttgtatttttagagagatggcgttttgccatgtcacctaggctggtctcaaactcctggattaaagcaatccacctgccttggcctcccagagtgctggaattacaggtatgagccactgcacccagcccaaaaatgttttttaaaaattagctaggtgtggtggcacgcacctgtggtcctagctactgagaaggtccaggtgggaagatcgcttaaccccaggagttcaaggctgcagtgagttgtgattccgccactgtattccagcctgggcaccctgtctcaaaataaaaaattaaagttaaggccagcgcggtggctcacgcctgtaatcccggcactttaggaggccagggcggctggatcacgaggtcaggagatcgagaccatcctggctaacacggtgaaacccatctctactaaaaatacaaaaaaattagcagagcatggtggcaggcgcctgtagtcccagctacttaagaggctgaggcaggagaatggtgtgaacccgggaagtggtgattgcagtgagctgagatcccgccactgcactccagcctggggaacagagtgagactccgtctcaaaaaaaaaaaaaaaaattaaagttaaaaaaagaaaaagaagaggaaaagacacagagacatgcaggggaggagaagacagataagacaagacagaagacatataaagacagaggcagagataagagtgatgcagccaccagccacggaaccccaagcggtcctgggagactccagaggctgacagaggcaaggcaggatcctgccctagaaccttcaaaagaagcgtggctccacggacactttgatttcacacttctggcctctagaaccatgagaaagcgaaataagagagatggggccaggcacagtggctcacgcctgtaatcccagcactttgggaggccgaggcgggtggatcatctcaagtcaagagtctgagagcagcctggccaacatggagaaaccccatctctactaaaaagataaaaattagccaggcgtggtggtcggcacccgtaatctcagctactagggaggctgaggcaggagaatcacttgagcccgggaggcggagattgcaatgaactgagattgcactactgcactccagcctgggcaacagagcaagactctggctcaaaaaaaaaaaaaaagggagtaatggaattttcttgtctctacaagaaaatgagaagaacagcccaagaaacccagcatccaaataataaagggtttcagaaagaagagagaacacagaagggagaaactgctgagcaaccattcaagaaacgttttcctaaatgaagaatgtgattgaaaaggaccagcaagtggccaacacgatgactggaaacagacccacaccaagacacagcgcagcgcaacttcagaactacagagagctacagggagaagctccggcaagaaaaagcaggtttcaaacagagtgtggagaatgaggatgacacctagatgcaaccatctggggatggggaaggggcgcagacaggcatgtaaatctcccagggtgattctcgtaatcacgtgttgtttagaataatcaggccaggtcattttgtcggggatcccacccccgtgtcaccatctgctggtatttttccttggattaattagtcaggttttccagagaagacccttcaggcttgctgccactcagctgagaggggcagaaggctggaagtctcagccttcagtatcaaaaccttcgctcagcaaaccatccgtagggatagtttcaatcctattggcgtgctgccaacccttaccctgaagtcctatggcagtcacttgcagatggggctggatctaccatgatgaacctgaacttcctcggaagcatgcttctgtagccagcatgggagaaacttgcaggcttgttaggaagatgcgtgtttattttagccacggggtagtaccaaaataccattaacattactcaaaaataagtttgccggctgtgggcggtggctcatgcctgtaatctcagcactttgggaggccgaggagggcagatcgcctgaggtcgttagttcaagaccaacctggccaacatgatgaaacccccatgtctcctaaaaataactaaaaatacaaaaattaggggggcgtggtggtgcacacctgtaatcccagctactcaggaggctgaggcaggataattacttgaacctaggaggcgaaggctgcagtgagccgagatcacacctctgcactccagccttggtgacaaagggagaccccatctcaaaaacacataaaataagtttgtgagccagacaaatatgatcgcaatgccaatagataataattttttttcaaacagaaaaactccaggagaagccaggcatggtggctcatgcctgtaatcccaacactttgggaggccgaggcaggaggattgcttgatcccaggaattccagaccagcctgggcaacatgatgagatcctgtctctacaaaaaatttaaaaatcacctggtcatggtggcatatgcctgcagtctcagctgctcaggaggctgaggtaggaggatcgcttgagcccgggaggtagaggctacagtgagctgtgattgcatcactgcactccagcctgggtgacagagcgagaccttgtctcaaagaatacaaataaaatcaataactaataaaagtcttattgctctcggtagccataagcttacggttttctaggaatcatgttttcatttggaacagcacccacgtactctcagacacagccatgagcagctatccaggaggaggagacagtggatccgcattctgtattctctctgggtccctccccatcttggggtggtgaggcatggctcttctttggcaatttatagtgttgctgagagacacacacactgctggaataaatcactgggcgtctatgctgtgaattgagccccgaggagcgtgtggttaatggaccttacttcaacactctggtctgtctgagagaagcgttctctcttcccagcatgtagtgggttccagggaggaggtgagcaggggcaggaggtggaagctggatggcttcccagcttctccagggccaggtcttcattagtgtggcttcattattgcatgtgcagtgctttcccagaatatctgacacatccatgctcaaatgtaagtacagaaacgaatccgtaaggcaggtaggagttactaccaactttctgcaagggcaccatttgacccctttgcccttcgtaacctagggcacacatcgtctcatttggagggaacctgaaggccatcacagctggaaatgaaaccgagagtatctcacagtagccccaaatccaagcctcgttctaaatctccaaaggcctaggggatttggggccttgacgggaaaaatcaatccccctgcatcataccaccacgcccaggcactggctgcttcactgtagctcgctctggctcagttcatgggagccgtggaaggagaggtgtgggtctctgggttcccactgtgttgagacaatctattcttactccaaagagctattcaggccaaaaagagttgactagggcttgcaaggtctataacctttttctagtcaacctaatgcttttttttctgagacggagtcctactctgtcacccaggctggagtgcagtggtgtgatctcggcttgctgcaacctctgcctcccaggttcaagtgattctcctacctcagcctcccgagtagctgggattacaggtgtgcgccaccacgtctggctaatttttgtatttttagtagagatggggtttcatctctctcaaactcctgacctcaagtgatctgcccgcatcggccccccagagtgctgggattacaggcatgagccacaacgcccggccaacctaatgctttttgggccttaattccctgataaaaactggaactctacttttaggctatgtctacagtactttagagactatcaaaatagctttgtattgatgtcgaaaaaagaaagtctgagttctaggaatgacagctgagtaccacagaattcttcctagaccccattctccgccccagcccttcaagtagattaaccccatttaatgaaacaaatcctgattgtacttactatgtcaaagcaatgtggtaaattgctgaatactaaagataaatgtaaaactaacctgctttcctatgtataatattgtttagtcttaaaaaggaatggaattctgacacgctataacatggatgaacatggaggacattatgctgagtgaaagaagccagacccaaaaagacagacactatatgattcctcctatacgaggcacttagagtagtcaaattcataaagacagaaaagaaactgctggttgccaggggccaggacggggctaatggggagttatttaactgataaagagtttcaggtttgtaagatgataacagttctggagacagatggtggtaatcactacacaacaatgtgaatatacttaatgccactgaactgtacacttaaaaatgtttatagacctggcagggcgcggtggctcacgcctgtaatcccagcactttgggaggccgaggcggacggatcacgaggtcaggagatggagaccatcctggctaacacggtgaaaccccgtctctactaaaaatacaaaaaaattagccgggcgttgtggcgggtgcctgtagtcccagctactcgggaggctgaggcaggagaatggcgtgaacccggaaggcagagtttgcagtgagccgcgatcgtgccactgcactccagcctgggcgacagagcgagactgtttctcaaaaaaaaaaaaagggggttatagaccagatgcagtggctcacgcctgtaatctcaacactttgggaagccaaagcggggagtatcgtttgaggccaggagttcaagaccagcctgggcaacatggtgagaccaccatctcaaaaaaatgataattttttttttttttttggagagatgggggagtctcactctgttgcccaggctggattgcagtggcacaatctcggctcagtgcaacctccacctcccgggttcaaacaatttcccgctaatttttgtatttttagtagagacagggtttcaccatgttggccaggctggtcttgaactcttgacctcaagtgatccacccgcctcagcctcccaaagtgctaggattacaggtgtgagccaccacgcctggctaaacattttttttttaattagccagatgtggtggcatgcatctgtggtcctggtgcctcaggaggctaaggcaggaggatcatttgagcctgggagtttgaggctgcagtgagctgtcatcacacctctgcaccccaacttgggtgacagagagagaccctgtcccagaaaaaatgttttaatggttatggtgatgttaagagcagaattgtgtccttccaaaatccagatgacgaagtccccaaccccggtacctcagaatatgactgcatttgcagatagggtctttgaagaggtgattcagttaaaatgaggtcattaggatgggccctaattcagtatgactggtattcttttttttttttttttttttttttttgagatggagtctcactctgtcaccagcctccgcctcccaggttcaagagattctcctgcctcagcctcccgagtagctgggattacaggcgcatgccaccatgcctggctaatttttgtgtttttagtagaaatggggcttcaccatgttggccaggctggtcttaaacacctgacctcgtggtcttaatcacgaggtcaggtgtttaagaataccacccatatgactggtattcttctaagaggaggaaattagggaccaggtgcagtggcttacgcctgtaatcccagcactttgggaggcagaggcaggcagatcacaaggtcaggagttcaagaccagcctggccaacatggtgaaaccccatctctactaaaaatacaaaaattagccaggtgtggtggtgaatgccagtagctgtggtctcagctactggggaggctgaggcaggaaagtcacttgcacccaggaggtagaggttgcagtgagccgagatcaagccactgccctccagcctggcaacagagtgaggctccgtctcaacgaaaaaaaaaaaaaaaaaagaggaggaaattaggacatacagaggcacagaaggaagatggtgaggagacacagaaaagacagccatctatgagccaaggagagaggcctcagaagaaaccaaccccgtccacactgtgctgtcagtgacaacagaactgtgacaacatacatttctgttgttcaagccacctcatcaccaatacttagatatagcagccctaacaagctaatccaggtggtaaactttctggtatgtgtattttaccacaattagtaataataggctgggcatggtggcccatgcctataatcccagtgctttgggatgtgaggcaggaggattgcttgaagccagttgaagaccagcctgggcaacaacacaagactccatctctacaaaaaaaaattttttcttctttttgagataaagtctcactctgtctcccaggctggagtgcagtggcaccatcttggctcactacaacctccacctcccaagtagctgagattacaggtgtgtgccaccatgcccggctaaattttttttttgttttttttgacatggagtctcactctgtcacccatgctggagtgcagtggtgcagtatctgctcactgcaacctctgcctcctgggttcaagccatccttccaacctcagcctcccaagtagctaggattacaggcgtgtgctaccacgcctggctaaattttttgtatttttagtagagatgggatttcaccatgttggccaggctagtctcgagctcctgacctcaagtggtctgcccacctgagcctctcaaagtgctgggattacaggcatgagccactgtgcccggactaaaaaattaaaaaacaacaaaacaaaacaaaacaaaaaaaacttagttaggtctggtggtttctgcctatagccccacctactcaggaggctgaggcaggaggatcaagtaagcccaggaattggaggctgctgtgagctatgattgcaccactgcactccagcctgggcaacagagcaaaactctgtctctaaataataataatgaaaataaaatcataagcctaagaacatgcaagtggaaaacaaccaccacctgccttcctagagcgcacagacttcccgcagctcagaacggagcaggcatggtgagtgttattagaaaggcacccgggagagtgcagaaagacaggaggttcatgtggacagagcagatttggaaaagcatctttgatacaggaagggtgagaacggtgtcttgaaagaggtggtaggaccctgccaggcagccatggggctaagaggaaagagttccagaaagaaaggcactgtgggccagggagcagggtgcattgtgagaaacagcacgtggtgtggcccgggcagataagtggccaagccagaggtgcagggctagacaagcaggcaaaggggtcggtaggtagggccaggctgaaaggtcaggatgaaagtcattccaaattctgcccctgcaaggaaagctttttatttatttatttatttatttatttatttactttttttgagacagagtctcactctgtcacccaggctgagtacagtggcacgatcacagctcactgcaacctcaacttctccaggctcgagtaatcctcccactttagcttcctgagtagctgggactgcaggtgcacaccaccatgcccagcatttttttttttttttttttggaagaggcgcagtctcactatgttgcccaggctggtctccaactcctgggacacaagtggtcttccatcctcggcctcccaaagtgctgggattacaagcatgagccactgcacctggcctgagaaacactatttttaaatttctatttcctgagcagggttggagagcgtggggctgcgcctctcctaaaggcacttgccagtgcagtcctagtaatcgcttcctgctccttgcctcctccgctggctccctggagtccttgcaagccagtctcaggctgagtttcagaaagctgtggagggctgggtgtggtggctcacacctgtaatcccagcattttgggaggccaaggcaggcagattatgtgaggtcaagagttccagaccagcctgtccaacatggcaaaacccatctccactaaaaatacaaaaattagccgggcatgggtggcatgcagctgtaatcacagctgctcgggaggctgaggcaggagaatcacttgagctgggaagaaaaaaaaaaaaaaaaagatgtgcagggtattaagcactttaagaccaagccagcagatgatgagatgcggttcctctacggccactacaaacgagcgactgtaggcaacataaagacagaacggcccaggatggtggacttcaagggcaaagccaagtgagatccctggaattagctgaaaggggctgccagggaagatcccatgaaagctaaagcttacgtcaacaaagtagaagagttaaagaaaaaattcagaatacgagagactggaattggttgccagccatgcctttgtcctaaactgagacaatgccttgttttttctaacactgtggatggtgggaactgatggaaagaatcagctaacccatcctcaaggctactcaggataaagttctaatagattaggggctaaaacgattactgaccttccctcagtagtttttatctgagatcaattaagtgtatttgtggctgactgtggtgcctcacgcctgtaatcccagcactttggaaggccgaggcgggtggatcacccgaggtctggagtttgagaccagcctggccaacatggtgaaaccccgtctctactaaaaatacaaaaagtagccaggcgtggtgatgtgcgcctgtaatcccagctactagggaggctgaggcaggagaatcacttgaacctgggaggcggaggttgtagtgagccgagattgcaccactgcattccagcgtgggggacggagcgggactccatctcaaaaaaaaaaaaaaagggtatttgttactttaaattaaaaatatctttttctacttccactgcacagtcatttttctggctctccccaccacacccctcaccctgcacaattacccctcttgcatgtacctctctagccgtgaatcttcagggatgggaatatgaggttcttgagatgggattcatcgcgggaatgactccaagaaaagctgccaagtgaggctttcattcacttccccaagatgaaagagctgatctctcgcctgtgttcccctcacagtcaggacctgcgtctgttatttaccaccatgcaatttaaaattagatgcgtgtcacctgaggctctaacagctggaaggctttaaaattagatgcgtgtcacctgaggctctaacatctggaaggcggtgatccagtcacatttatgccacctgagggaacaatcccgggtaagtagtcccagcggggctcagaggttcaggcttgtcccacacagggtccaggaagggccggcactggggcagcctggctcctgggccgtggggcttcaatgcaggctgtccgcacttcattgtccctcaccacacctgctactagaagcccatcggtgaccacagttggagagagggaaggccacacgaagcaagaagtgctgcaaaatcgtgcgatgctgaaaagggaatgcttgtttgcagtttcgttctccctggttgagagccaactttctttaataagcacagttcaaatcctggtaaaatccaaagcctgaaaccaccttttcccacctcttgagttgcacaaacgtgcattcacagataccagggtgcaacatgctgggacgttatattacgtgtaaatcatcatacaaacaccctgggcttttgaaacatggcttgcaagagggttgcacccaaactcttgggccaggcacagtggctcacgcctgtaatcccagcactttgggaggctgaggcgaggagttcattgacatcaggagttcaagaccagcctggccaacatggtgaaaccctgtctctactaaaaatacaaaaattagctgggcatggtggcaggcacctgtaatcccagctacttgggaggctggggcaggagaatcgcttgaacccgggaggcggaggttgcagtgagtcgagatcgcgccactgcactccagcctgcgcaacagagtaagagtcagtctcaaaaaaaaaaaaaaaaaaaaaaaaagagcccagacacggtggctcatgcctgtaatcccagcactttgggaggccaaggtgggtggatcacctgaggtcaggagttcaaaaccagcctggccaacatggcaaaaccccctctctactgaaaatacaaaaaattagctgggtgtgctggcacgcgcctgtaatcccagctacttgggaggctgaggcaggagaattgcttgaactcaggaggcggaggttggagtgagccgaggttacgtcattgcacttcagcatgggcgacaaagcgagactgtctcaaaaaaaaaaaaaaagggttgtacccaaagtcctgtgagtctcacagtagtcctgcaagtaagaggacaggacaaaccggccccctcggacagacagatgcgggctccgagactcagagccagtgtaaatgcctcctggaaagtcacagccatcccatgatagaagaatctggggctcgaaccccaggtttctatcccagtgttcctctctgcttgacccttagaataataaccaccatttatggtcacttactctgtgacagtcattttccacttattatttcctttgatccacaccacgctttgaggaaatcaaatttagccaataaatactagaggaagcattgaactcaggtgtgtcctaaattagaaggccaccttctaattcagctgcattcaattacttctcttccttccagttcagttccactctttatttttttttgagacagagtctcgctctgtcacctaggctggagtgcagtggcacgatctcagctccctgtaacctctgcctcccaggctcaagcaatccctcacctcggcctcccaagtagctgggaccacaggaacgcaccaccacatctggctaattttttgtatttttggtagagacggagttttgccatgttggccactcttaaaaggacacctgtcattggatttagggcccacccaggtaatcacatcgcgagatccttaggttaattatatccacaaagacctcatttccaaataaggtcatattcacagggactagatttaggaattgcacatgtctttttggggggatactgtccaacctaattcaaggacgaggcagattcaggcctacagtatccccagtcctcagtggtagctgcctctgccacaaccctaggaagggtcaggcctggggcaggcagcgggaagcagaatcagccctgggcgggtctgggcaacccatccgtccaagaatcagagacaagggccagcatgctggttccctgggcagcaagtgagtagaacacagggccaggcagggccgaaatcgtggttcatgaggctcggggaggtcgaggaaagcaagcgaaacccagagaactagggcagcactgccaggacagtgctaacatcacattcctgggctccttaagtctcccgagaaggtgcaaattgcgttaattgccactgctgaggccaggccatggcgccctgctgggggctaaccttgcgtgacccgtcagaccagagctgggcttcctcctggtttggtatccgctggagctgtaagggcccgagggtcacagtgcctcttgcaggaggtatggcctcaccagtgcccaggcagggacagtggccattcaggagtgccctggtttccaaagtgatagaggtcagatgtgcctggccacacgcaatcctgggcttcatttatatgcaacaaacccattatctgctcccaacaaatagggaaggaggctaagacgtaggcggatgaagggaaagtgcctccaagacctgcaagttaggatagagctggcagccaggggttagggaagtggaaggaggccctgcgggttctggaagaggactgtgtgcagctacagcagcgggctttgcagtgggactgcctggcttcagaccttggctcttcagcttgctgtgcaaccttgggatagttactcaacctctctcgacctcagttctcttccctgtcaaccgaagaccaaaatagaacctacattatagggctattatgaggattaaatcaaacaagccaaaaaaagcacttcacacaatacctggtatgtagtaaatactcaactaatgcgggctattatcaaccagccacactggagggaagccttgaaggagggtgtggttttctgtgtcagcttggccaggctatggtatttggctgtttggtcaaacgccagtccagatgctgctgtgaaggtattgttttaggtgtgattaattaatatttatatcagtagactttcagtaaaggaaatcacccttcacaatgtaggggggctttatccaatcagttgaaggccttaagagaaaagactgaggttcccagagaaataagagattctgcctccaggctcaaggctgcagcattggctgggtgtggtggctcatgcctgtaatcccagcactttgggaggctgaggtgcgtggatcacctgaggtcaggagctcaagaccagcctagtcaacatgttgaaaccccgtctctattaaaaatagaaacattagccgggcgtggtggcacactcctgtaggcccagctactcgggaggctgaggcaggagaattgcttgagcctgggaggcaaaggttgcagtgagccaagatcacgccactggactccagcctgagtgacagagtgagtctccatctcaaaaaaaaaaaaaaaaaaaaaaacaaaacaccaggactgcagcatcaactcttccctgagtctccagcctgctgggctgctctacagatttcagacttgccagccccccaatcccatgaaactatttatttatttagagacagggtctcactctgtcacctaggccagagtgcagtggtgtgatcatagctcactgcagccttgacctcccaggctcaagcaatcctcctgcctcagcctgcagagtagttgggactataggtgcatgccaccatgctcagataatttttaaattttttgtagagatgggatcccattatgttgtccaggctggtctcaagcttctgagttcaagagattctcccatctcagcatcccaagttgctgggattataggcatgagcactgcacctaactgacaattcctttaggtaggtaggtagctagaggatagggatggatggaggaatggatggatggatggatggatggatggatggatggatggttggttggtggttgggtggatggttggttggtggttgggtggatggatggatggatggacggttggttggatgggtgggtgaatggatggatgggtgtgtggatggatagacagatatagatctagctatctatccttctatctgtccacatatcctatcagttctgtttctccatagaactctaatacagtcagattagtggccagaagacacaaggacaaatgtcccaggcaaagcccaagagtgtgggctgtgctatggaggatcaaacaggccagtgaagccaccgggcacaaggtgcaagagaagacatcaggaaatgaagcagaactgcaggttgtagtcatggtgcaaggtggctcagcagccagctggaagcctttggaagatggagaggcagagagtgagcgtagggctgtccttgaggaagaggcatgcacaaagccagccatgcacactccccagccgtatctgctgccaaagcgaaaccaggatggctgtagaaatttgcttcaaatgaagaaacctgtcccttgacggggacaaatgatgtcaagcacaagtgcagaagcagaccacattcctgccacaccatggctcaaagtcacaaggcagaaacacctgagaaggggggaaggtctgaaggaggagccaggtctggccacgttctcctttggaatctgggtgtggccaccctacatggggatctggaatgtgccgtgctgcaaagtgaattcctggtgcatttttgaggctcaggtgatcccgaagttatggctgtcatgagaaagcagcaccctgcagacaaaaggttctggaaggtgggcagtacaagctggcttcatccaggagccctgctcacagcctggtgctcaatggatatcatccccaccggaagttctaggagctgcccttggttaatgagcctggcagctaaatggcgtcacttgccaggtcacatgggcaaatggccagcgcctcgttcctggagacaaggcggagtcattcagttcttttgttattgttgctagagatggagtttcactcttgctgcccaggctggagtgcagtggtgcaatctcagctcactgtaacctctgcctcccaggttcaagcgattatactgcctcagcctcctgagtagctgggattataggcacccgccaccacacctggctaatttttgtatttttagtagagatggggtttaaccatgttggccaggctggtctcgaactcctgacctcatgatcctctcacctcagcctcctaaagtgctgggattacaggcgtgagccacagcgcccagcctaacttttgtattttcagtagagacagggtttcaccatgttgtccgggctggtttcaaactcctgacctcaggtgatctgcccaccgcagcctcccaaattgccgggattacaggcttgagccactgcgcctggcctggagtcattcagctccaggggcttctttcttccttactaaacggctttgtgcagggagcagaagttctgcctgccctttctaattgccggtcgcaataatatcattcctatttaagactgaataatattccattgcatggatagagcgcattttgtttattcactcatttgttgatggaaatttgctttgtttctaccttttggctactgtaaagattactgctatgaacatgcatgtatagatatctgttttaagtctctgctcttttttggcttggtgaggtggctcacgccgataatcccagcactttggtaggctgaggtggaaggatcacttgagcctaggagtttgagatcagcctgggcaacacacaaagacctcatcaaagagagagagaagaaagaaaagaaagaaaaagagaaagaaagaaggaagaaagaaagagagaagaaagaaaagaaagaaaaagagaaagaagagaaaaagaagaaagaagaaagaaagaaaaagaaagagaaagaaaaagaaagggcacttcaagatgatgcaggttggaacaaaaaaaaccagattattattaaacttgttattaaacagcacctagtttgacaacacttggagtttgcaaaatatacggactctcttggttgacaaacagaaaggggattcttccccagttgcttccactgtccacaggacagcaagtggctgtgactgcctaaacgccctcctcccaagtcacatccagcagtgccctgcctgccacaccacgtcattcgtgtcatttctcccacaggcagccccttcctttgtgtcaatcaaaagctgatgggcacccggcaggcagccggtttgcttctgtcggcagcaaatgctgtccacatttcagaccactagtgaaagtggaaaagaaattattaccatatgaagtttccttgatgaaagcagatttaaattcagccttcatccccaaattttcaacactactttgacagtggtttatctattccattttattttttatttttttgagacagagtttcactcttgttgcccaggctggagtgcaatggcgcgatcttggctcgctgcaacctccgtctcccagtttcaagtgattctcctgcctcagcctcccaagtagctacgattacaggcgcccgccaccacacccggctaattttgtatttttagtagagatggggtttcaccatgttggccaagctggtctcaaactcctgacctcaggtgatccgcccgccttggcctcccaaagttgacagtagtttattttaatacgtaactttgagtcatggaataactgcagaatatgcaacatatttttaaattgtttatctgatcgtggtgtcaaaatcccagtgatcaattcattaggtttgcttgactcccagaattaatacatattaataaatattttgttgagtaccactatggtctgaatgtttctgtctccaacaaaatctatagcctcagaggtgatagtgttaggaggtgggatttttgggaggtgatcaggtcatgaggttgacgcccttatgaacaggattagtgcccttataagaggctccagagctgccaagccccgcccaccatccgagatctcagcaagaagtcacctctatgaaccaggaagcagccctcaccagacactgaatctgccagcacttaatcttggacttcccagcctccagaacctcgagaaaaaaaaatttaagagataggttccggctttgtcccccaggctggaatgcagtgatgcaatcattgtggctcactgccgcctcaagctcctggactcaacagatcctaccacctcagcctccccagtagcagggaccacagaaatgcactgctgcacccagctgatgttttttattctttatttttgtagagatggggtcttgccatcttgcccaggcctacaggcatgcaccaccatgcctggcttccaaccataattaattctatcaagacaagcagaaaactcacttggacatgggtgctgttttttcgtttattttgccatatgactagactgggttgtcaagaaacatccattcctctgtgctacctgtgttcaaggaaaggaagataacaactgagataaagtctgacttttcaatctagaaaattccccttctggcagcaaatgctagtcaggaagcaaggctggaaaacacacacacaaaaggtgtgagatcagttggtagaaaaaggcaatgcagaccacgtctgtgtgcaaggctgagtccaagaccaagtgttggctcctcaccctgtggtcccagatacacctgccatccccgccagggcaatgacagaaacaccacaaaaggctgtatcaggccaggtgtggtggctcacgcctgtaatcccagcactttgggaggctgagggaggtggattgcttgaggccaggagttcaagaccagcctgggaaacatgatgaaaccccatctctacaaaaaatacaaaaattagctgagcgtgatggcgtgtgcctgtagttccaggtgctagggaggccgaggtgggaggatcaccagagcctggggagttagaggctgcagcgagccatgattgcaccactgcactccagcctgagcaacagagtaagaccctgtctcaaaaaaaataaataaataaaaaggtaggcttgtgcaaaactgaagcacatgaagtccatctgtcccttttgcttctgtgtgtctgtctctctcaatgagttgattgcccgttgatcacacccagccagtggggtccagaagacaggacactggacctgagattgaatcccagctctgaaagttgccacctagatacctcaggcaaagcctggtttacctctctggggaggtaaactctggggaggatttccccctcctgaataagatggtaaggacttgctaagggaaagcccttcattccttcacccttcctcttctttctgcctggaacatcagtgtgaggtgtggaggtacagcagccatcttgcaaccatgagacaagaggcttgagaatgaggtctatgctaaggacagaggaacagaaaaatgagaagagcctgggttcttgatggcatcaatagtcattaatactgatatggtttggatctgtgtccccacccaaatctcatgttgaaatgtaatccccagtgctggaggtagggtctggtgggaggtgattagatcatggggcggtttctcatagtttaacaccatctcgctttggtgctgttgttatgatagtgacagtgatcggtggagcaggaacaagagagacagcacctcccctctctctttctcctgcttctgcttcaaccatgtaggacaagcctgcttcgcttcaccttccaccatgattggaggtttcctaaggcctccctggaagctgagcagatggcagcaccacgcttcctgtacagtctatggaactgtgaacaaattcaatctcttttctttataaattacccagcctcaggcatttctttatagcaatgtgagaatgaaccaatacagataccagcaccaaagtgcctaccgtgaactttttcctacccaggaaaaaggaattctttattatcatcagcctctaaaacagggctttctgttacttgcctctgtatgaactccaaactgacacgctatctaatttatgctgagagcacagctagggaacatgcccaggcatgcggcttttacctactgagctggacaagattgtggaagtgaaagtaaaatttgaagattggatgaaagatgttaaaatcatgggaaggctgaataatttgagaatactcagacatctcataggtgaggaaaatgacagtattaacattaatacaaagaaggtgatcagtcaaaacattcctcacgagaaaaggtcctttggcaaatactttcctttaaagtaaatgaatataacaggccaggcacagggctcacgcctgtaatcccagcactttgggaggctgaggtgggcggatcacctgaggtcaggaattggagaccagcctggccaacatggcaaaaccccatctctactaaaaaatacaaaaattagtcaggagttgtggcgcacacctgtagtcccagctacttgggaggctgaggtgggagaatcgcttgaatctgggagtcggaggttgcagtgagctgagatctcaccactgcactccagcctgggcggcagagtgagactccaccacagccaaaaaaaaaaaaaaaagaaagaaaaagtgaatgagactgactagttaatcaagcctttccagccttccacatgagcccaataaattgacctctcagcctgaagacgcatctgtggaaatttccaccaatgataacctgaagagtttgctcctgccgcctcgtgggcagcacgccaggcgtcttccctcagtagttaagtcaacctggctcataaagcaatggaacaaatgcgatttgtgtccccatatcttgcggaagccaaagtagagaaaatagcctagatcttttcaccgattttctgcgtcaatcctctttgattaagtatccgcgctatccacttcaatgaagctatggccccatgaataatactgtggtctgttgccatactcataatggaaggacataaaaatgtccctatttggaattcataaaaatgaagatgcaatttttttccatccaaaaatggctaatagaggttcgtgagttgtctccattttcctccctcaacggtccgttcctgagcaaatcatttctttgggctctatcacatttacgtcgttcatacatgatacccaagcaggtgcgagaatgcaccatctttcattgatgaaaatgatccaattggccaggcgcggtggctcacgcctgtaatcccagcaccttgggaggctgaagcaggcagattgcttgagcccaggagttcgagaccagcctggacaacatggcaaaaccccatctctgttttttaaaaatatatttatttaaaagaaataataataaaatgatccaattgccttccaaactgcttttccaggaagcagttggatggatcatgttgagatggtgtggtttctgtggcaacaagtcaaactgtgacacccaaaggattagacttctcacctgggccccaatatggtaacccatgaaagaaccagccttaggcttccacgacgtcaacactcatgcttgctgccacctccaagccccacccatcccctctgcccttggttccacacccccagctacacgctgacaaagatgctgggctagagacacccagctcgccagacacacccaggatgctctcaccacttcccagagccaaatgccctggctgcaaaacagagaagcgaaacctagaaataatcaaggcttgtttccagaccttcagagttctcacaccctgccctgtcttgtgtgtgtgtagatacagatatagacaagatatcatctgtaggtagagatgtaaatatagacatagctcagctattactcgggaggccgaggcatgacaatcgcttgaacctaggaggcagaggttacagtgagccaagattgcaccaccgcactccagcctgggcaacagagtgagactccgtctcgaaaaaaaaaaaaagatgtatctcagctagacactttacacagattttctgatttaatcctatcaatgtgagaagtattatctgttttattgatgagaaaaacagatttacagagtttcgtttgttcatttttttggtgggtggacagtgtcttgctctgttgcccaggctggtgtgcagtggtgtgatcacggctcactgcagcctcaaactactggactcaagagatcctcctgtctcagcttcccaagtacctgggaccacaggcatatgccaccatgcctggctattttttttttattttgttttgtagagatggggtcttgctatgttgcccaggctggactcaaactcctggccccaagcaatccacctgccttggcctcccaaagtgttgggattacaggcataagccaccgtgctcggccccaagagatttttttcttcaaccttaccaagctcaccagctgacaggaggtaaaggtgagggtcgcagtggctttgaggactccgcagtcaccacggtgcactccttccatctcactttcatcaagcacctagagccccaccctaggccatgtcaggtctcctgctatttctcaggctggcccgacaccgtcacgactccatctctgtatccagggctggcaccaggttcctctcccaaggctctctccctgcttcttttgagatcctcctcatataagaggcttcagataagtgccgcctcggatgccaggccggatgttctgccggaagcttcactcaccgagtcagaggttcatgggctggctcttgatcctcaccctcagaacctagttctgaaagagtaggcatgtgagtgattctatttttttttttttacagacgggatcttgctatgttgcccaggctggtctcaaactcctgacctcaagtgttcctccacggcctcccaagtggtgggatcattgactttatatcttcaagtttagctcaggaggctccgacagagcaggcagccaaggcatgctggttgaataaatgaacaaactcagcaatgtttttgcaccccacaaacactggtggacagtatcacctttgaaaaatcattgattatatcataattgcaaaaatttaggtcaccaactagattacaaacacacgattttgataaaatatatgtaacctaaaatttaccattgtaaccatttttaaaatgtgcaattcagtgacattaagtatattcacattgttggccgcgcgtggtggctcacgcctgtaatccagcactttggtaggccgaagctggtggatctcttgaggccaggagttagagaccagcctggccaacatggtgaaaccccatctctactaaaatacaaaaattagccaggtgtggtggcactcgcctgtaatcccagctactccggaggctgaggcaggagaatcacttgaacctgggaggcagaggtcgcagtgacccgagatcgcaccactgcgctccagcctgggtgacagagagagactccatatcaaaaaaaaaaaaaaagaaaaagtatattcacattgttgtgcaaccatcaccaccatctatcttcaaattttttcatcatcctaaactgagcccttgtcctcattaaacactaactcctcacccctcctccccattccctgacaaacattccattttctgtctccatgagttggactattctaggtccctcctgtaagtggaattatacaatattgtccttttgtgcctcgcttatttcacttaccacagtgtcctcaagttcattcatcttatagcctgtctcagaatcctgtcatttttaaaagatgcttactggatcatcaaaaaacattgatgagcttctgctgtaggcagggcctgtactctccagtccaactaaaaagaggtaaatgacagagtctctgctccaaggtgtcagacaaccaatttcacttttaatttttttgttgttgttgagatttctggaatctgtcttctgcaattaataggttcacctggagaaatagtctgtagtctacaggctagtgtggaaagccattttcaaaggtgaagaggaaggccaggtaggccaggtatgttggctgcctctcatatagtagcatgggaccccttaaaagtgaaattggccgggtgcagtggctcatgcttgtaattccagcacttcaggaggccaaggcaggagaattgcttgagcccaggagttcaagaccagtttgggcaacatagtgaggccccatctctaaatatatatatatatatatatatatatatatatatatatatatatatatatatatatatatgtacacacaaaaatcagccaggcgcgggccaggcgcggtggctcacacctgtaatcctagcactttaggagcccaaggcgggcagatcacgaggtcaggagatccagaccatcctggctaacacggtgaaaccccatctctactaaaaatacaaaaaattagccaggcgtggtggcgggcgcctgtagtcccagctacttgggaggctgaggcaggagaatggcatgaacctgggaggcagagcttgcagtgagctgagatcacgccactgcactccagcctgggtgacagagcgagactccatctcaaaaaaaattagccagacgtggtggcatgtgcctgtggtcccagctgctcaggagactgagaaaggagaatctcttgaacctgggaggcagaggttacagtgagccgagatcacgccactgcactcaagcctgggtgacagaatgagactccgtataaaaaaccaacaaacaaacacaaaatgtctttcagcagcatggtggctgacacctataatcccagaactttggcaggccaaagtatgagtatcgaggccaggagttcaacatcagcctgggcaacatagcaagactctgtttctatacaaattttttaaaacttaactagaccaggcatggtgactcacacctgtaatcccaacactttgggaggctgaggtgggagaatcacttgagctcaggagttcgagaccagcctgtccaacatggtgaaaccctgcctctactaaaaacacaaaaattagtcaggcatggtggcaggcacttgtaatcccagctactcgggaggctgaggcaggagaattgcttgaacccaggaggcagaggttgcagtgagccaagatctagcaactgcactccagcctggggaacagagagactctgtctcaaaaataaataaataataattaaccagaccacaggcctgcagtcccagctactcagggaggctgaagagggaggatctctcgagcctagggtgtcgaggctgcagtgaaccatgaccccaccactgcattcacttccgtctgggtgacagagacagactctgcctccaaaaacaaaaaattaattctggggggttcctcccctgaagagcttttcttgagagatcatgaattgactcatggtaaagtgttagaaacagtgtcaaatggatcttgaagagctcatgaccctgcccaatgcaggcgtctctgtagcatctgcttgtttattccagggatacagaaatcagagtcccaggaagcctgtcccgtggctgtacagctccttgaaagctcctcccctcccaatatggcattgggagcaaatattctcctacttcaaggcagtattgaaagctccccaagcacctctcctgcgaaccccagctttcccaggtcttccttgcagcctttctctcttttttttttttttgaatcagggtctcactctgtcacccaggctgaagtgcagtagcatgaatgtggctcactgcagtctcaacctactgggctcaaggagatattctcctgcctcagcctcctaagtagctgggaccactggtgtgcaccatcacatccagctaatttttttttggtgggggtgtgggtggagtttcgctcctgtcacccaggctggagggcagtggtgcaatctctgctcactgcaacctccgcctcctgggttcaagtgattctcctgcctcagcctcctgagtagctggggttacaggcacgcgccaccacacttggctaatttttgtatttttagtagagatggggtttcactttgttggccaggctggtctcgaactccttagctcagattatccatttgcctcagcctcccaaagtccctcagctgggattacaggcatgagccaccacacccagccccagctaattcttaaaattgttatagagatggggtctccctatgttgcccaggctcgtctcaaactcctgggctcaaagatcctcccacctcagcctcctgaagtgctgggatgacgggtgtgagctgccatgccgggcctggcctgcctttcagactccccgctatccaggatgcctctgattggcccctccaaattatcagtaagacctctgcctatgtgagacaaaactgcaaagacaaagtatggtgtcccaattatttttgtgtatgcacccacacattgacgtagcctagtaacctagagaaaacaaaaggcttccaactgagggagcacaagagctccaagggcagtcacagttgtgtgagggtggcacccctggataccagcggcagcgattccgagtcagttctcacagtgggtaggcattacggtggggaggcttgtggaataaggaagagaggaagcttagccacggcgccagccctcaaaggagccttgggaaagtcaaaacacctaagccttctggggaaagcaagagtcccaggagagcgaggccccccaggcaccggaagtggaagtccactggaaacccaaggctgctccgacagcagcctgtctggtagaccctcaggcaactgccattcatgggccccttccacagtgctctgccattaaagccactcagcttccttctctgcctcttctcatccatttcttggcttctcctgtcctaccaaatccgtggttggtactacattttctagtcccgtagggcagggctgtccaagcctgggcctcaccaaggccactggccactgttgctcagggggaagcctcacactgtgcatcagaagctggagacactgcagcttctctcaggaggggaccgtaagcacaggcagcctgtggctgatctgtgtgggacacccagggtcgagaagggaggaccaaggtgttcactgcaatggaacacagccttactagctgtcatgtcccccagacagcaaattggcttgattgcaataaccagttggagaggacaaagtgagaatcaccccatgtgaccagctgcttcttgacggtgatcattttgggtgctgaatcgagctccaaccccaaacatcagccccataattgcccatcaaccatttcaccttcacctttctggggcttccaggttccttcattaaaataaaaaatgctatttgggaataaatttaacaaaagatatgcaaatcttttccactgaaagctgtaacacattattgaaagaaattacagaaaatctaaataaatgaagaaatgtaccatgttcatggattagaaaattcaatattgttaaaatgtcaattgtctcaaattaatctatagactcaatgtaatcccaagtaaaattccagaatgcagactggcatggccaaagcagaaggatcacttgagctcaggagtttgagaccagcctaggcaacatgacaaaacctcatctctacaaaaaaatagaagtgttagccagtcatggtggaatgtgtctgtagtcccagctactcaggagactgaggtgggaggactgcttgagcccaggagggtgaagctacagtgactatgatcatgccactgcactccagcctgggtgacagaaaaagaccctctctcaaaaaaaaaaaaaaaaaaaattaaaaaaaaccagaaagctttttttagaaattggcaagcagattctaaaatgtaagtggaaatgagaaggacctagaatagccaaaataatcctaataaggaaaaaattcagaggacttacactggctgattttaagaactgctataaacagcagtagctaagaccatttggtagtggcgttaggatacacaaaatagaatcaatggagcagaaaacagagtccaaaaatagacctacataaatatggccaactgattcccaacaaatgtaccaaggtaattcaatggagaaagaaaaacctttcaacaaatgggctagaataattgtctatttgtaaggaaaaacaaattgcctatttgtaaggaaaacaaatgaacctcaactcctttttttttttttttaagacagagtctcactctgtcgcccaggctggagtgcagtggtgccatctcggttcactgcaagctccacctcccaggttcacgccattctcctgcctaagcctccctagtagctgggactacaggcacccgccaccacgcctggctaattttttgtatttttttttttttagtagagacagggtttcaccgtgttggccaggatggtctcgatctcctgacctcgtgatctgcccgccttggcctcccaaagtgctgggattacaggcgtgagccaccgcacccggcccctcaacttcttacatcacaccaaaaaattaaattgaaatagatccaagacctaaataaaaaattaaattcataaagcatctaaaacataggaaaataacttcatgactttgagatgggcaaatatttctaaggcaaaacacaaaaagcattccataaaaaattaataaacaaattcatcaaaattttaaattttgagtacagtcaccagaatggctacaattaagcagactgacaacaccaaatgttggcaaaaatatggagtaactagaaccgtcgtatgttgttgatgggagtgtaaaataacaaaaccgctttgggccaagcacggtggctgacgcctgtaatcccagcactctgggaggccaaggcgggcggatcatgaggtcaggagataagaccatcctggcaaccaaaaattagccaggcttggcagtgtgcgcctgtagtcccacctactcgggaggctgaggcaggagaattgcttgaacccgggaggcggagcttgcagtgagccaagatggtgccactgcactccagcctggcgacagagcgagactccgtctcaaaaacaaaacaaaaaaaaactgctttggaatactgtctaatggtttccttttttttttttttttttttttttttttttgagaccgggtctctttctgttgcccaggctggagtgagatggtacaatcactgctcactgcagcctcaacctcctggcctcaagccatcctcctgcctaagcttcccaagcagctgggactacaggcatgcaccaccaggcccagctaaatttttctttttcttttcttttcctttttttttttttttttttgagaccgagtctcgctctgttgcccaggctgcagtgcaggggcatgatcttggctcacagcaacctccacctcctgggttcaagctattctcctgcctcagcctcccaagtagctggaactagaggcatgcaccaccacacccagctaatttttgtatttttagtagagatggggtttcaccacgttggccaggctggtctcgaactcctgacctcaggtgatcagtctgtctcggcctcccaaagtgctgggattacaggcatgagccaccgcgcccggcctttctttttgtgttttgtagagatggcatcccactatgttgcccaggctggtcttgaactcctgggctcaagtaatcctcctgcctcaacctcccaaaggaggcatgtgaaccactgtgcccaacctggtttctttactaaactagaaagtaaaatcttatgacccagcaattcggttttttttttccagcaattccatttcaaatgtccatgaaaagccttgtgcaaaattatctgtaatagtcaaaaaatggaagtggcccctggtgtctgtctataagaaaatggataaactgtggtaaagtcacatattcgggtggtgggaaaggcaaaaggtacgtcacaatgacacagacaaatctcaaagacataatgcttggcggggcacagtggctcacacctgtaatcccagcactttgggaggccaagatgggcagattgcctgaggtcaggagttagagaccaccttggccaacgtggtgaaaccccatctctactaaaaaatacaaaattagctgggcatggtggcacacacctgtagtcccagctactaggcaggctgaggcacaagagttgcttgaacccgggaggcagaggttgcagtgagccaagaacacgccactatactccagcctgggtgacagaataaatgagtacctaatgtatatttccaactatacgaagtttgggaacaggtacaatgaatcaatgttggaaaaaaaaacaacagaacaatggcaggctttggggcgtgggaactgactgggacacactgtgaaggcaatttcagggatgacaatgatgttcaatattttctaaaaaaatcacagcttttggccaggcacggtggctcatgccttaatcgcagcacattgggaggccgaggcagaaggatcgcttaagcccaggagttcaagaccagcttgggcaaaatggcgaaaccccatgtctctacaaaaatacaaatctcggctgggcgaggtggttcacacttgtaatcccaacattgtgggaggccaaggcaggtggatcatctgaggtcaggtgttcaagaccaccctggccaacatggagaaaccccttctctgctaaaaatacaaaaataagcatgacatggtggcacttgaatctgggaggcagaagttgcagtgggctgagatcacgccactgcactccagcctgggcaacagagtgagacgtcatctcaaaaaataaaataaaataaggccgggcacagtggctcacacctgtaatcccagcactttgggaggccgaggccggcagataacctgaggtcaggagttcaaggccagcctggccaacatggtgaaacttagtctctactaaaaatacaaaaattagctgggcatggtggtgggtgcctgcaatcccagctactcgggagactgaggcaggagaatcacttgaacccgggagacagaggtttcagtgagccaagtccactgcactccagcctgggctacagagggagactccgtctcaaaaataaaataaaacaaaataataaaaacaaataaaaattaaaaatatataatatccattctattgtaagtaaattacaattagaaaaaaaaaaagagcccccaaaggaaaggaataaagacagaacacaggaagaaaggaggagagacagggagggaaggagggccagcatgagttatttcaggggtggaaaatcacccaagtcaaacaccacaggtatccccagtaggttgcagcaaactgctctctgtagggaccaagctgtgcccaggatcaccccacaaccctgagattatctggcatgctcaccaatcagttctcatgatctgcagcagggcacattcggtcctgcagagacgacccagctgtcaccctatcctccttgctgaagaagggaccctgcggggctgcagctcatctgcctcaggctggcccatccctgcacaggccgctgagtctgagcatgtaccctgggagttgcttacagagcaactttgtcatgtcaagttgacctccagggtagattttcctgctgcaagagagagatgatatctggttagcctggcggttctatttctcaatgtgaatcaggaaattgacatctgatttaacatttcaaaaacaatttgtgttcagccagaatggaggcagtgtctgggagtggtgagggatgtgaagtgcagcagcgcacaggacctccagcactgggaaggaggcctgaggccaaggcccctggtcaggacacctgagcaatgaatactctgtctccttgtccaaagacatttagcattatggaggttaaaaacagccaaattcacatgtatacatatgtaactaacctgcacattgtgcacatgtaccctaaaacttaaagtataataataattaaaaaataaaaataaaaataaaaacagccaaatcggccaggttcggtggctcacgcctgtaatcccagcactttgggaggctgaggcgggcagatcacgaagtcagattgagaccagcctggctaacatggtgaaacgcagtctctactaaaaatacaaaaattagcaggacgtggtggcaaacactgtaatcccagctacttggaggctgaggcagaagaatcgcttaaacctggaggttgcagtgagccgagatcatgccattgcactccagcctgggtggagctagactctctcaaaaaaaaaaaaaaaaggccaggtgtggtggctcgtgcctgtaatcccagcactttgggaggctgaggcaggtggatcacctcaagagttcaagaccagcctagccaacatactgaaaccccatctctactgaaaatacaaaaattagccgggtgtggtggcatgtgtctaatcccagctattgggaggctgaggcaggagaatcacttgaacctgggaggtggaggttgcagtgagccgagatcgtgccactgtactccagcctaggtgacagggcgacactgtgtcttggggaaaaaaaacaaaaaacagccaaatcgtggcattttcatgcagctcgacctagtagacatctagtggctgcaagcgcctgtgtgcagcgctggagacctgagtcctgttgtgtgtgaaggtggggcagggcagcagggcaaatgccgaaaacaaaaactgatcaggccgggcgcggtggctcatgcctgcaatcccagcactttgggaggccaaggcagacggatcatgaggtcaggagatcgagaccatcctggctaacacagtgaaacccaactctccaaaaaaaaaaaaaaaaaaattagccaggcatggtggcgggcacctgtattcccagctgaggctgaggcaggagaatggcgtgaacctggcaggaggcggagcttgcagtgagccgagatcccgtcactgcactccagcctgggcgacagagcgagactccgtctcaaaaaaaaaaaaaaaaaaagaactgatcaatgagccgccagatgccgagcaccacaccggcaagggctgcggatcgtgaacactggagattcaaacagcagagagaccacctcacaccattctgtcaacccgtgccaagtgcccaggcctgtgccaacgcttggcacacaatgattcaacagaggcagcctcatgcttcacggcccgatgctcgcttgttgtctatggccgtaggctaacctgcaaataaagaactggactgcacggaggtggtcattcaaatggagggatgcgctgggcgctgtggctcacacctgtaatcccagcacttcgggagaccaaggtgggtggaccacttcaggtcaggaattcaaaaccagcctggccaaaacatggtgaaaccccatctctactaaaaatacaaaaattagccagacatggtggcgtgcgcctgtaatcccagctacacaggaggctgacgcaggagaattgcttgaacccaggaggtggaggttgcagtgagccaagatcacaccactgcgctccagcctggactgcaaaatgagactctatctcaaaaaaaaaaaaaaaaaaaaaaaagaacaagaagaaagaatgtcacagctctgccaatctaagacacctgtgcaagactgaggtgggcaagaggagtttcgtagaagaagacaggctggggtcaaactgggaaatttccagggaaaaagagggctctcagagtaaaagagtaaaggtggaaatgtgcccagaccaaagaggggcctctgtttgaccacagacctgctcacggtggagggcagcagcaggaaccaaggctgaggagcatccagatggagggactcaaggaagacttcctggaggaggcagtcgaggtcttgaatgatgggaagactttagacatgtacagataagcaggcatggcagggccagggaccatagcacatgcctgcaatcccagcactttgggattacactttgggattacacttagcactttgggaggccaaggtgggcagataacctaaggtcaggagttcgagaccagcctggccaacatggtgaaatcccatctctactaaaaaaaatacaaactattagctgggtgtggtggcaggcacctgtaatcccagctactcaggaggatgaggcaggagaatcacttgaagccaggaggtggaggttgcagtgagctgagatcacgccactgcactccagcctgggtgacagagcgagactctgtctaaaaaaataaaataaaataagaaggcatgccaggagctttctgaatgtggtaaactggacaacggccttctcagagatgtgcaacttccaatccccaaaacctgtgaagatgtcaccttatatggtcaaagggactttacagatgtgatcaagttaaggatcttgagagatcagccttcattattcagctgggcccaatttaatcacaaggacccctacaagtgggaggcaagagagcagagtgagtactagcaagagactggagccctgtgaggaagggtccatgagccaagaaatgcaggcagactctacaagctgcaaaggcaaggagcttgattctctctgaagcctccagaaggagaacagacctgcagacaccttgattttagctccataagactcacttcagacttctgagcttcaaaactgcaggacaacaaacgagtgtgtggttttttgttattgttgttgttgttgtttgagatggagtctcactctgttgcccaggttggagtgcagtggcatgatctcagttcacttcaacctctgcctcccaggttcaagcgattctcctgcctcagccttccaagtagctgggattacaagcaccctccagcacacccagcaaatttttgcatttttagtagagatggggatttaccatgttggccagcctggtctggaacttctgacctcagataatccacctgcctgggcctcccaaagtgctggaattacaggcgtgggccactgtgcccggcctcatgttttgttttgagccactccatttgtataatttgttacagtgccagtggaaaactagtaccccgcagaatcagtggaaattcaattcacacatctcccctacacatctccatacctcaggtacatacatttccttctggagatttcattagatcagaaagggctggaatgcacatgcatgtttggcaaatgtgggtgcattcgccattccattcattcattcacccagcaaatgacaggaatggagctaagaccatggttcatatcaatacccctgccctcagagagcccagaatctagtcggggacacagacaggtcaacaggtagttgcaatacaaggagataaaagcttttttttttaaagctcatcatcactggtcattagagaaatgcaaattgaaaccacaatgagataccatctcacaccagttagaatgacgatcattaaaaagtcaggaaataacagatgctggagaggatgtggagaaataggaatgcttttacattgttggtgggagtgtaaattagttcaaccattgtggaagacggtgtggcgaatcctcaaggatctagaaccagaaataccatttgacccagcaatcccattactgggtatatacccaaaggattataaatcattctactataaagacacatgcacacgtatgtttattgcagcactaattacaatagcaaagacttggaaccaacacaaatgcccatcaatgatagactggataaagaaaatgtggcacatatacaccatggaatactatgcagccataaaaaaggatgagttcatgtcctttgcagggacacagatgaagctggaaaccatcattctcagcaaactaacacaggaacagaaaactgcacaccacgtgttctcactcataaatgggagttgaacaatgagaacacatagacacagtgagggaaacatcacataccagggcctgttggggggtggggggctaagggagggatagcattaggagaaatacctaatgtagatgacaggttgatgggtgcagcaaaccaccatggcacatgtatacctatgtaacaaacctgcacgttctgcacatgtatcccagaacttaaagtataataacttttttttaaaaaaagccttttttttttttttgagacagattctctctctttcaccaaggctgtagtgcagtggcacgatctcggctcactgcaaactctgcctcccaggttcaagcaattctcctgtctcagcctcctgagtatctgggactacaggtgcacgctaccacacccagctaagagataaaaactttgaagaaggtaggcagaggaaaatgcagcacagaaaagagccaacgaatccagcttcccagatgacagagtgttgcagtacaacaggtcttactcagctaggcaaagagctgagagagcaaagggaatccaatcagatggaaccatatatttttttctttttttgagacagtctcactctgtcgcccaggctggagtgcagtgcaatgatcatagctcacagcaaccttgaacttctggactcaagcaatcctcccacctcagcctcctgggtagctaggactacagacgcatgtgcctggataatttttttttagtttttatttttttgtagagacaaggtcttggaccttggaaccatgtttaccaaatggaggctagaggagatatggggaactatggactaattgggtatgaccagaacagaggtcagaggctgggataagttgtttctgattacaaagtggagacaattgctgcatagctgcttcttggactctttcttggtcaaataaaagggccagcccaggcacggtggctcacgcctgtcatcccagcactttgggaggccgaagtgggcggatcacctgaggtcaggagtttgagaccagcctggccaacatggtgaaaccccatctctactaaaaatacaaaaattagctgggcatggtggcgtgcgcctgtaatcccagctactcaggagcctgaggcaggagaatcgcttaaacccaggaggtggagactgcagtgagcctagatcgcaccactgcactccagcctgggtgacaaagtgagacttcatctcaaagaaaaaaaaaaaggcaaataaaggggccaatgcagggaggttcatggcaaagacagggaaggctctggggacatctttcctacataacctgaatctatgttcatcgtcatgaaaagaagctccaggtggaaaaaaaaaacactgggctgagcacctctgcccctgtttctcctgggtgacaacttgcctggaatttctctccctttgaatgtcagtgccactaccggggacacctccgtgtgcattgctcccgtcacaccctgcgccaagaggcaacaaaaccctttcattgccaccctcatgagtaaaataaagagaaagagattcccgccctgggaacagcctaatttctccagctggtttctggtctgagacattgtcagatggtttgtattccaaatgaaatgaacgagccaactgtattatcatagtggcatgcagaaaatagccacatctttgagacagcattacccatggatactaactggatgatgtttggtcacaagggtgagaaaatctggagatgaaaagaagatgccagcctgggcaacatagtgagaccccatctccataaaaataaacaaaacattagtcaggcgttgtagtgcacgcctgtagtcccagctactcaggaggcggaggttggaggattacttgagcccaggaggtcaatgttgcagtgagctatgactgcaccactgcactccagcctgggtgacagagcaataaataccctgtctcaaaaaaagaagaaggagaaggagaagaaggaggagaagaaagaggaaggaaggaaggaaggaaggagaaagaaaaagaaagaaaaggaaagaaagagaaagaaagaaagtgaaagaaaagaaagaaagaaagaggaaagaaagaaagaaagaaaaagaaaaggagagaaaaagaaggtggagttgggccaggcgcagtggctcacatctgtaatcccagcactctgggaggccgaggtgggtggatcacttgaggtccggagttcaagaccagcctggccaaggtggttaaaccccacctctactaaaaatacaaaaattagccaggcgtcatggcatgggcctgtagtcccagctactcaggaggctgaggcaggagaatcgcttgaacccgggaggcagaggtagcaccactgcactccagccagggcgacagagcgagacagcatctcaaaaaaaacagaagaagaagaagaaggaggaggaggaggaggaggaggagaaggagaaggagaagaagaagttggagaggagaggggatggagtatctcccctttgcacaaggactgagttacaggccagactttccaagactatgtagagctctctaggactcctgacttcagagaataagatcagggctgtggcagaggaacagtctaagaggccgaggggacagaatcgcccaccttgtagcccagggatcgaacccctttaaaccactgaccttgtccctatgcagatctgggccaaggactgtgtgtaggcagaggaggcccgtagttcagaccaaggggaagattttgcaaacttgttcttaactgtcactacttatgtgcaaggattctgaagcttgacaagcagcattgtttcctccctgagcaatcagaaatcaataaaagcagaactctctgtacttaggagatctgcgttggtgtgggccgacacgcagcagaacatggcggagcgggtgggcaaagtgatggagagccctagccacgttccagatggtgcaggaagggtgttgcagctgagcacaaacaggggagaaagctgctccaacaaaaaccgccggagccacatgtggggaaagtcagacatttgcggtgcacgtggacggaggccctctggagagggctgcggttggtatccgtcatccccgctcctcatcagcagctgatgctctggcgacagaggctgttggctgggctagattggacgcgtggagcttaaatgaagctgcccaggcaagggagctagaagctctggctctgctgctaattggccatgaacctagggccagttatttcttgtctctggattcatttcctcattttgttttttggggtgtttgttggttttgagatggactctcactctgttgcccaggctggagttcagtggcgtgatcttggctcactgcaacctctgcctcctggcttcaagtgattctcatgcctcagcctcccgagtagctgggactacgggcatgtgccaccacacccagctgatttttgtatttgtagtacaaatggggtttcaccatgttgaccaggatggtcttgatctcttgacctcgtgatctgcccaccttggcttcccaaagtgctgggattacaggtgtgatctactgtgcccggcctaatttttgtatttttagtagagacagggtttctccacgttggccaggctggtcttgaactcctgacctcaggtgatccactggcctcagcctctcaaactgctgggattacaggcatgagccatggcacccagccatttcctcattttgaaaaggacagagaggaggtgtgaaggggcgatgttctcttcggtaacacctgaggtctctggtggtatcactgttggaaaggggccttgacaccctccaccccaaactctactaaaatgtgcttctagcaactctaaacttaaatcatttgtgatctttcctctagctttattagtcactgatctttctcactgggccaggaaataagcttgcaagggggcactcctccagatttcccaaggagagtacctctcggttgtaaattcaccaaaaatgtggaacatcccctcctactgggtaaagttggccaatgaagtggcaacctttgctaccatcactgctactgttttaggtctattttccaagaaaaagcatattaaaccagttttattgagacattacagaacataaaattcacccatttaaagtgtacaattcaatggtttttagtatgttcctagaattgtatagccatcaccatcaccatctaattcactacattttactatttccagaaagaggccctgcccattactagtcactctcattttgccccagccctaggcaaccaccaatctacttcctctctctagagatgtaaaacatagcattttgccccgttagggacatttcctacaactacgtatagcatcatcatatagcactgactaatcaagaactcatgacccatatataaatagccaacaaaaacatgaaaatgtgctcaacatcaccgatcattagggaaatgcaaatcgaaaactacaatgagataccatcttgcatccatccgggtggctactgtcaaaaaaaacagaaaataacgagtgttggccaggatgtggagaaatcggaacccttgtacattgttggtggaaatgtaaaatagtgcagctgctgtgaaaaaaagcatggtggttcctcgaaaaactaataatggaactatttatcagcgattccacttccgggtatatacccaaaagaatggaaagcagggcctctaggaggtatctgtataccctgtccctagcattattctcaatagccaactgtccatcaacccaactgtccatccacagatgaatgaataaacaaaatgtggtctatacatacaaaaaaaattcttttattttttatttttttggccaacatggtaaaaccccatctctactaaaaagtaaagaattttttttttttttttttttttgaggcagagtctcgctctgtcgccctggctagagtgcagtggcacgatctcggctcactgcaacctctacctcccaggttcaaggaattctcccacctcggcctcctgagtagctggatcacaggcatctgccaccacgcctggctaatttttatacttttagtagagacggggtttcaccatgttggccaagctggtctcaaactcctgaactcaagtgatccgcccacctcagcctcctaaactgctgggattacaggcgtgagccaccacgcctggccaaaaagtaaagaaattctgtggccaggcgtgggggctcatgcctgcaatcccagcactttgggaggccaaggcaggcggatcacttgagcttaggagttcaagaccagcatcctgggcaacaaagtgagaccttgtctctagaaaaaatacaaaaattaactgggcacggtggtgcacacctgtagtcccagctactcaagaggctgaggtaggaggatggcttgagcctgagggacagaggttccagtgagccaagatcacaccactgcactccatcctgggcgaaagagccagaccctgtctcaaaaaataaccaaaaaagaaacaaacaggctgggcaccgtagctcacgcctgtaatcccagcactttgggaggccgaggcgggtggattacccgaggtcaggagtttgagaccagcctgatcaacatggtgaaaccctgtctctcctaaaaatacaaaaattagccgggcgtggtggcgcatgccggtagtcccagctattcgggaggctgaggcagaagaatcgcttgaacccagggggcagaggttgcagtgagccgagattgcgccattgcactccagccaggacactaagagcaaaactccgtctcaaaacaaacaaacaaacaaaaagcaaggaaattctagctgggtatggtggtgcacacctgtagtcccagctactgggatggctgaggtaggagaatagcttaaggccaggagttcaaggccagcctgggcaacacaacacatgctacaacgtgcatgaaccttgaggacattatcttaaatgaaataagacaatgctgtatgattccatttgtatgactctagttacctagaagagtcagattcctagagactgaaagtaggatggtgattgccaaagaggaggatggggagttattgttaattttattttatttttgagacagggtctcactttatcacccaggctggagtgaagtggtacaatcacatctcattgcagcctcagcctcctgggtccaagcgatcctcccacctcagcctcccaagtagctcagactataggcatgtgccaccacacttggctaattatagactttttgtagagacgaggtctcactatgttacccaagctgatcttgaactcctgagctcaagggatcctcctgcctcaacctcccagctgtgcagcacgcggctgagttatggtttaatgggtagagagtttcagttttacaagatgaaaagagttctgaagacagattggtgatggttacacatcaatgtgaatgttgttactaccatttagctatacactttaaaatgcttgagttagtaaatttttttgtttttttggtttttcttttttgtttttgtgagacagagtcttactctgtcacccaggctggagtacagtggcacaatctcggctcactgcaacctctgcctcccaggttcaagcgattcctctgccttagcctcctgagtagctgggcctacaggcgtgcaccaccacacccagccgagttagtaagttttatgtcatgtgtactttattataatttaaaacaaaaaacctggctgggtgtggtggctcacacctgtaatctcagcactttgggaggctgaggtgggtggatcacctgaggtcaggagttcgagaccagcctggccaatatgacaaaaccccgtctctactaaaaatacaaaattagctgggcatggtggttcatgcctgtaatcctagctactcaggaggctgaagcaggagaattgcctgaacccgggaggcagaggttgcaggtagccgagattgcaccactgcactccagcctgggcaacagaacgaaactctgtttcaaaaataaaataaaataaaacaaaaaatctcatgacccacatcaaaaggtgtaggcaaggggtgcctttcttatgacacataaaacgcccactttttttccttttaaaaatacaaatataactttttattaaacagctaaacatagacaacattagcaaaatgctttttaaagaaatattattcacagaatatgctttaaaaaaattaacattcaagcacaatttgatcttttctcattaactcttcactaatatcaaacaggcgtaatcatttttgtaagactattttctgaatgcttaagcgcaaagaagaatgccaagtacataaatgtgcattaattcatctactcttcctgacaccaggaagtagattttaatatgatacttatcccatttctcagaattagaactgagagttagagatattaaagaacttgcccaaagccacaaacccggtgtcagagttgagacccaatctagtcttctgactccagaatcgatgctgtcttattaaaagacgacggttctcaaggaacatgaaaacagccattctctcatcagttaggggcctgtttaaacaaatccaccccaaaaagctttttcttagcattctctactaatagcttgcaaactgtcttccaaaaataatttttaagtctgcatcctttacaacaacaacaacaaaaaaccttcaaacaattcagtgtaaggacctttttttagtagaatgtggttttggagcagaagcagacgatgagttcttggccaaatcttacatcttttaaggcctcttctataaaatcggacaactcagaagtgataaggaccagaaacacgccaggtccatgttttttacatggcccttccagacatagatcccgcctccgccaccatctctacagagtcgtctagttccttctgagatagaaaggtcatcccaacagcaatgattctggtttagcaggggggatatttgaagcaggtccctttggaggaagtgggcccctcctacaagccaagctttcaacagccggagtttgtgttttgcgactccaaactgatcaccgttgactgtactaacgttggttctccaggacacatttggaaatgagacaaacagatcctcactgagtcttcgctggtctcctgatctattttttttttttttttttttttgagatggtcttgctccatcacccaggctggagtgcattggcacaatcactgctcactgcagcctctgacttcccaggctcaagcaatcctcccacctcagcctctcgagtagctggaactacaggcatgtgccaccatgcttagctaaattttttgtattttttgtagaggtggggtctcactatgttgcccaggctggtctcaaattcctgggctcaaatgatcctcccaccacggcctcccaaagtgcttggatgagccatgagccaccacacccggccttggctgttctcttgaatgaaggggattacaaactgggggtctcaggctggccctttcttgccttctgggtggtctggaagcagggacagccactctgcacagagtgcacgtcgcagcaagcacactgaggggatgcctggcttcttgatggctttcctcttcctacttaaagtcccttcctgagacacagttgtattcccggccttagatctcatatgtccctgaatcttttaaataaattattctctttggcttaaactacttccagatcattggggtacatgtcataagagaatcctaactgatacactattaaattcatttcttcatgacttgtatgaccactgaagttaatttgtcctattgtagtccagattcaaagaagaggaaagaatctccagacaagtgtggcccaccagcatgaagaggaaagctctccaagccatgaggaccaaaaatgagccccatcctcctatgctcctctagaaaatgtgcaacaacaaaatatataaaatatagtttggttgccaaagagaggtcaaatgttgaactatgacagtgatggcattcaaatgcattcatctttaatgctgcatctgtctacaaaaacgaaaacaaagcaagtaaagctccttggttaaaaatagtgctttttaattggctgggcccagtggctcacatttgtaatcccagcactttgggagggcaaggcaagcggatcacctgaggtcaggagttcgagaccagcctggccaacatggtgaaaccccgtctctactaaaatattaaaattagccaggtgtggtggcacacgcctgtaatcctcatctactcaggaggcaggagaatcgcttgaacaacaacaaaaaaaaatagtgctttttaaagcaaacaggtaagggcaagggaaaggacattgactgggaggcaaggagtaaacttaaagggaaaacagcatcccacagatgtgcccttgaggttgacgccaagccagaaagggtggttccctacaattcatctggacccctaggaaggggcaaaagttcagaaatcctaagctttaatataagggagaaggaagagtggagggcagggagtcattttcttttttttcttttttttaaaattattatttttttttgagacacagtctcgctctgctgccaaggctggagcgcagtggcgtgatatcagtgcaccacaacctctgcctcccgggttcaagcaattctcctgcctcagcctcccaagtagctgggaatgcaggcatgcaccaccacacccagctaatttttgtattcttagtagatatggggtttcaccatgttggtcaggctggtctggaactcctgacctcaactgatctacccgcttcggcctcccaaagtgctgggattacaggcctgagccaccgcgcctggcccattttcttagattaagaagcaacacctcccatggtccaagccagccgcctcacactccgtaaataaaccatgctgattcaaacccaaatggctttgctcagctctcaccaagcctggaagatcttcccttctcctgtctacttaatccagtcccagccatcccttaacacctagtataaaaggttccttcctcgctgtcatctctctgatgtccctctcaaccagattcccacagcacagagaatcacagctggaatggccctgatggaaagcatccaacttggccatccctcctgctgaagctcttgattatgtgtctgatgtcgactgttgtgttgagatgggcaagaacagaaccacaaagaagttccctcctcctctgagtgatcaagccccagccatctggagaaaccaaggtgaaaaagtgactgagaagcgtgtcaacagataaattacccaacttagcaagccacactcgcagatcggggtcttgtctttacagagatcccatattttccatgaaaccacctttattatcatcacctgttggaaacagaatgggtaaagagagatagggaaggaaaaatatgaatgaccaatgatctaatttgcagcagataggcccaggaacagctgcggaggtgccatgactgctcacagccccaccgacattgcagtgtgaccgtctgcgtgagctcctaggcagcgtccaaaaagtcaacccgacctgcacatggatgctgcccggaacatttggccaagaggggtctctgtattcagctccagatgctgacattggctggtggtgattctgaccccctcaccctcaccccatttggattttaacacgtgcagggtctcagctgttcttaggcctcaaaacagtaaccaggagtcaaggcataaagctgggtggccctgacggctccttgctgatggaactgacttctctgaagacaaaagacatggattaacaaagcctgaggatacagaatatttgaaatccacacagaaacttggtgcccttcctgtcaccacggaattagccctgggatttacagtcatgcactgcatactgatgttttagtcaatgatgaactgcgtatgcaacggtgttttttttttcctgagacagggtctcactctgtcacccaggctggagtgggaatgcagtgtggcacactctcagttcaatgcagcctcgacctcccaaggctcaagcaatcctcccacctcgatctcccgagtagctaagactataggcatgcatcaccatgcccagctaatttgtgtatttttgtagagacaggggtctcactatgttgcccaggctggtctcaaactcctggactcaagcaatctgcccatcccagcctcccaaagtgctgggattacaggcataagccaccacgcccagcctgcaacagtggctctataagcttataatacagtatctttaccgtaccttttctatgtttagatgtgttcagatacacaaatacataccattacattacaattgcctacagtactcagcaccgtagcctgctgtacaggtttgtattgcttgccatatagcatcggtgtgtagtaggctgtgccatctaggtttgtgtaagaacactttgtgatgcttgtacaatgattaaatcacctaaggatgcatttcttagaacatacgtattcccatcattaagcgatgcatgactatatttctattaatgatcctgccatcttcttccccatcctctagacttgctgatcatcttggattccacttttttttttttttttttttttgagacggagtctcactctcgctcaggctggagtgtagtagtgagatctcgactcactgcaaccgtcacctcccgggttcaagcaattctcctgcctcagcctcccgagtaggtgggactacagttgcacaccaccacgcctggctaatttttgtatttttagtagagacggggtttcgccatgttgacaagactggtctcaaactcctgacctcaggtgatccacccacctcagcctcccaaagtgctgggattacaggcgtgagctaccatgcccagccgaaattttcttttcaaaaaacagactgttttctccaggtggtaacagaagagcaagtcaggtacttaaaataggagggggatttgatgcactgttgctagattggaaatggaggggccacaaggaaaggaccagagagtggcctctaggagtggagagcagcacccagcagacagccagcagggaaacgggggcctcaacctacagctgaaaggatggaatcgcccccacctccatgagcttggaagtgggttctttcctggaacttctggatgagtgcctggccccctcacaccttgatttcagcctttccaggtcctgagcggggggcctggtagagcctgcctggacttctgacctatggaactgtgagatgataaatggatgctggtttatgctgccacattgtgtggtcatttgttacgcagcaacagaaaactaatacagtctcctaactggggccagttaccaaaagaagacatttcggcggcagaggggagtctccatgactaactttgtcttcttcacacatctcctccccgtctagaaagccttcctagccccagtgggtaccgtcctctgttgctgggtatctcccactcccttggccctgggcaaacactgcctgtcggcgggaattccctgctcctctatgacttcaccttcttcttcttctccaaagcattcaacacagagcaagcacacaataaatatttgctgattcagccattttctttcagctcctatgaccagcaggaccaatgaaggggttcaaaaactgcctggccacaggcagacagagagcctttcccctcagactctggcttcatggcttcccaggattcacaaagcgcctggatggtaacatgccatttccgaagcttggccttttttttttttcattttctttttctttttttttttgaggcagagtctcactctgtcgcccaggctggagtacagtggcgtgatcttggctcactgcaacctctgcctcccgggttcaaggaattctcccgtctcagtctcccgagtagctgggactacaggtgcatgccgccttgtccggctacttttttgtattttagtagggacggggtttcaccttgttgcccaggctgctcgtgaactcctgagctcaggcaatccacccgcctcgaccttccaaagtgctgggattacaggcttgtccaccacgcccgctcagccgcttggcctttgattaatactggctagtcatgctttcaagctccatttctgtgaattatgtcctgggtttttaggctgatgtgcaactgactttgtaaaacaaaggaagtgagaatgaggtctcacaaatgcattacttgtatttgttcaacaacaaacttatcctgaatatctgttgtgtccatgcaccaagctcaaccctggagacagagaaaaaaactagagtgacccttactgtagagctttaatcaaagtaccccctgatcacagaggtcactgcagtctgtggcagtttggaaacgaggagaccaaatttcctcaagtcagacaaatgagtgacaacagaatcaggtcttctccaggcagacagtgggtggggttcccttctgtgttcttccctgcccccatgactctgggcctgtcttctgtgccccaccctggacctcaataacatgtatatgatgtcactgtctagatgtgcaacagccttggcaaatttcatccagagccctcaaacacagattaaaaaacaaatctaggccaggcacagtggctcatgcctgtaatcccagcactttgggaggccaaggcaggtggatcacttcaggccgagattttgagaccagcctgggcaacatggtgaaactctgtttctactaaaaatacaaaaattagccaggtggggtggcaggtgcctgtaatcccagttactcaagaggctgaggcacaagaatctcttgaacctgggaggtggaagttgcagtgagccaagattacgccactgcactacagcctgggcaacagcacaagactctttcttaaaaataaataaattaattaaaaataaatccatagcatttgcacagacccttataatttacaaggcagtgtcatattaattctcagttaaccctcctaagtagcctaacaagttaggtggcgtagagattattatctccattttacaaataagaaaactgaggctcagagactagaagcgatttacccaagtcacacagtgttcttctctttttaccatttggatctagtcttgggactagatgggaattcaaatggagattggccaagctcaagccgaccttagtagctgatgatctgagagctttcaaagaactcacatctttcttatctcacttggttctcagaacaatctcataggattaacaaagcaaatataatgtcaccagagattggatcagaattagtccccaattctgattccaatgctctttccatacactaggggaggccttcccaccactcatactctactgctgctcctttagtcttaaagggtcaaaaccaaaagaagatcgacacccttcttttgtgtgtccacacaagtcctacttaaaatgacttttaatatcactatgtgctcccctgccaaaaactggccctacaaacagcccttctcccttctggttttaggattactttactgtcacccacccaagcgggagtgcagtggggccatcatagctcaatgcagcctcaacctcctgggtaaagggatcctcccacctcagcctcctaagtagctagaactacaggcacgtaccaccacatccaggtttgttttgttttgttttgtttttgagacaagagtctcactctgtcgcccaggctggagtgcagtggtgtgatcttggcttactgcaatctccgcctcctgggttccagcgattctcctgcctcagcctcctgagtagctggaattacaggcacgtgccaccacacccagctaatttgtgtatttttagtagagatggggtttcaccatgttggtcaggctggtctcaaactcctgacctcgtgatccacctgcctcagcttcccaaagtgctgggattacaggcgtgagccaccacgcctgaccaacaccctgctaattttttatttttatttcttgtatttttattattttattctttgtattgtttatatttgttgcccaggctggtctcgaatttctggcctcaagggaacctcctgcctcagcctcccaaatcactgagattacaggcatgagccatggcgccaggcctagaactgattctttagaactcaaataccagagagaatagaatctgttcactcatttagcaaccattttctgagcagaataacacactaggctagtcatcaggagtttaagaaatgaatcagatatagtccctgctaacaagaagctcacaatctcgtggaactgatgaaaacactcttaaacacatgatgagataaaataaatgtcacaataaagttgtaaacaaaggactgcagaggaacagagaagacagcaataatcctaactgatgagaagaaagtgtcttcatgaaaaaagaggcatttgggctgggccttgaaggatgaatggggactcctgacgagtaggaagatgcaggctgagaaaagagcataaatatttggataacagggatgtctccccaggaaggccacacaaagtgctgcttggccctcaacctcacagtaacactagctgggatccagctcagaccctcaggctagatctaggtggatccaacccccaacttgaggaaacccaagacacctagagacaactagacaccacttgctcctttctcttttctcttttgttgagacagagtctcactctgttgcccaggctggagtgcagtggcacaatctcggctcactacaatctcctcctcctgggttcaagagattctcctccctcagcctcccgagtagctaagattacaggtatgcaccaccacacctggctaatttttgtatttttagtagggatggggtttcaccatgttggccaggctggtctcaaactcctgacctcaagtgatctgcctgccttggcctcccaaagtgctgggattacaggcatgaaccactgcgactggccacttgctcccttttttagggctctgcagtatctacagcctataccatcaaattcttctttttttttttctgaaactgagtctcactctgtcacccaggctggagtgcaatggtgtggtctcggctcaatgcaacctccgcctcccgggttcaagcaattctcccgcctcagcttcccaagtagctaggactacaggcacttgccaccatactcagctaatttttgtatttttagtagagacagggttttcattatctggtcttgaactcctgaccccatgatctgtccacttcggcctcccaaagtgctgagattacaggcatgagccaccgcgcccggcctcaaatttttttttttttttttttttttttttgaaacagggtcttgctccatcacccagactgcagtgccagtggcgcgatcatggctcactgtagcctcaacctcccgggtagctgggactacaggcatatgccaccatgcccggctaatttttttttttttttttttgagatggagtctccctctatcacccaggctggagtgcagtggcgtgatcttggttcactgcaacctcagtctcctgggttcaagtgattctcctgcctcagcctccctgagtagctgggactacaggcgcatgccattacgcccagctaatttttttttttgtatttttagtagagacaaggtttcaccatgttggccaggttggtctcgacctcttgacttcaggtgatccacctgcctcagcctcccaaactgctgagattacaggcgtgagccactgcgcccagccaatttttgtattttttgtagctagggtttcaccgtactgcccaggttggtctcagactcctgagctcaagccaaccacccaccttggcctccgaaagtactaggattacaggcatgagccactgtgcccaccgtgtaccaccaaattctaaccgccctcttaactactttcattttctcttctatagttagcttttgtgttttgctttcccaactactctaaagtaccagtctccttattccttgagaacatagccagggggcgtatatatcctgtcacagctactatcaggctaggcacaccacagacactcccaacctatttgttgacagctaaagtctacaggcctaagaatcacaagatggacagggcacagtggctcacgcctgtaatccctgcactttgagaggccgagggtgggggggggggtgtggatcacctgaggtcaagagttcaagactagcctggccaacatggtgaaaccctgtccctactaaaaatacaaaaattagccaggcgtggtggtgggagcctgtaatcccagctactctggagactgaggcaggagaatcgcttgaacccgagaggcggaggttgcagtgagccgaaatcatgccattgcattccagcctgggtgacagagcgagactctgtctcagaaaaaaaaaaaaaaaaaagaatcacaagatgactgtcttacaagcaagtagagcaagaaaaggcaggatgtgtaaccctggccaggaatagaaacagtgaaggaattaggagaagggatatacttctggtttttggattacatttcatagaaatggtctaaatttaaggtgctcagacttgctcgatgactatgtggcactgccctgtatctcaccttctgctcttagaccaaggtcacaagctcagtctttaatccattttccgacttcctgcttgtcaatatctcccattgagacatggtgtctcatctttcctcctaaaaagagtaacgggaaggatggcatagatgccagtgccaatctggagacctcaaatccaatgccagaggagagagggggctggaggtgggggtgggaaggactctgagacagataacagcttcctcctagttggtctccagtgagctgagactcatctgaagtaagacttcagggatgaacagaacagataaacagggaaatcggattggttcaaaacccaaacaggtcaccatcccccaaggatgggtcatgaacaaccaattaggacaatcagctaggagtagggtggggaggaggcaggtataaaaagcgccaaagcagcctggcctggtggctcatgcctgtactcccagcactttgggaggccgagatgggtggatcacgaggtcaggagtttgagaccagcctagccaacgtggtgaaaccctgtctctactaaagatacaaaaaattagccaggcatgttggcacatgcctgtagtcccaactactcgggaggctgaggcaggagaatcgcttgaacccgagaggcggaggttgcagtgagccgagatcacgctgctgcactccagcctggctaacagggagactctgtctcaaaaaaaaaaaagatacaaaaaaaatgagctgggcatggtggcgtgtgcctgtaatcccagctacctgggaggctgaggcaggagaaccgcttgaacccaggaggccagaggttgcagtgagccaagatggcgccattgcactcagccctgggcaacagcgcgagaccccatcacaaaaaaaaaaaaaaaagaaagaaagaaagaaagaaaaaaaaaaaaaagaaaagcgccaagcactggtgggttcaggagcataaaactttgattttaggtattatccagtccagctctcttctgtaataccgtagtggaggtcctcaaactttccttcctgtaatagtctaatcttcttctaaccggtgtctctctcttcctctttgacccttttaattcatcctccacgttgcagccacagtgatctttctacaacacagagctgatcatgtcttgctgccctcaggataaggtccgaagttcacatgttctaccaaggcccttgactcctgagaccacacggaccttcaaatcttgtctctcttcaccctcacccttctctacattcctctgacaatattccccaaagatgcaacagacttactccagtctgccaaaggaattccagtttcaagggctagctcaaatgtcatcttttcaattaaatctaacctgactcactcacttcccctaggatattagtttctcttccatacttcaaaccaccttagtgcagtattgcattcattaccctgacttgtattcatttgcagagactgagagaccatcatggtgagggacagattttgacttctcataaccctttctgtccttagttagcacagcagaagtcagcggtccaaaaaaaaaaaagtttaagccttgtgcggtggctcattcctgtaatccaagcactttggttggccgaggcaggaggatcgcttgagcccaggagttggagaccagcctgggcaagatggtgagaccccacctctaaaaaaaaatttttttttttttttaattagccaggtgtaatgggactgtagtcccagcttcttgaagaggctgaggtgggaggatcgcttgagcccatgatggcatcacttcactctagcctgggtaacaaaacaagactctgtctcaaaaaaaaaaaaaaaaaaaaaaaaagtttacttaaagaatgaatgctcttagactaggcgtggtagctcacacctgtaatcccagcactttgggaggtcgaggcaggtggatcacctgaggtcaggagtttgagaccagcctggccaacatggtgaaaccccgtctactaaaaatataaaaattagctaggcgtggtggcatgcacctgtaatcccagctactcaggtggctgaggcaagacaattgcttgaacccggagggtgcatgttgcagtgagccaagatcgtgcaattgcattccagcctgggcaacaagaacgaaactccatctcaaaaaaaaaaaaaattgaatactcttcctttataaacacacagtgagctcctggaagagcccaggtgagacctgggtcatctgatacccagatcagggcactgctttctgaagctgctgattctgcctgttctccatggccattcagctggatggctcctcactgacctggactttgaaacatcagtacggtgacaggcatttgcagaagcaggaacccaaactgctgtctctaaggagagcctctgtgcttgtcctagggaagtgttttgattcccaagggctttgagctgcactgtaggcggccacagagcaggtgagtcatcccagcccacacccgttctctgcggaagggccctagcatctgtctgtgttgggtgttatgggaaataggtgctctgaactgactggggtcccagggagggaggactgccactatggccaaggtttccctcatccccagtggtgaaagcaggaggagtgatggccttcgtctatcagaacaaacataaagggacttgggagcacaagtgatggcctcagaaaagctgcagcatgtgataaaagtctagggacacagctcaccactctgctgggccccatctggagagtcgaatatgtagggtctggggggccttttacctaagcagcctgttccccactgcctgccctcattagtgtctcttcacttccccaaattcaaagctctcttgccagacacagtggcttatgcctccaatcccagcagtctgggaggccaagacgggtggattacctgaggtcaggagttcgagagcagcctggccaacatggtgaaaccctgtttccactaaaaatacaaaaagtagctgggcatggtggcgtgtgcctgtagtcccagctactcaggaggctgaggcaggagaatcgcttgagcctgggaggtggaagttgcagtgagccaagatcatgccactgcactccagcctgggtgacagagtgagaccctgtctcaaaaaaaaaaaaacaaaacaaaaaaaaacccaaaaacacaaatttgaaactctcaaggaaaacacaaggaatttctccctaggagtgccctaccatcacgctagactcaaccaggacatttatcatacagctgaatattgtttttaagcaaagttaacatgtaaagtagaggaagatatcttcactatacaaacccttttccccataaagggctcccctgatgcgtgcattcactggcggcttgctagtttaaggtcctggaaagattcaagtactattgcagaataatccctgtcccccacaacaaagaaaataaatcacatgcccaaattactgtaacacaaggagtaacgtaagaaatccttcagggaagggtaacaaaggtaagtttgggaatctggaggcaaatgagatccaagggacacaatgggggaggtggcactggaactgggcttggatgttgccattcagaaaccggtgaaacggcctcccagatggaggagccatcagcagcaaaggaatagatggatggaatgacagacgatggatggaatgaaatgttaggcactccacgtggaaacccacaagggtgagctgaaacagcaccttccacacactcgagccccggggatacaagtaacggcacaaggaaaaggctctgacttgcaaaggtataagataaacccaaatactgcagcagcagggtttattctttcttttttttttttcaagacggggtcttgctatgtcgcccaggctggagcgcagtggcctgatcacggctcactgcagcctcaaccactgcacccggccacgccctgctaatctgtttttaattttttgtagagatgggggtctcactgttgcccaggcacagggtttattctgagtgtgaagggtgttagaatggactttgggattagaccagagttcaaatgccagctctcctcttaacagctgtgtaatattccacatgttccctaaccagccttagttttctcagctgtgagctctctgacttttttacctaataaattgctatgaaattaaatgaaatctagatatgaagcatctggcacagcatgtcaggcacatagcatgtgatcaatacatatcaggttccttttccatgcttgaggggcttagattatgaacaacaactgaaagacttcatgggaccctccaggaaagaagaggccagtaaaaaggggacacggcagtaaagcaagaggaaggcatggaagaaatggctcggcgctttccagcagaggtttctgctccacagcaggccacttgcagggtgctggtgaaactcacccaccaaactggttgttggctcatccctgaatgctgtgttccaacagcagcaccagtgatgcaatcagcagaactgagctcgtgggtggagccgtggggaggagttgagcagggagagaggtagcaccctgggcccctgcccagactgtggggtattaggaataaaggtgtgggtaaagagggcttcagagagacttttgtttgtttgtttgtttgtttgttttgagacagagtctcactctgttgtccaggcaggagtgcagtggcacaatcttggcacactgcaacctgtgcctcccgggctcaagcaattctcctgcctcagcctcccaagtagctgggattacaggcgcccgctaccatgccctaatttttgtatttttagtagagacggggttttgccatgttggccaggctggtctcaaactcccgaccttaagtgatccgcccacctcgggattacaggtgtgagccactgtgcccagcccatactcttttttaaattccaaaagctaacctccactaggaaagccaagcacaagtccaaggcttttttcagactttcatgcctgcccttttcacctgaagaagctggcctattacaggccaacaggagacacagcaaaaggcacagggctcatctctgcagagaccctccgagtcccaaggagaagaggccccgctaaggctcctcagggaggtttactatctaaccctatttatgtctgctcctcattcattcattcattccacaaacattcacaggggaactactatacaccagataagactctggacgggaaaatgacagcttagctgttcatacctccgtccctcaagctgtttcactagtcagtttctttatctgtccaatggaggaaaccgggtttatgggaagatgcaatgagataatggacatgcctgacacagactaagtgtctaagaaacgtaaactatttttatggtagtagaagcaagattgcctgtgacgctgtatatctttcatttgcctcttcaggtacatttctccttttccatgctgcactgcaccctggaattggcctgtatgcgctgcatcgagatgctcttgccctctgactgccagctgggtttggtccatgtggagcctggaatcaaaaccagagggagaaggtggggacagggtttatggtttttattcctccaagtccctttttgagctccttgacttaaagtcccagctctagtgagatcgccctccacacaacctgcctccaggtgcagaggtggtaagatcccactgtcaccagccccagaatattccacattccatagcagtttccctatatcctgcctcaaagcccccactttaaatgtccccaatttaatctgttttctgctggatcctgactaatacaaagagtgtagagaacaagggcaggcctgggaatcgggagacctgaatttaagtctcatctttgccaccagctccctccgtgaccctgggccacatttttccatttccaggcctcaaacttcctcaattttaaaatgagtgggttgggtccggacacagggcctcatgcttgtaatcccagccctttgggaggcggagacaggggtattgcttgaggccaggagtttaagtctggacaacatcgtgagaccctgtctctaaaaaaaaatatatatatctatatatatagatatataatagacatatatagtatctatatagatatatagacacatatatagtgtatataaagatatatagacatatatagatatatatagacatatatagacatatatatagacctatatagactatatatagacatatatatagacctatatatatagactatatatatagacatatatataggcctatacatagactatatatatagacctatacatatagacacagactatatatatagacctatatatagacatacagactatatatagacatatataagacctatatatagacatatataagacctatatatagacatatataagacctatatatatagacatatatagacctatatatatagacatatatatagacctatatgcatatagacatatatatacctatatatagaccaatatagacctatatatatagaccaatatagacctatatatatatagacctatatatatagacctatatatatatagacatatatatagacacacatacacacacacaaatgagtaggctggactatatggctctttcatgatccaattccctgccacttctaggtgttaagttacaggaggaggacacagatgagaataaaagctccctagtgaatacggcaatgatggccaggttggccactaagcagctctccccactctccaccattgtatcagctcattcttacccagaagtcacctaactcctttccaaggactttccttctcttctcaggccatcagggtaccagatgtctaaatgatctccactccaaagcaacagccaagaaaacccaggaaattaaaaataaattcctttttcctttcagtaactccctgcccagccctgggttagctggagaggtcccttcccaggttccagtatacccagggggccaaacagggaagccgttccacactgacaccaaaacactctcacagggagtgatctatctctgccctgggaaatgctggggacacagctggcttgcagggcagagggagtgacctaaaccagcatcctgtcagaagacatgcaatgccctgcattgagatccctgtcactgggcaggtttcaaagagaggccaggcagggtgcggttgctcctacctgtaatcccagcacagaggctgcagcgggagaatcgcttgagataagacgtttgagaccagcctggcgacagagcgagaagcccaatttattttattttatttttgagacggagtttcactcttgttgcccaagctggagtgtagtagcacgatctgggctcactgcaacctccacctcctgggttcaagcgatcctcctgcctcagcctcctgagtagctggaatcacaggcctgtgcctccacacccggctaattttgtatttttagtagacgggttttaccatgttggtcagactggtctcgaactcccaatctcaagtgatccacctgccttcgcctccctaagtactgggattacaggcgtaagccacagcgcccggtaaacttttttttgttcgtttttgtgtttaagacagagtctggccttgtcaggcaggctggagtgcagtggcttgatctcggctcactgcaacctctgcctcccagcttcaagcaatcctcctgcctcagcctcccgagtagctgggactacaggcgcccgccaccacgccggctaatttttgtatttttagtagagggtttcaccatattgcccaggctggtctggaactcctgactttgtgatccgcccgcctcagcgtctcaaagcgctgagattacaggcttgagccaccgcgcacggcgttagcaaaaattctttcaaataaaaaattagccaggtgtaatgatgcacacctgtagtcccagctactgggaaggctgcggcaggaggatcgctcgagcctgggagttttgagattgcagtgagctgagatcaggctactgcactccagcccgggcgacagagcgaggctccgtctcaaaaaagataaaaaagtaaaaacctaaattagccgggcatggtggcgcgcgcctgtaattccaagtactcgggaggctgaggcgggaggatcacccaagcccagggagttcgaggttgcagtctcaaaaagaaaaaagagtagaaaagagaggaagaaggtaggaaggaaggaaggaaggaaggaaggaaggaaggaaggaaggaggaaggaagggagggagggagggagggaagaaagagaagctaatgaccacttgatcctcgtaaggccttttcagttcctaaaatgactgattcaggaaaccccaagagccacaagagtcattctattcagatgatgaccctccctgaccctcctggtttctggagttttcattcgctaagggctgcccttcggttttcaattactggcggagagggcggttcgtttctggcggggaagggaggtgacattccggtaggagaatctcctaaaactcgcatttcctgtttgccctgggcgccggcctcaggtggaaacctcaccccgataactgagggcagcagtcggccttgggcgttcttccgtcacccaggtctccagaacctcccggactcaatggcaagtcactgcacaagttcagggccttttcggtcccgatcgaggatctggagatctcggggcttcccggtcgtctgccccacagcccacgaggcggaccgacctgcggggtgaggcaccgggagcgcatggcagccccggcctcggcctcctggcgccctcccagccacgcggtgaatgcctgagaggacagaggttcgcggccctccccatcccaccggcagcgaccgcaaagcccgggagctgagtccgcggcgtgaagcggcggaggtcagcagcgagggggcagggccggcgctggcggccacggagcttgcgcgtcgctgggctcggaacccagggacgcgagccagcgctgggagctggcggagagacggctctgccatccggctcaggcagtgggcgcccgccccgcccccagcgcccacgcgactccggccccgaggctctcccgagcgcagcgttctggaagcgccgccgctaagcgtctgcgtctgcgcctgcgctgaccccagtcccggactcggtccgaggcgcgcagcccggagggggcggggccgagcccgaagggaaggcagtgcgcatgcgcggggcgagccggccggcactgtcacagctgagcggccgcgagatcggtccctgtccgcagggtcgggtagtggccccctcggggacagcgtgtgaggattcgggcgcgaaggacggggtcagattcagccaggtgcccactttccccacggtcacgaccctggtccagaactgccctgccccgggcctcagtttccccactaaggagaggaggcgtgccggggaaatctgaggccctccccagccgcgaccttttccctcagacgaaggaagagtggtcgtacccggccgcgatcaccgaagcctccagccctgtccccgcacggatgctggaagcccgtccacgccgcgcggggagtggtggcccgggtgctcctacgacctgggggccctgtcaccgcgatcttaattgattcccaaaggatccagaaaagggacacattggcgcccgcccagggcgggcggggtcccccgggcggccaggccgatggggtggatgggcttctgctcgcggccgccttgtggggcgctggcatcggattggagtggggcagcatcgggggaggacagagaccccacgctccccccaacgcagcagacccaggggcaggcccttggctcctgcatgccacgctccggcctccccatatcgccctagcaccgctgcccgctggtcttcccttctcagaaacctgcagtggcctcaggcctagactccctgggcttcccctgaaggcccagtattccctaattcacctcctctcaccttggctgctcttccattcccttatccccgccacacacagcggtcttcccttgtctgcgtctgggcgccctcgatcttcccgtgctccacccccctaatctgtgacccaccaaacctgcccatccctcaaagtgtagctaaaactccactccttccccaaccaaactccatagccccacagtgtgtctcagtattctctgaagagccctgaggttgtgtcaattgattcttctcaacagaagtaatccattacataatttatcaacttatatgcattgatcaggctttgcaaataattacatttgcaaatgagaaagacagtcctttgccagacccctgtatcctgatttgcaattgtgcgctgtatcccttactagatggctacatcccccaggggagagactatgccttaatatgcagaatatctaaatttttttggaatcgtggtgggaaaaaattaagaagtttggaaaaaatggaaatataacatctttttgcactcttcacaatacaaaatctcatcttttagtgggtctgaaaaatatacagtgcacaatatgctgtcagctctagattaccgcaaatcaatgtgatggaatagagtagaaaggatattgggatgggtacgaaattggccttttggtgtggtttgtcttgcattagcagagtgaactcaggccgaactcaggcaaaactgcacctctgtagatgcagtttccccacattagatttggatttaggaataagaaatatccctgcccccatctactttacaagatcatggtaaagatcaaatatgaaatggagatggagttaagatttttttaaagtatttttttgttcaggaaataatcctcagtaaattttctaatgaaaattactttatatatatatatatgtgtgtgtgtatatatatgtatatatataattttttttttttttgagacggagtctcactctgtcacccaggctggagtgcagtggcgccatctcggctcactgcaagctccgcctcccaggttcacgccattctcctgcctcagcctcccaagcagctgggactacaggcacccgccaccacacccggctaatttttttttttatatatatttagtagagacggggtttcaccgtgttagccagggtggtctcaatctcctgacctcatgatccacccgcctcggcctcccaaagtgctgggattacaggcgtgagccactgcgcccagcaaattttttatatattttatatataaaaaatataaaatatatatagatatatatagagatatataatatatatatatttttttttgagacagagtttcgctctgtcgcccaggctgtaatgcagtggcgcgatctcagctcactgcaatctccacctcccaggcttaagcgattctcatgcttcagcctacaagtagctgggaccaccggcatgcaccaccacgcccagctaatttttgtatttttggtagagacggggtttcgtcatgttggccaggctggtcagcattctacagacaacctcatgtcacatcacactactctcagtttctatttgttttgttttttaacggagacaggttcttgctctgtttcccaggctggagtgcagtggtgggatcatggctcactgcagcctctacctcctgggctcaagcgatcctccaacctcagccacctgagtagctgggactacaggcacatgccaccacacccagctaattttgttgttgttgttgtagagaggaggtctcactatgtttcccaggccagtcttgaactcctgtcctcaaatgaccttcccaccttggcttcctaaagtgttaggattacaggtgtgagccacctagcccagccagtttgtttttctaatgcttttttattgcctttactttcttctaaagaaaaatgatctgaggtgagaggatcacttgagcccaggggtttgagactagccggggcaagatgacaagatcccatctctctaaaaaaaaaaacactcagcctggagtgtagtggtgccatctcagctcactgcaacctctgcctcctgggttcaagcaattctcctacctcggcctcccaagtagctgggatgacaggcaccctccgcaatgcctggctaatttctgtatttttagtagagactgggtttcaccatgttgaccaggctggtcttgaactcatgatctcaagtgatctgcccacctcggcctcccaaagtgctaggattgcaggcatgagccaccgcacccagccaaaaaaaaaaccttttttaattagctgggtgtggtgatgtgcacctatagttccagctacttgggaagctgagctgaggaaggaggatcgttagaggccagtaattcaaggctgcagtgagctgtggttgcatcacgtcacccagcctgggtgcagcctgggtgacagagtgagaccctgtctcaaaaaaccgcacagacaccttctttactcccccaaacccacttattcactctgatggcacacgggtgatgagctcctgtgtgtcaggcactgtgctaagtacctggccacctgtttccccacactcatggactttacatatgtatttgcacacaccttttgcatataaccatgtgtaacccccatggattcagatgatacatccacttacccttaaaaatactccattcatgcccctcactttatctatgtttatcctggtcccggattgtgctttctccgttttctgtttctgtttctctatcatcttaatggcagacaatgtgaagatggtgaggcttgtgaaacagtacaattttgaggcagattctggcatattacttaacatttatctttaaaacagtcctccttcttccaggcaagagctctggatttctcccgggaaagggtggaagagggacgcagggttgggtgggtgaacaggagtggccttagttgggtcatgttgctcagttgctcaaagaccaaggactgcagactctccctttctccccagggcccagttttttccctttcaaaacccgctgtctacctgcaagatggctcacatctctaatcccaacactttgggaggctgaggcaggaggatggaataaggccaggagtttgagaccagcctgggcaacataatgaaacctcatccctacaaaaaaaaaaaaatgtttttttcaattagtcagacatggtggcatgtgcttgtagtcccagctactcagaaggctgaagcaggaggattgcttgagcccaggaggttaaggctgcaatgaactatgatcgcgctactacactccagcctgggtgccagagcgagactccgtctcaaaaaaaaaaaatgggtagatgtggtggctcaagcctgtaatcccagcactttgggaggccgaggcaggcggatcacttgaggtgaggagtacaagatcagcctggccaacatggtgaaaccctatctctaccaaaaatacaaaaatgagccaagcatggtgttatgtgcctgtagtcccagctactcaggaggctgaggcaggagaatcgcttgaacccgggaggcggaggttgcagtgagctgagatggcgccactgcactctagcctgggcaacaatgcgagactccatctcagaaaaaaaaaaaaaaaaaaatcgaaaacaacagaaaaccagccgggtgcagtgactcatgcctgtaatcccagcactttgggaggccaagatgggcagatcacgaggtcaggagatcgagaccatcctggctaacgcagtgaaaccccgtctctactaaaaatacaaaaaattagccgggcgtggtggcgggcgcctgtagtcccagctactcgaaaggctaaggcaggagagtggcgtgaacctagggggcggagcttgtagtgagccgagattgcgccactgcactccagcctgggcgacagagcgagactccgtctcaaaaaaaaaaaaaaagaaaaagaaaagaaaacaacaaaaaacctgttctcaagcaagatgtgaaactccttcgaagaccccagaagtaaaacataaaaattaaacgacctctgctctgaagaggatactagaaacaggaaaatgtgatagaaagggctcagggagtcaaggacgcgttcaggtttctctaaagacaggtccaagcgggaggctcacgtccacacttcgtggaggaggagaacactttctggtgaagccaaggggaggtggcagccttaccattcaggaaacctttgtgccctcctccactggagccctcagttatctaaggcagctgcgtggatgcccaggggaatgaggcattgaggtgctgaggagagagcagttctttaagtttcagaggacaccacgccttcctgggcggctgagagagcaactcagcctcagtcccaaaaaaggtcctggggcatccagctaacacaagggtgggcaatttcttaatttccagtctctccccaaggaacttacacatgagttaactctaccagataaaaggaggatgaagagagtaacctagctggagaccatgagaaagcacgcggtgttaaagagagatcggaactttattgagactgatgaaatcagaaccaaaagaacactggaaaggttctgccactgtccaggcacagatccttccagacactcctcttgggggaatctctggatcattaagtttcccccagttcctaatcccccaccccaaagagtcagaattctgcttaaagccccctccacggagctggccagaaaccagacactgagtatctgtactgactgatgggcaggcctgtgagcagcagagacaagagaaatcagagaaggaacacgaaaaggaaaacatgacggaaagaaaagcccaaggcagggagagcatgctgataacgcagccccctgaaaatataaatattgcatgaatgtattagcctcatcccagccatttcccccaaagcagtggtgacaccaacagctatgacaatgcccacacagttgtgcatctttttttgtttttcccctgactacacagaaaaacagatctgccaaagcagctcacagcatggaggagcaggcaggggaaagtgggagggcccatcccccaagagggcagacagtacagagatgaggcgaggggttctggggtttgcggagggtggttaatgagaagaaaagtccaggacagattccatctcatcagcccctatcacaggctccgtggatgccccttgcagaactcactgttctttcctggtcgactcgttccttggaaacattgtcctgagtgccctggaacctcgggtgttcttgtggaagggtccaggccctccacaaagccaaacgcaacggcccctgtgacagcatgcaccagagtgataacaattctgagaaccgggaattcctaactcgaggttctcctcatagacctaacctgactgccaactggcttaccctgcctgacctcagagtgcctctccctctgcctgcctttccactgtcctgggtccaggatgacttcctggtgctgagctggtgcatcctgactcctgcctcgtgggtaaggcccccaggacagcttgttcccaagagaagcggctggctgtgtacaaaggagcccctcgaggcagcccgggctgggtctcctgggcatgcacagactgtgcaccatgcacatttcaccatccaaaggctgcttcttccctgcaggtcctgcccctctgctccccaccacctgctgtggagccgtgcatgctagccttgcaagactgttacaagttctctactccctagagtctatgtgatctccctaatctctcttggacaacatacacacatattcacacttattggtattgaaggccctggctttcctgcggtgtgttcagtggacatctgcatcaaggtcaggcgggaaggtcaatgttaagccttggtggccaccgacaccgagtggctggtgctggttctgactcctaggaaattgctccaagtaagtgttgatgcatcagggaatggagaagaaaggaaaggaaaagccatggtgtggaaactgcaaaggagcaactccgctgccaagtgtttccacaggggagttgtggaaacagcctcctctgaaatttgagagactggcggcctaaggaaaaggagcaaggtctccactgtcctctctgaaacccagcgcctttgggatctgagttttccaagacatgcaatagacaaagacgcactgcaaaccaattaaccctctgagcccttccacgaccttcactacagtcacttccaagagtaaattacctggatacaccaaccagtcccctcctgggtccgatgaagggatcgagccctcgagccagctttgaggaacacatcagagaagtggcagtgggggaggcagatccttgtccttcctgggaactcctgttcttagttgtcgagtgtcctaaaccactgccccaccccttgaggaaaccaggagcaagtccgggggattggctcaaaacccaggtggaggccgggtgcggcagctcatgcctgtaatcccagcactttgggaggccgaggcgggtggatcacttgaggtcaggagttcgaggccagcctgggcaacatggtgaagtcccgtttctactaaaaatacaaaaattggctgggcatggtggtaggcctataatctcagctactcaggaggctgaggcaggagaatcgcttgaacccaggagggggaggttgcagtgagctgagattgcaccactgcactccaacctggccgacagagcgagactccgtctcaaaaacacaaaaacaaacccaggtatattcagacccaagagactattcactgttgaaagtcaacccaaagttaagaggcagccgagggctggggaacaaacgcgagactgtgggtgtggaaagaagccaaaatggacctgacaatctctacgactcaggccttcgctgttttcccagctcacagggaacaaaggaatttcagctgcttttagcttatttgaccctcactgatttaagatacactagaatttagctgctctctgtccttccaagacaggacccaggaaaagcaggtggaggctgacttgcctcaatcaggcctcctcattgaagcaacaagacaagcacacaggaattcacagtttccactctcctccctagacccacacacctgccccgacccctggcctcaatgaactcccaactctccactgtgtaataattcctgccagtgtggctcaaagggttaataaaccaggacctctcagacagttaggacacaagctgattcaccaacaggaacccaaggaccgctccaccacctagtgcttcctgtagcgattttttggtgtttcgctacaccctgttttgtcacagttgagagcacctggattcttcccgagcccgaggctacccaggaggcccggaagctcctgagtgatggcccgctcaatcttctccagaaagcaacctcccatgtaggagcactgctgggagagcagtttgaaactggaaatgggattgatgccgaagaagtccttataggcctcgcggttgggaaggtcaaatttgctgacattggtctttgccaggatggtcttgaagatgtagaatttatcgggatcttccacaatgtccttaaagaccagttctccatcactgaagaaggtcattttgtccttgtaagtctgcaggtagcggtcaaccaggagggcgtggatgcggacccggatggcgtgctggcggatgaaggcaatcttgttctccagtctgttctcgatcacctgattcaggtcttctaggagggagatctcttcttggaggaacagttcctgatgggtgtccggcttatactcttgtggccagaaggagctgacgtaaacccttgggggctctgtgacattgatgagaggggccaagctccagaagagggccccgtaaacccgcatgagcatttgggtggccagattgtcagccttgttcaggatgatccttatctgggattcacgccccttcaactggcggaagagcatctccagctctagacccacatccagctttgttgggtcaaagacgacaaagatgaggtcagctctgtcgatgaaccactggcacacgtcgttgaaggggtagcctttgggagacagaagtgagaagtcaaactgagtaggcctccctcaaagcccgcgcacctcctttcagaactaaaccattctgggggttgaaagaaggaacagcgctacggattttctgggtttctacagactattaaaaaatcaattgcatatctcctgtcccttgccaatcttcaaccaagaacagcctgatccttgtttttcttgttggtttgttttttgagacagggtctcactctgtcacccaggctggagtgcagtggcatgattatagctcactgcagcctcaacctcccgggtttaagaatcctcccacctcagcctcccaaagtgctggggtaataggcgtgagccaccatgccccacctgatcattgttttaatctactgtgaaatccaagtttccaagaaagctaaatacctgttcaaaatggagattgtcctattgtctaaaaggatctggggcaatggcaaagatgctgagggagagaaatgaggaattagaagaacatgaaagaatgaatgcattatttacggggaaggaatgtgggcttagcattgagacctggactagaatttgagctttgcccctggcgagctgtatattaaatgcctctaagctctacctttttagctccaaaatgacaagaagaacaatatcaacatctgaactgatataaagattaccatgttgctgtaaatataggacagcacctaaaattccagtcatacagctggtgcagaatacattttaattccattagcttcttatttcctagttttctttgcaaataagaaaactgaggagatgaggactacctgtcttaaaaacattgaaatctttttttttttacaataatgtataaaattatccaacgtgtagtaggggtacaatttactattataattattaacattattaacattactaataatactactaatgtcattataccataataatataattaaatatactataatattattactaatattactactaatattattaattgcttctaatattactgctaatatcattactacaagatctatttataaccacaattggagttgtaaccataaactgagatccaccgtctgctcacacattcctgcactgccctgttcaggactcactgcagacagccttgcctcatggcaggactcagtggcctactccatagccacatgcctggtggatctggcttctagtcttgtggcctggttgtcagccttgttcattaaatacattcacactgttgcacaaccatcatggccatccctctctggaacttattcatcttcccaaattgaaaattctgtacccattaacagtaactgcccatctccccttccccccagcccctggttaaaaccactctggtttctgtctttctcattttgcctactctcatgtaagtgaagtcagacattagcattcccctgctacctgagggcaagtagggctttgaagaagcctgctaaaggcttatggggaagcaaccctggaaaagcagaaaccgggaataggaggagttgaaggtcaggttcaacctacagcaggcccaggagcaccaaacccaatttagccagaagtcaaacatactggtactgggatccaattagtccaggcccttggctacacaggacacacagggcctcccaaagacaactgagccccagcttgaacctctcagagctgcttgcagagaggactaggcccccactttggaaaatattgccgtctccaaaccaaatcagtccttggggaggtaggagcaccaggcactccaaaacccagatggcatcgcagtaacgacaagaagggtggaagttaagaatgcctctcctggtcttaggcaacactgggcacacttcctctccctgcctgcctaccacccactgtcaaaagtagttttcttttcttcctttttttttttctgagacagagtcttgctgtgtcactaaggctggagtgcagtagcatgaccacagctcactgcagccttgacctcctgggctcaagcaatcctcccaactcagcctcccgagtagctgggactacagtcatgtgccaccatgccaacctaatttttatattttttgtagaggcggggttttgccatgttgtccaagctggtctagaacacctgggcttaagtgatccacctgccttggcctcccagagtgctgggattacaggtgtgagccactgtgcccagccttatttattcatttatttatataagttagggtctcactcttgcccaggctggagtagagtggcacgattacggctcattgcagcctcaacttcctcagctcaagcaatcttcccacctcagcctcctgggtagctaggaccataggcacatgcgaacatgcctggctattgtttaaatttttttgtagagatgaggtttcactatgttgctcaggctggtcttgaacctccggcctcaagggatcctcctgtcttggtctcccaaagagttgggatcacaggcatgagccatcatgcctggccaaaaataattttttgaaacagagcttacactgttcagaaatgagggctaaattacctctttcttgctgcttgcggttctcgatgatgcctggtgtatccacaaaagtgaccctctccagaagtttgtggggaacctcaatgccaatcagcttctctaggaaattctggccaaacttctcaaggggtgagaaggaacgggcgctgtcagcagccatgacgatgccctcgatggttttcagcttaggcccatgcatgaggaccgtgaactcagaggtggtgggttcagcgcctgggcacacggggtgagaggtgaaggaatacatgatctctgtgaaacagatctactgagaagcatgtgtatatgcctggtgtcacagggagacttttgcaacagaattggatatgtttgccaagctattggggctttcttttaattgtggtaaaacatacataacataaaatttaccttttttttctttttgagatggagtcttgctctgtcacccaggctggaaagcagtggtgcaatctcagctcactgcagcctccatctcccaggttcaagcgattctcccacctcagcctcccgagtagctgagattacaggcactcgccaccatgcctggctaatttttgtatttttagtagagacagagtttcaccgtgttggccaggctggtctcgaacttctgaccttaatgatctgcccaccttggcctcccgaagtgctgggattacaggtgtgggccattgctcctggcctaaatttaccattttaatcattttaaagcatgcagttcagtggcattaagcacattcaccctgttgtgcaaccatcgccaccatccaggtccagaatgtttttatcttcccaactgaaaactctgtatccattaaacagtcattccccatttcctcttcccccagtccctggttacaagcactctggcgtctctctctctgattttgccttctttttttttttttttttttttcctttttggagcagagtctcactctatcgcccaggctggagtgcagtggcatgatctcagctcactgcaacctccgcccccgggttcaagcgattctcctgcctcagcctcccaagtagctgggattacaggtgcccagcaccatgcccagctaatttttgtatttttagtagagacaaggtttcaccatcttggccaggctggtcttgaagtcctgaccttgtgatcaacccacctcggcctcccaaagtgctgggattacaggcgtgagccaccgcgcccagccgcctactgtcatataagtgaaatcagacagtatttgtcctcttgtgtctgtcttctttcttttagcataatgtcttcatggttcatccatgtagcagatatcagaatttcattcctttttaaggctgaataataatttatgtatgaacagaccacattttcttgatcctttcatccattgatgaacatttgactggtttccatgttttggctattgtgaataatgctgctatggacattggtgcagatgtctttttttgttttctgttttttccaaattttcttttttttttttttttttttttttgtgagacagagtctcactctgtcgcccaggctggagtgcagtggcgcgattttggctcactgcaacctctgcctcctgggttcaagcaattccgctgcctcagcctcccaagtagctgggactacaggcacccgccatcacacccagctaattttttgtatttttagtagagacggggtttcaccatgttggccaggctggtctcgaactcctgacctcaggtcatcctcctgcctcagcctcccaaagtgctgggattacaggcataaagccaccatgcacagcctttttcaaattttgtattttaacacgtgcatgtggcataacttttctttccttttttttttttttttttgagacggagtctcgctctgtcacccaggctggagtgcagtggcacaatctcagctcactacaatctctgccttctaggttcaagcaattctcatgtctcaagttcctgagtagctgggattacaggaacgtgtcaccatgcttagctaatttttgtattttttttttagtagagatgggtttttgccatgttggccaggctggtctcaaactgacggcctcaagtgatccactgccttggcctcccaatgtgctgggattacaggcatgagtcataatgtccggccagtgatttaaattttcatggtgcttttacatacaacattcaaatcccaacaatcacacaagaatattgattacctgtatagagctgatagcgagtattttccagcccaaggaggtagtttatcatggtagatttaccaacactccacggtcccaggaacagtaccatgggcttggaggtaatctctccatctgtgggcaacaggaagtagaaatggaataaaactaacaaaagttcacacaaggggtatggcaccgtactccaaagcatctcaccgtccatccaactgagttgtggaattctccatgaatcagacgtgtgtagcccccagtggcgcttctcttgctacgtaagtgtgatcacccagtaaaaagacacagaagtcacttttgggccttgcccagatccttggcacgtctgcccccaccacaagaaggatctcagtgaattcaacaaaccctgactccgaactcactctgggtgaggtctcctggttaaatctggaggagaaaagcccatagagaaaggaggacggagcttccacatggagagaatctgggttgagaatggaggatggatgtggagcagcttgtataatcttgggtggtctggactcagacccttcctgtctccagcctctgcagctctcctctcctccagcctggggctccccaaattcccaatacagcctaatcctggactctgaggccagtgtctctctctctctttctgccctcttttgtttagaatcagggtctccgttgcccaggctgaaatgcagtggtgcaattgtgccccactacaattactgggctcaagcaatcctcccacttcagcctcccaagtagtagctaggactacaggcatgcaccactatgcccagcaaatttaaaaatttttttttgtagagatggggtcttgcaacgttgctcaggctggtctcaaacttctgggctcaagcaatcttctcacttggctccccaaaatgctgggattacagctatgaaccattgcacttaccctcttctagggccactctcaaacactagcctctaaagtccatgacaaatttgccagtgcccaaaaccaaacaatgaactggcaattcttgggtcctgcatccaatgtccttccgaaggccatgttggggagatgaccctgcaagggccactccaggtgggtccctaagaggaaaaatagaatgctctcgtgctttcaaatccagtggacagggagggaaggggagaggctttcaacgtggggtgtggtcagtcttattgcagattttcaggcctcagctcttccagctcttctctggactacagcacagagggccagtcctgcataactcagcactgaagttctccagactcgtctccctgaggccagcaggccaccctaaaaacactaggcactccccttttgtttcatttatttatcatgattttaatttatttaatttcttggttcaaagatcaggaatataaaaaggtaaacagtgaaaagtctcccatctccatcccagtctgcctcagccctgacaccccctggaataggtaaccactgctgacttcttacatgttattttagacattttaatgcatatataagcaatatttgtagctaacatattccccatctttttttttttttttttttttttttgagacagtgtctcactctgtcgcccaaaccacagtgcagtggtgtgatcatagctcatatagcctcaacctcccaggctcaagcgatcctcccacctcagcctcctgagtagctgagaccacaggcatgtaccaccaagcccagctcatttttgtatttagagtagagatggggtcttgccatgttgcctaggctggtctccaactcctgggctcaagagatccacccaccttggcctcccaaagtgcttctattgcaggcatgagcccggcacccagcccctccccatcttcttttcttttcctttttttttttttttttttttgagacagagtcttgctctgttccccaggctagagtgcagtggcacaatctcagctcactgcagcctctgcctcctgggttcaagccattctcctgcctcagcctcccaagcagctgggactacaggtgcgtgccaccacgcctggctaatttttgtatttttagtagagatggggttttaccatgttgcccaggctggtctcgaactcttgacctcaagtgatccacctgcctcggcttcccaaagtgctgggattacaggcgtgagcccccacacccggccccatctttttacagagagcgttgccatatgcttcctcttctgtatcttgccttcggatgctctggtcttccttctccgaggctaaagctcagtcctaaccaggtggtgtcttatacatggcaggcacatgtacgttgcctgaaagcaacaccatggccctgccccatccctccctgtctgtgaatacacaggagacactcacatctctgtggaagtcaagccctggctgggggccaggaagggataaggaggctgagagggtggcaggaatccccagttacagccacagagatgtcacagtatcttaacaccggcccaggcgacaccaaggagagccctagatgttccggttctccgagacaaaccacaaacagggccctttcctggtgctgtggtttcggctcctcacagcagggggcaccgctggcctatacaggaggtgggaggtgagcctgggagaggttacaaggaagctggccagagactaggagttaagaaccaagcccaaaaggtgagtgcaggggcaaggaagcgggacctccctgcagagcgccatgccctggggactctggagctcctggccctgctgctgtacacacaagtttcctaggagggccaagactccgggtcttagggccaagagagaaagaaaaacccttcgggaggctctgcaagctcataccaatagctgtgcatccactacaaaggggggcgataattggctgctaggctacaaaaaatagtacaggtagctgtggaacagggtattccctgcttccagctgtgtgatcctgggtaacccagcacgtctctgggcctcaggctcccctctgtagagcaggaagaatacaaaccctattacaccctggccacttacagccatccagagcatcaaatgagatcatatagaaacagcccaattaacacagggaaagatttctaatctcattcaaaaaacaataagataccactgctaaattttttaaagatgagtaacatttttaaattgcattgctgttgggaaacaaggactctcatctactgttattgtgagtacaaattggtatcatgggagacaatatggcaacaactagcaaaatgtttaattccagggttccaatttttttttttttttgagacagggtctcactctgtcgcccaggctggagtgcagtggtgcaatctcagtttactgcaatctctgcctcccaggctcaaatgatcctcctgcctcagcctcccgagtagctgggaccacaggcgcatgccaccatgtccagctatttttttctttttttgagatggagtctcactctgtcacccaggctggagtgcagtggcacaatctcggctcactgcaacctctgcctccccagttcaagtgattctcgtacctcagcttccccagtagctgggattataggcacccaccaccacacccagccaatttttggatttttagtagaggcagggttctgccatgttggccaggctggtctcaaactcctggcctcaagggatctgctcgcctcagcctcccaaactgctgggactataggtgtgagccactgtgcccggccatcggattgtttttaaaagtgctatgagccatcacgctgggcccaatttttgtgtgtgtgttttgtttgtttgtttgtttgtttgtttgtttgttttgagatggagtcttgctctgttacccaggctggagtgcagtggcacaatctcagctcactgcaacctctgcctcccgggttcaagcaattctgttgcctcaccctcctgagtagctaggattacagccgccagccactaggcagggctaatttttgtatttttaatagaaacggggtttcaccatgttggctgggctggtctcgaactcctgacctcatgatctgcccgccttggcctcctaaagtgctggtattacaggtgtgagccaccacgcccgcccctaatttttgtattttttgtagagatggggtctgactatgtttcccaggctggtctcaaactcctgggctcaagccatcctcccacctctgcctcccaaagtactgagattacaggcgtgagccaccaggagggtgctggttttccagagcatggcgtggtcacgcaggggaggagcacacagctgtcagagggaaggagggaggtttccacacacacagctcacctaacaggatcccatgtttgtaaaaacaaaaaacaacatccatctatgtgctcacacatgaagaggaaatgcttggaaggcttcactataacgatgtgtttctctgggagtcgaattaaagaagttggaggtcggctgggagcggtggctcacgcttgtaatcccagcactttgggaggccgaagcgggcagatcacgaggtccgcagacagagaccatcctggctaacatggtgaaaccccatctctactaaaaatacaaaaaattggccaggcgtggtggcaggtgcctgtagtcccagctattcgggaggctgaggcagaagaatggcgtgaacctgggaggcagagcttgcagtgagccgagattgcgccactgcactccagtatgagtgacagagcgagactccatctcaaaaaaaaaaaagctggaggtcaagaatataatttttatttttcaacgtataccattctgcactatttgaatttttgcaacaagtgtgtcttatttttattattttgaaaatcaattttgtaaagaatccaggcccaagggaagcagagtggaagggcaatagcaggaggggaaggaacggagtgatcagaggactcaggcaccacccatgagtagacagggggcacctgtggcctctggagcacaggagggattgaaataggcatcatcgcctttgaaaactcaaatgtgcatgactgaagcataaaggcttaaaaccaaaatgcatctgtaacaccctggtaaagcatcgcgctgtgctggtgaaagggtagttccgtgatggaggtgtcgtcctttccaactcccagggggagcccagacccagacccacaagtccttgcacacatcatgaatgagctcctgaacctgtgtgggtaccgggagagtccaggccggtcagcagtgtggccccgccgacaggcctgcgccgtacccgtaatctcaagccctacctgttatctcaagccctacctgtgatctcatgctgccggagctcattgtacttgtaggactgctccagaggcttgatggatgagtggtagatcttccgaagccgctgcagcaccgctggagacagagagggccgggggaagagcatcacgcaggtgcgatccaggcagctcctccattgtggaggggcctcaccacccagggcagctccacccctgcctggtgggcagcaagtgctgtttgcagcccagcgactgtgcaatgtatttgcatatggggagctggcccacatctcaactcgcagaaacctccaaatgaaaaggcattctcctacccacccccaaagcttcctgaactgtttggttattttattttattatttatttatttatttagagaaaggatcttgctctgtcacccaggctggagtgcagtggtgcaatcatagctcactgcagcctctaactcctgggctcaagtgatccacccacctcagcctcccaaagtgctggaattacagacataagccactgtgcccggcctgagctgtttttttttaaaacctctctcctccttcctcacctcagtagtgtgtctgaaaccttgtctcggcctgctgcctcactgcaagccctttctttggtggatgagaattccatctctgttgcccacctctgtgtgtgctccctgaggcttagaaggcaaagaggcccagcacccagcaggcgcgcagaacagcaccctggccctggcgttggcctgtcagtgtactcccagacactccccggaggggtggggtcagataacccaggtggcctctttctaagagttagctccctgctgggagcccacagtgggaaggcctatggggtgacgagtcaggctagcgagactctacccctcgatccgccaccctctagccgtgggccaggagcaaatcgctgctagcctgagctccagttaggtggctcattgattaagaggagacaagccctgctgcaatccttgggtttcaaagataaaatgaaacagcacacatgaaacggctttataaactaaaaatcacagcgagggagatggcatcagcacagcatggggctgcactggcttcgcccacaccaggccgtctacttggatggcccttcctcctctgtgcccacctggaaccccaaggcttggaccttgctcacagagcctcctccacgaagcctcccaccttcagggctctcctcttccccaacgtcccctccagcctccaagatagatacagccccggcctccaagatacagccccggcacgccctggctctcaggagcctccaggagtctgcccgggccctggtggccgggctctcccagccctgggcatatctccctcccctggttaccagagtagtcatcggatggcttgtcctcattcagcatgagggtcttctcgatgtgggagcggtccctcaatggggcttcttcatttgcatcctccgtctcttctgtggagagaagcagacagccaagtgagagcaaagctaacagccagctgagctctgggccccggcacagcagacgagggctgggcctcaagcaggggctcaacagggtcttgccaagttacactggactgagctctgcctttaggaaggaatttgatcatccagactctatgaagttccatgtgtagtgtattcgcattcggggagctggtccacagctcaacctgcagaaaccttcttatctatttatttcatatattcaacaaatatgcattgaacaccttcgccacgccaggcactgagcatcatgctgggaatacagtggtgcccaaaacaggcacaactccttaggcagctgctcttagtccagtggagtcagagatgatagtctttaaagtaacgctagggccgagtgcagtggctcacacctgtaatcctagcactttaggaggtccagatgggaggatcactggagcccaaaagttggagaccagcctaggcaacatagcaagaccccatctctaccaaaaaaaaactttccaaggagtggtgcacacccatagtctcagctcaggaagctgagacaggaggattctctcagctcaggaggtcaaggctgcagtgagccatgaccaccccactgcactccagcctaggtcacacagcaagaccctatcttaaaaaattaaaacatcaaacatctcaggaggctttagggctaggtaggagaatgccttttggcttgaaccccagcctgggcaaaagagggagaccctgtctcaaaaacaataaaaataattaataaaatgtaatcattacagatgatgaggtggccacagaaggaaacattctgaaagctaagtgcggctcaggagtgtgcctgcaccagtggtctcagcagcacggtcagagaaggcctccccaggtctctgctggggggagtgagttaggtgaccagtggagagaagcgttctgcaaaagccccagacgagccttatttagcaagaagcaggagaaggggtgtctggctgcagctggggaggcctgggtgctggggagctgctgaggtcctcagggctgaccgggcaggaccttccacagggctttgggtttcatcccaagagcaatgggagccagtgaggggctctaggcaggcagcctagcgtgatagtgcatgcctgtagtcccagctactcaggaggctgaggtgggaggatcgcttgagcacttgagctcaggagttagaagctgcagtgagctatgactgcacgactgcagcccagcctgggtgacagagtgagaccttgtctcaaaaaaaaaaaagtatgtaaattaattcttcaacgaagcctgtggggaagccatcttggagagtgaagacttgacctcgacctctaccctgaaagccccactcctggtctaagtccatgtactaagcagatgcagccatgaaggtgcctgaccgaccctcgtattggctgcaattctcacactgcccgagagcttagcccggcccttccccctctgctcctggccccgagccctttgagggcagctttggctgctttaggtgggcacttgagagtcaacagcggtcacagcctgagttctcatctcatgatcctgacccctcagtcctggttctgcaatgcttcctacagcctagtcttcaaggggagaccccagtcctagcccactaagggaatcaccagggaagttcccaacccacccccatccattccctgcacgtccctccacccgctggccccggggcaccaatcattccattagctcgctgctcctttaggctgaggcactggcatgggctacggcgcatcagggaccctaaggggaggttctggggcccctgactcggaagtaccagggcccctctgacccctctcactggcccctccaagctggaggccagtggccaatgcacagcctgaagccacctccccgggccgggactgtgaaaagggcctgccaccctctgccaccttctgtccctgcctgtcccctacacacaagacttccagggagaatgcagctgcccaagggacggggttgctgttagggaattaattcctaccctgggcaacaatgatgggactctccctccccctgatgtccctcctcgggctcctctgccttcatatccagggtctcactgcccatggactctgtattcaattcctccgggccaggctgggcccctctgtccctgtgacttgtggttcctgtggcttccggaagctctgcaccttcctggggttccctggcttcctggggctccctggcttcctggggatccccaccttcctggggctccccgccttcctgtggcgctccaccttcctggggctcctcggcttcctggggatccccgccttcctgggactcctcggcttcctgcagatccccgccttcctggggctccctggcttcctggggctccccagcctcctggggctccgtggcctcctcggaggcgccctctgcttcttctgagctagccccatcgccgctgtcctcttcggactcctcttcggagggaactcctccttcttcctcgcttccacttccatcaccactttcctcttcagaggaggcttcatctgcgtcctcctcagtcatctctggggactggttctcctcagtgtcccctgccttaacgctttgggcgcccccaggctctgcactggcctctgcagctgggccgggctccccctggtcctcggtgccctcactggcttgtgtgtcaatatctggctccgactctcccccaacagccgcgacgtcaggggctccctctggcactgcaggctcctcgccaggcccagggctgccctcggcctctgcgttcagtgggccgaccccatcaccctctgagtgaggagaggccccctctgcctttggctctgctgtccctgctactgctccctgcaccaggctgtccccttggacctcctggacttcctcggggagttcatggcccccagcctgtcctcctgcctctccactggcagttccctccgtggggagcccaaacccagtctcctcctctccttgtccctctccagaactgggctccggccactcctcttccacaggccccttggcccctcctggagggagggcgcttgccactggtgggccattcttttcctccccaggccccgcagcgtccctgtcgtccctttccccaggtggaggtgactctgtggctgaggcattggagaggctggcttcaggatcggggcccgcgctggcggcagacgcgggggtcttcttggggctctcggcctccctgccatctgggtagtgaaggagcagtttcttgtcttgaggggctgtgtctgcataaagcgccctttctttctcctctagacttgcgtctccagcagagaaatgattctccaacaaattgccaacatcttctgtgccacccgacgcggagacttgcagttctaaatgattagaacatgattggtcagtttcacagggttggcaccggctctgtttctcaagagtctataataacctagctcccgtcttctgggatgtggtgttggcctggtgtgcagtgttacgcccaccaacctgggtcttcaggactacctcgtgcgtagcgagcagaataggtgttattctgcctccctcccaagatgtagaagctgtggatcagggagttaaaggactgacccgttgtccatcactaacgaagtgagcagctgtgctaacccgagaaccgcccccgcaccgcgaccctggccctgaccttcaagcttccgggcttggtcctgatgactgtatatggagggaaagttgggcgagcccttccagtccctcaaccttgctcacgggcgtgtgcagctgggctcaaccttggagatgcttccaagaagggacaaatgcttgtgcatcccacctcatggcagttcctactgtcattaaccagcaggcttttaatactgctctcagcgaaggagtgaaaacaggtgtttgcaggccggataatcttaggttacacagcacggtgcttaagggattacttgtggctctcaaccttattaagtcacacatctaaccctgtcccagtaagggcaggcatttgctggcccccctaccttagattagagggtacatggcctgaggaggagatatctaaaacaggccgggcctggcttcccaaaggctctggccaaccccttccaaggggatccccttgtaagggactgcagcttaacccagagagcagagggcccaggaagagagaagagtaggggcctcatctgtgccagagacctctgtcaaggatcaagtttaatatgtttggaaaatggggtcagaaaaggctaagtgtggtggctcatgcctgtaatcccagcactttgggaggtcgagataggcagatcacctgaggttgggagtttgagaccagcctggccaacatggtgaaaccccatctctactaaaaatatgaaaaattagctgggtgtggtgacacacacctgtaatcccggctactcaggaggctgaggctggagaatgacttgaaccgggaggtggaggttgcagtgagccgagatcgcgccactgcactccaggctgggcgacagagtgagactccatctcaaaaaaaaaaagaaaaaagaaaatggggcccattaggcccacccctctgccccctgcccccaggctagggtctgtttatgggggacattgcaggctcatggagatgaggggaccacaggtgtcctgccttggagcagctgaggcagcctctgttcttccttgactctcaaggcccctctccgaggaagagtaccccacctatctgctggatgcagacaacccccctctctcaggccaccacttgctactcccatctctccctcccacaaagaaaagccacttcttggagtaccccttctccctcagggtacccacccttgttccccaaaagctgggtggcctccagggatcaggagcaaatattttctcattagttcccatagacagctagcctgttgtcgaactcagaaagatgtgaagcttggtgccttttattatagaggagccccgtggattgaaatatacaacttttcccccagcactttcatatgcatggccatttaaccttctttacgactgtcagagagatttcagagctgaataagtgaaagtccagagatctttgccctgccctagatacatcaccactaggtagttaatgggtgaccggaacccagaactgcccagtccctgtccaggcttccatgccatgctgtgcttagcagggcacaggggaccccttcctgctggaatctcagctcctgcctgcacgtgccttctcttcaggctcaagctccgtactggtcctggctcctgatttgcaggaatccaatttaattctgtgttcccagggcctggcaccctgcctgacccacagaaagtgctggaagaggtccgcggtcagattggggtaccaaaacgaattcctggtcccttagtgggggacaggacagggagctgactgttgctcagtttaatctcctttcatcaccacctacatacctgtaagtcctgactccttcacctacatctctatctctccaccttccacccctgcagaaaaatctatggtgggaatttggtttaatcagaagagactgaatgtcctctgaacagcaggatacgtataatgtatatgacatacatctgtatgtacatatctgagatacagcctgccaggcaatgcttaagcactttatatataaaacagtatcttcatcatactgaattttcttaatcttacttgttttggtaaaatgagtattactcatatctttttttttttttttttttttgagacaaggtctcactctgtcacccaggctggagtgcagtgaacgcgatctcggttcactgtaatctccacctcccgggttcaagcgattcttctgcctcagcctcccgagtagctggaattacaggcgcatgctaagttaatttttgtatttttaatagagacagggtttcaccatgttggctaggctggtcttgaactcctgatctcaagggatccacccacctcagcctctcaaagtgctgggattacaggcatgagccaccacacccagcctcatatctctatttttacagatgagaagtctggaaccagagacattgaggcccttgttgaatgtcacacagctaataactggcttgggccatgtgacttcagagccacagtatcccccgggagcctgttagagacgcagacttttaagccccagcctggacccattgaatcagaatctgcattttaacaaaatggccaggtgattcctgtgcacattacagtctgagaagcgctgggctacactgcctcacaaactgcccctcagccagcgactctcagcattggctgcatattgaaatcacctgcttcttggtcccatgcttccctttctctgcagttttgatttaaataatccagggtatagcaccagcatcatgattaaaaaaaaaaaaagttcttaggtaacacacaaagttgcaaaccactgcaactaccaaatcaaataatcttgacccccaggcttcagctcccaggccctccctactcgcaggcccaccccactaaggatccccattgtgggctcccacgttggggggggtctcctagggcctggcatttgcctttggaacagcagtagttaaggcttctcctctgggaatccagccctttccatgggctcctgttgtccttcaatgatgatggtgatgaccgtgccgatgatgaggatcgtgatgatgatgatgatggtgatgatggtgatggtgatgaccatgctaatgatgaggatcgtgatgatgatgatggtgatgatgatggtgatgaccgtgccgatgatgaggatcgtgatgatgatgatgatggtgatgatggtgatggtgatgaccgtgccgatgatgagggtcgtgatgatgatgatgatggtgatgatgatggtgatgaccgtgccgatgatgaggatcgtgatgatgatgatgatggtgatgatggtgatggtgatgaccgtgccgatgatgaggatcgtgatgatgatgatgatggtgatgatgatggtggtgactatgctgatgatgaggatcgtgatgatgatgatgatggcagcaatggtggtgatgatgatgatggtgatgacgacgatgacgacgatggtgatgatggtgagagtgatgatgacaatgatgatgagaatgatagtggtgataatgatactgagttgaatgaactctaggtctgatgtcctataacatttctgacagtctcaaaagccgttttccctggtaaaggtgagagggccacacagtcccaagggggatgaaagttccaaatgttggaggttcaccgtgaccatgaccttcacactgctgtgtgtttccactcctgcgccctgggcaggaagcaaggtgtgtgcatatgtgtatgcacatttatattcaagctcttccctggttttcacaacttagggctgagcttcccctgaacttctgctaaacaatttggagtaaaaaggactgaggataatggcttcttacactgtgacctttctcccaggctaaaaataactgctccaacagaaagtctctcaatgaaacaagctgtcccattgggccccagagctcactccccaggaagcagctgtgccactggacccagttctcctcttggaggcgcagacagaggtgtgggagcctccgattacactcacttccatcgcatgacatctcacttcaatcctgggaaatcaaggctggtgtctttcccacctcccttgcttcttgccgaagcaccctattggccctggagcagggaggccgcagaggacccaggacaccctggagaggtgaatccccagtaagatgagtcttggtctatcctgggacatgaagtaccgcactgtatgtgctgctgccagggtggcccccccgactccggccaggccaggcccgggactgacgtcagggcacaggaatagcaggccccaactctgcccagagaccatgggaaggccccaccccactcacacccagtccaagcacaacacacaacaatcctgcttctcccaccagcccctctgccaccagcctttctcggggggccagctttccagcaggtcccaccagccccacagcctcagggcaggcccaggctcagtccctctctcctctctccatcaccaaccaaatgccctgattttgtttcttcagccctgtctctttccaaagcacttctacatggactcagaggactatggagttgccaagggccctcgtgagtccaactgtaaaggaggacgctctggccagataccttcagagacttgcccaagattggggcaggggtgggacagagtccaaatatatgaaccttagtctggagttctttttgcccccatggagttcacaaaccatgtcccatgaagtgctagggttccatagaagtgactcatggggtgaggaaagatcaaacagcagagacagccacccactttgtacttcctgctctccttgaatttgtctgccccagtgtccacagagaaagactgcagggagattggcaagccctgctcctttactctcctcgcttcttccttcaaaatattagtatctgccttgagcctcctatccattattttctccaacgtcccaagacatcctgcttacagcatctttttttttctttttctttttcttttttttttttttttttttttttttgagacaggtcttgctgtcgcccaggttggggttcaatggcacaatgacacctcactgcagcctccacctcctgggctcaagggatcctcccacctcagctcccccaaacagctggaactccatgtgtgtgccaccacatccagctgatttttttcatttttgtagagatgaggtctcgctatgttgcccaggctggtctcaaactcctggcctcaagcgatcctcccacctcagcctcccaaagtgctgggattacaggtgtgaaccacgcttacagcatattttcactttgccagtccacacgtgccaggctctcagctgggtcatctcctgccctcacgtaggactccatctttccaaggtagtttcctgtgcttattcttctctgatgctcctagcagccctctgaggcagaaaaagcaagggttgttaacctctcttgaaatgaggaaacaaacacacggaagtcaagtcgtttgcctcacaagtcattccagggatgggctggaactcaggccaagagacagaacaaagctccctgggagcgaccatgacctgctgagctgttcaagcccagatacccagcttctggggctgggtcaacgtgtacctgtgtgtttcacaaggggattctacagaacaccagcatttcggaccctctgcactagccatcctcagtaccaagggccaggaagctctgtcttgaagttgaaactagagatggagagaatagaggtcaggacctgttttcagcccacctctgggtgttgaatgtattcagtgccttcgtgcaatcaaatgtagattctattccagcccgtccaagtctccttagcacatgtttataacaagtacctgccaaggttattcttccacatgacttctcatccatttgaactagagctagcaagtccaaagtcatgcgtaagtaaaatacctctgaccattactcatacacagttatgcaaatcagtcattagtaacagaatccccagcgggggcaggaatcactctccaaatctctgcctggttcatctgtcccagagagtgaggagcaccagccatggcatacatgtgagccccatgtcttgcccccatccaccccccgccccacgttttggctctcattggctgtatattaagtgcagcagggagcaattcagaaaacagagttcatgccgcagagcaggcagcctgcccccttccttgttctagatcttgtctctgaacactcgtggaccgggcaaacgtgggccagcagcctcttctggtgtcctgtttttccttgactttatcctactgggtaaacattcactgctcaggaccccttgctcttccacttttttttttttttttagacgaagtctcattctgtcgcccagggtggagtacagtggtgcgatcttggctcactgcaacctctgcctcctgggttcaagcgattctcctgcctcagcctcccgagtagctgggattacaggtgcctgccaccactcctggctaatttttgtatttttagtagagacagggtttcaccatgttggccaggctggtctcaaactcttgacctcaggtgatccacccgcctcagcctcccaaagtgctgggattacaggcatgagccactgcacccggcctcttccacttcttagatgaagtcttaggacaactttgcagaaggctgttgcccataaggacccgagaagagaaattctggctggaggaaggcttgtctgcattctcccaggacccctgaggtcctcttctgccattctctcagcctttccctcttctcccaacatgggcgaccagagtgcaggggctgaggcagccattcttggaaggcttctttggcttcctggccatgctcctaaagtcaaggctaatcccactgggacagcttgtccctggctggactctagcccttaaaatgattcatccagggaatcagatacaatgacaaaagtatgacagggtacaatgacaaaggtagcaatcagaaagaaccttgggatttgggggtccagagagatcttctgatagaccaactggcttgatttcactcatgaacaaaaccccaaaaccctggtaagtgcttgtcccaaggccatggggctagttaaggtagtaggcagcagtctgcttctagaactcagctctctatggacgctctcccagcagtgggccagccaataagagggtctaagtctaccctaggacagtgatttcttagcccaccctcttctactcttcaataacaactgttttaggctggacgcagtggctctgagagcccatggctcacacctgtaatcccagcactttgggaggccgaggtgagaggatccctagagcccaggagtttgaaaccagcctgggtaacaaagcaagacctctgtcttgcttactacttgctttgtcttactactggcccatctttccaaaaaattttaaaattagcttggcatggtagcgtgcgcctgtggtcccagctactggggaggctgtggttgacggacctcttgagcctaggagtttgaagttgcaataagctttgataacaccactatactccagcctaggcaacagagggagaccctgtctcaaaaaaaaaaaggattaagacttcagcacaattgtttttaacccatagagtcctgagaattgacagaataacttcactcctcaccccacctccaattcctgggaattcttggtttgggaggtagaaagaaattaccagaaatcccacaaccatcatatatatacatgcttgtcactgatgcctggaggagtcatcagtataaatgactattcacttttattttattttatttttattttatgtatttatttattttttgagacagcatctctgtcactcaggctggagtacagtggtacaatctcagctcactgcaacctctgcctcctagattcaagcgattctcctgcctcagcctcctgagtagccgggaccacaagtgcacgcaaccacactcggctaatttttgtattttttgtagagatggggtttcaccacgtttgccaggctggtctcaaactctggacctcaagtgatccacccgcctcaagttcccaaagtgctgggattataggcatgagccacgatgcccagccactattcactttaaaaagacaaatacctcagaaagagcaaaacattatatcctaacccctcagtatgagtcaatcactagcagggatactctatagagcactcagtttttccagagatcagccgtgcctgcagtgaacagaaatccttgcagaaggccttgggcctgctgcctcccttcagaggggccgagctggggaggaaagggaaaggaaggggaaagggatgcaggctgggttctgagacagaccaaggcaggtggctggcttccccccacatcccagtccgaagaaatccaatctccctgggatctgtggggatgaggtgctggtctaacttttgggccccagacaggaaaagacttactggaagccaagggagcgtggctcccgcaggtctcagtctaacagctatcctgggttaaagtcagagccatctccagcttggcaggtgaaggggtcaaggaatctgggcccaccccatccccaatccagggaagctggagggaatcttcttgagaaacgtgggagcttgggaaatgggtgtgacaccttccctagcctgagccaggcccacggctatgccttttctttcttcctggggctgaggctccagcctcctagatagtggctggtctctctgaatgcacctggaagtcaggaaagctgggttctgccccttactctttttctttttttacagaccctgtcccttagagacagggtcttgctctgtcacctggactggagtgcagcagtgtgacgaaagctcactgcagccttcctacttgtcacacttcagcctccagagtagctgggactacaggcacgcgccaccatgcctggctaattgttttattttttgtaaagacagggtctcactatgttgcccaggctggtctcaaacttctgggctcaagcgatcctccagccttagcgtctcaaagtgctgggattacaggcgtgagccactggcccctcccctgctgtcttaccactggcgcccccaccccccgctgtcttactacccagcgaagtaaccttgggttgctccttactccctctgcacacaactttattcgcccataaaatgtagataacaatacctgctttgccagccccatcagagcgttttaaacatcaggtggtgctcagaagcatttcaataaatgtcagctatgagcatcattctttcctagaagagcaaagacaccaggccaaatcccaaatttgctgagtgggccacagcagagccagcttcggacaggagccgagccagctggcccttcacgctgttcctttagccctccgggtctgggggctcagtcagggggcccggagccatccatccttctgccagggactcctcctccctggctgccagccagaggcagctcaggcgaggagctgcagggtgcctgggggtgagccctgcgctcttggtgaagttctggctggtctgggaacggagcaggctgagctgtcaacactcccaggggccaggagctcgttctgctgatcccaaagttaacccctgcagtccctgactccagcctcagtcagccctgattcaccagcaacatctgaggccacatgtggcctcccctttccccaccacgtcccatcccttctgtccagtcactgaagtgaggtgaccccgcacttcaccccaacgcaaacgcgcactcaggaagtttaaacagacccattctaagggccacgtctttctgagaatgggagggaagccctttccgaaggcagaggaccggtaagggcccttcaaagctctctgaaacagcaacacggtcggagggaggtcattagcagtgctgtgtggcttcctcatcctcatggtaagtgagcactgggagtaagacaatcagcccttcagaaaccactcgggcctggagaacgcagccagggctgagccacagagatggggcaggagcagttctggcctccaatatacagcggcgctttgctcctctcgcacaagtgaaatcacagctgatgtctccatggctttgaagagcctcacacacaggcccgctggaccacgtgggccctgctcctccatcaccagcagctctgtccccattagcagagcaggtgagaggaaatgccacacccagagtgccagacaacagggcgcacagcccccaacctgctcagccggggaggtgtcctcagccatctctcctacaactgccaggaagaccacagaagccggcggttcccaagtctacgcagagttagttaaggaggaaggccaggcctctggcagagctagggcagcaagaatacacaaatgtcctgcccatgtgccccagctcatagacctctctggaaaaacttctgcctagacaccaaaaggccagatttttcaaccttctttcccagagggtgtcaccgaatccatgacagatgggccccaccgccaggtcctggcattcatggccccaggtctcatcttatttatccttatggttatttttgcattcaaggctctagaatcagaaagaaacttagaaagtaactagcccaactctttagcccaactctttcttttcacagaggaggaaaccaatgcccagagaggaaaaaggagcttgccagaagtcgccagtgcactgggacaaagctagaactagagacaaggtctcctgaccccgcagccgtagtcttcccatagggggcccagacaaatacaacttccccttctcccagacgtttctaagctttggatgctcacatcctgccctgtccctgggagctggggcccctggattgctcatctgtccccctattgttcctacaaaggacagccccttggtgagtctcagagggctgtgtcggggcagccacagtagtgtcaggctggcgccctgagcacagctttttttttgagacagtctcgctctatcacccaggctggagtgcagtagcgcgatatcggctcactgcaacgtccacctcccagtttcaagccactgattctcctgcctcagcctgttgagtagctgggactacaggtgcatgccaccatgcctaggtaatattttttatatttttagtagagatggggtttcaccatgttgcccaggctggtctcaaactcctgcactcaagtgatcctcccgccttggcctcccaaagtgctgaggttacaggtgtgagccaccacgcctggcctgtatggagattttaggaaggacccagggtgagggttagctccctgcattcagcattaagtctgtggtattcctggcgtcagcagaggcatgcaggaatggttgtcatcaccaccaagagacaaaggacagttggttccatgagggctgtgtgagatcagctcttagctatctgagttcaaggtggcagaggccaaaagaagatgggaccagaagagcattccagcgtctgggtcattagagaagggaagaccctcccagcccaccttgccgctccgtgaacagtacaaactctggatgcctccagagcaaatctgaccattaccctgaattttcactccagagtacaggtgtccagaacacccagccaccctaaggggaaccatcctagaaatctcacgtctaggccaggtgtggaggctcatgcctataatcccagtactctgggaggccagatcacttgaggccaggagtttgagaccagcctggccaacatagcgaaaatctgtctctactaaaacacacacacacacacacacacacacacacaaataaccgggtgtggtggcacacagctactcaggaggctgaggcacgagaattgcttgaacccgggaggtggaggctgcagtgagccgagatcacgccattgcactccagcctcagtgacaggagacactgtcctagaaaaaaaaaacacacacacatctcatgtcttccctgggagcagccttgctagagcctctgatttacatccccagaccccttaaccccagacacatggggatgcactttcctgggtgagctgcaggctccatcccgcccctcaggccgggcctccaagttgcctggctccctctctggatatcccaccccagggagaaatcatcattcaacccaacagcagctttctctggtgaactttgtgtcactgagagcctgggctctctgcatctgtctcatctagtcaaacactgaaataactctgggtggctgaggcagggggatcgcttgagcccaggagttcaagaccagcctaggcaacatagtgggaccccgaatatacttaaaaaaaaattagctgggcctcgcggtatgctcctatagtcccagctactcaggagactgaggcaggtggatcgcttgagcccaggagttctaggctgcagtgagctatgattgtgccactgcgctccagcctggcaacagagcgagatcctgtctcaaaaaaaaccccacaaatactgaaaccagatgaggccctcatcgcctgggaccatgggctattccattattttttttttttcgatacggagtctcactttgtcgctcaggctggagtgcagtggcactatctcaggtcactgcaacctctgcctcctgggttcaagtgattctcctgcctcagcctcctgagtagatgggactacaggtgcatgccaccatgtccagctaattttttgtatttttagtagagatgggtttcaccatgttagccaggatggtctcgatctcctgacctcgtgatctgcctgcctcagcctcccaaagtgctaggattacagacgtgagccactgcacctggcctattccgttcttttcttttcccttggcagcctcatggccacacagcaggccaggctgcctactccctagttcccaaaggactcccctgaagagaggaaggctgaagccacagcagggctagagcaagtgtacattccacactcgctgtccccaggctgaccctccccggtcaacactgagagccacatggggccacctccagcccatgtctgaggagcttagtgggccggcctggccaaagggtcccactcagccctggtcaaaaaaggcccagatccctgcactgatgcctgaatgtggttttgtatttgttctatggggctgctgtgacaaagcactataaacttagtggtgtaaaacaatggaaatgtgttcactcacagtcctagaggccagacgtctcaaatcaaggtgccaagagggccacctcctctgaaacccacaggagagactccttcgttgcctctctagcttctggtgtttgccagcaactcttggcttgtggctgcgtcactccagtctctgcctccactgacacaaggccttctctgtgtgtctgtgtcttttctcttcccataaggacaccttcatattggatttatggccagccccactccagcatgacctcatcttaactaactacatctgcaaccaccctacttccaaataaggtcacattctgaggttctggggttaggacttcaacacatccttttgggggatgcaatccaacccataacaggtcccccaatagcccacaccaccacctgcctaacccactgccactcccttcccccagcctggcccctcgctaatcccagctcacatttcagatctcagctttgagtcccatcccttgggagtcgtccccgacccctcctctggtctgtgtccctgcagcacctgtcacctatgtgacatcaccctatgtgacggctttttttaaaaacagggtctcactcttgtaacccaggatagagtgcagtggcacgatctcagctcactgcaacctccacctcctgggttcaagtgattctcctgcctcagcctcctgagtagcttggaatacaggtgtgcaccaccatgctcagctaatatttgtatttttggtagatacggggttttgccatgttgcccaggctggtcttgaactcctgactcaggtgatccacccgcctcggcctcccaaagtgcttagattacaggcatgagccactgcacccggcttttttgtttttttcttttaacctgtgtccctccatagatgagcagctgctagaggctggtgcctgtgacttgtccccactggaggctgcagatatcccctcaccataagtaacctgctggctgcattgagagcacctgacagtaaggagccttgctcctggccagcacttctcaaggtgtggctcgagggctatctgcaaaaggaccacagaggagcttgattaaaagtacaattcctggcgagatgcggtggctcacgcctagaatcccagcactttgggaagctgaggcagatggatcacctgaggtcaggagtttgagaccagcctggccaacatggtgaagccccgtctctactaaaaacacaaaaattaggctgagtgcggtggctcatgcctgtaatcccagcactttgggaggctgaggcgggaagatcacttgaggtcaagagttccagactagcctggccagcatggtaaaaccccatctctactaaaaatacaaaaaaattagccgggcatggtgacgggcgcctgtagtcccagctactcgggaggctgaggcaggagaatggcatgaacctaggaggtggagtttgcagtgagcagagatcatgccactgcactccagcctgggcaaaagagcaaaactctgtctcaaaaaaaaaaaaaaaaaagcaaaaaagcaattcctaacgtttggggctcgatgattgaaaaaaaagaaagaaaaagaaaagtaccattcctaggcctattctcaggcctccagaacaaaggagtgggcaggaggcctcaggaatccaccttttttttattttaagatacagaatcttgctctgtcactccagctggagtgcagtggtgcaatcatggctcactgcagcctcaaactccagggctcaaacgatcctcccacctcagcctcccgagtagtgggactacaggtgcatgccatcatatctggctaggtttttaaattttttttttttttgtagagacagggtcttactctgttatccaggctggtgtcaaactcctgggctcaagtgatcctcccacctgggcctcccatagggctgagattacagaaagatgagccaccacatccggcaaggaatctgccttttaaacaagctcccagaagattctcacacacactaacatccgagaaccaccatccttggaccttgattatgggagccaatctaagcccatcttcccagagacctacgggttgcaaagggtggaggaacctgcttgtgtgaggctgcaccagtcctgcccctgggacccccttcctagctacgatccacttccagggccacaggcggccaacaaaagctgatgtccatcagccctaggcccatcatgggtgggggcatagctggccctgctccctgcccgataatattcctgggaggagaaagaagagagaggagcagctggtggtcgggggccctcacagcaactaccatggatggaactctagtagccagagctgcccagggagcacagtgatggaacagccctgggaccccgggcatctggaggagggagaggagaggaggagggagagagagaggagtagaaagatcagtgttaggagcccaagtgttctcccctaatcagcagtgggacctcaagcaagtatttaaacatttctgggcatgtttcattagtaataaaacagaagagaaaaacaccaaccctgcccacccctcagacttgcagtgccttcaccccactactattgatggagtgcctatatactgtcacacagtgggaggaattctgaaagctggagagtactagaacgtacaagatatttctaattataagataaagtgaggccaggcacggtggttcatgcctgtaatcccagcactttgggaggccgagacgggaggattgcttgagctcagcagttcgagaccaacctgggcaacagggtgaaacctcagctctataaaaatttttaaaaattaaaaaaattagtgtgatggctcacacctgtggtcctacctactcaggaggctgaggcgggaggatggcttgagcccaggagacggagtttgcagtgagcggagattgcgccactgcactcactgcactctcgcctgggcaacagagcaagaccctatctcgagaaaaaaaaaaagaaaaaaaaaggataaagtgtccccagaatgtatatccacacaaaaaactgtacactgatgtttatgagcagtgtgattcacaatagccaaaaggtggaaacagcccgactgtccatcagtagatcaatggataaacagaacatggtctatccacacaatgcaatatttcccagccatggaaaggggtggagcgcttccacctgctacaacacggctgaacctggaagacacggtggtaagtgaaagaagctggacacaagagaccacatcttgtgtgattccatttatacgaaagtccagaataagcaaatccatagacacagaaagcagattagtggttgctgggggagcagggaggaatggatggtggaggagaactggggagtgtgtgctaaagggcccagagcttctttttgaggtgataaaaaatgttctaaaattgactgtgttgatggctgcatatatctgtgaatatactaaaaactactgaattgtatgctttaaatgagaaaattaaatgacatatgaattatatctcaataaacctgttttcaaaaataataaagagccgggtgtggtggctcacccctgtaatcccagcactcggtgaggctgaggtgagaggatctcttgaggccaggagttcaagatcagcctgggaaacatagggagacctcatctctaccaaaaatacaaaaaatgagctgggtgtggtggtgtgcacctatagtgccagctactcaggaggctgaggtgggaggatcgcctgagcccgggagtttgaggcttcagtgagccctgattgtaccagtgcactccagccggggtgacagagtgagaccctgtctctaaagtggctgattcttttctttctccaaaaccttaattaagttgtttacctttaaaatataccctcaatccaaccatttcttaacacccctgcccccaccggctccctggcccagccactgtcatctcccacctggattgttgatgtcaccctttcccgagctgcctgcttctgtcccccatcccctgtgtgtttcccacacagcagcagagcaacaggagacccccactccacacactccctccggtggctcccacctcatgcaaagaagaggccaacatcctacggtgacctggaggcccacaccctctagccctgcttcacctgtaaccccatctctcccatgtgccccctcgtccactgtgtccagccactctggatttgctcttcagggcccctcctgccctctgtgcttgctttgctttttgctgagaatgttcatgcttcccagacaaccgtctgtctgactcactccttcctcttctaagtctgctccaatgtcaccagctccataaggccttccctggccacctactgaattattgaatattgtctcccagtcagtcttccccatcttccatccctggtttttctccatcgcatctaccaccttctaataatctacataacttactcagtttcctgtctgtcagggattgtgtagcccctgcacctagggcagccattggatggatgggtggatgaacgaatggacagctggatggatgaatgaatggaaggatggatggatgaacagacgaatggatggatgggtagatggatgaatggaaggatggatggatgaacagatgaatggatggatgggatggatggatgaatggatggatgggtggatggatgaatggaaggatggaaggaaggatagacggatgaatgggtaggtgggtgggtgagtggaaggatggatggatggataaatggagggacagatggatggacacatagatggaaagatggatggatgggcagatgaatgggtgaatggacagatggatggataaatacatgaatagataaataaatgggtagatggatggaaggaaggaagggtgaatggaaggatgatggatggttgaatgtgtggatgaaggaatggaaggatgaatggaaggaaatatggatgaacagatggatggaaggatggaagaatgggtggatggatgaatgatagatgaatgggtggatggatggctgaatggatggatggatggaagaatggacggatggatggatggatggaggggtagatggatgaatggaaggatggataggaagaagatgaatggaaggatggatgaatggatgaatggatggatggaaggatgaatggatgggtggatggatgagtagatgcatggacgggtggatgaataggtgtgtgggtggatgagtgggtggatggatggatgaatagatggaagaatggactgatggatggatggatgaatggatggatggatggatggatgatggatggatgaacagatggatggatggataaatgggtggattgatgaatggaaggatggatgaaagcaaggatggatggtggatgaatggaagggtggatagatgaatggacagacggacagatagatgggtggatgggtggatgagtggatgggtgggtggatggatggatgaagggatgggtggatggatggatgggtaggtggacagataaatggatggatgacggatggatgggtggatgcatggatagatgggtggatggacagacagatgggtgaatggctgggtggaaggatgggtggatggatagatgaatggagagattgatggatgggtagactgatggatggaaggatggatgtgtgggtgcgtggataagtgaatggatgatgggtggatgaatggatagatgagtggatgggatgaatgggtgggtagatgagtagatggatgatgggtagatgatggatgggtggatggatggattggtggacagatgggtgaatggaaggatggatgaatggatggatcgatggtggtggtggcaaaatggaagaccttccgtcaaccccacttgcgttccaagagacaggagaggacccagattcagaaccagggaagtgcttgcctaagagtaggctgtgtcctcaggccatgtcacctaacctgtccaggcccgcttctcattattaaaaggccccagaggagctgctttccacacctttcatcatgtgacagctacatgaactgaactgctgagttgcagggcctcctcttaaagaccttaagatcttattggagggaaaggcaagcaggcagaaagatggaactaacttcagggcagctcctgagcaggaatgtgaacccaaagggctgagcgaaggagcccatgaggaagtgaagtcatttggggtgggacactgcaggagcccagccaggtgtgtggggacagtggctgtggttaggacagtgggacacagccaaaggagagcctgggatgctggtctaaggagggcagcctgggattcctggaccgggcctccctgaccattggtggccacttctgaaaaggcctgaaggccgggagcagtggctcacgcctgtaatcccagcactttggaagactgaggcaggtggatcacgaggtcaggagttcaagatcagcctggccaagatggtgaaaccccctctctactaaaaatacaaaaattagctggatatggcggcgcatgcctgtaatcccagctactcgggaggctgaggcagagaactgcttgaacccgggaggtggaggttgcagtgagccgagattgcaccactgcactccaacccgggcgacagagcgagactccaccttgaaacaaacaaacaaaaaggctggacgcagtggctcacacctacaatcccagcactttgggaggccgaggcgggcggatcactaggtcaggagatcgagaccatcctggctaacacggtgaaaccccgtctctactaaaaatacaaaaaattagtcaggcgtggtggcgggcacctgtagtcccagctactcgggaggttgaggcaggagaatggagtgaacccaggaggcggagcttgcagtgagccaagatcatgccactgcactccagcctgggtgacagagcaagactccgtctcaaaaaaaaaagaaaaaaagaaagaaaaagtgaaaaagaaaaggcctgaagaccccggggctggggaaaggtggggaccagtctcctcactcttgttcccctccagaactggactgagccacagccacaagcttcaagggctgcccaaacaccccagactctgggtttgggacccctaccacccacagcgagaagacacagccttctagtgggggacccctccttctagagagggagaggtcatgagaaagtgaacttctcagcaacattcaagaaggttccacacacacacttatgtgttcactgcagcgttactcacaacagcaaagacacagaatcaacccagatgcccaccaacggtggcctgaatcaagaagatgtggtacatctacaccatggaataccaaccagccattaaaaaaaatcatggctgggcgcagtggctcgcaactgtaatcccagcactttgggaagccgaggcgggtggatcacaaggacaggagatcgagaccatcctggctaacacagtgaaaccccatctctactgaaaatacaaaaaaattagccaagcgtggtggtggggacctgtagtcccagctacttgggaggctgaggcaggagaatggcgtgaacatgaacccaggaggcggagcttgcagtgagccaagatcacgccactgcactccagcctgggcgacagagcaagacaccgtctcaaaaaaaaacaaaaaacatgttgtttgcagaaacatggatgcagctggaggtcattatcccaagcgaattaaggcagaaacaaaaaaccagagactgcatattctcacttataagtgggagctaagcattggagacacatggacataaagaggggaacaatagacactgtggactactagatgggggagtgagaaagaggacaagtgttgacaaactacctattgggtactatgttcactatctggctgataagatcaacaaaagcccaaacctcagcatcatgcactacatccatgtaaaaaacctgcacacgtcccccctgaatctaaaataaagttcactcagaagttcttcctctgaggagcttctgcagatgaggaggtgcttccacatcctgcaccatctcctgcttggctgctgtgcccaaggccaagactttgaggggactgcgtgctggggcctcgtgcagaagaagagctgggcctcaggtcacagagtaagctggtcctgggcttccagcttcttgctcccttactcttttcatcacacaggcagccaggacccagacctccatccctttcccctctctacctcaccctgcgtcagagacacaccccctaggaactgggcaattctggtcaattctccccacccgggcagccaccctcctacctaccaccactactaggccgggctacctcctgagattctctgcctgagccagtcctccatctgttcattcaacacacttgcccgggtgtgtctgcagagctccagatcagccagggggggcaacccatgagctgtggaacaaagtggaccaaggaaacaggtaccccctccacccagtggaagaccatcccctaggagaaagccccccaaaattagtgtatctctaaaattcatatccacctagaacctcagaatgtgatttttttttttttttttgagacagagtcttgccctgtcgcccaggctggagtatggtggtgcgatctcggctcactgcaacctccacctcccgggttcaagcgattctcctgcctcagccccccaagtagctgggattacaggcgggcaccactatgactggctaatttttttttttttgtatctttagtagagacggggtttcaccatgttggccaggctggtcttgaactcccgacctcgtgatccgcacccccttggcctcccaaagtgctgggattacaggtgtgagccaccacacccaggaagaatgtgaccttctatggaaacagggtctttgcaaatgtaattagttaagatgagatcatactggattaggtgggccctaaacccaacatcttcaatgtccttaggtgatgaggagaggacacagggacacacagacaagggagaaggccacatgatgacagaggcagagagtgcagtgatgaagctaccactcaaagaatgccaggaattgctggcaaccactggatgctggaagaggcaaggaaggatcccccttagacctttcaaagggaatgtggccctgccaacaccttgatttcagacttttgggctccagaattgtcagagaataaatttctgtggttttggccaggcactgtggctcacacctgtaatcccagcactttgggaggccaaggtaggatcacttgagcccagaagctcaagaccagcccaggcaacatggcgagagccctgtctctacaaaaaatacaaaaattagctgagcatggtggtgcatgcctatagtctcagctacttgggaggctgtggtgggaggatcacttgagcccgggaggcagagattgcagtgagcagagattgcaccactgcactccagcctgggcaacagagtgagaccctgtctcaaaaaaaacaattgctgtggctttaagctactgactttgtggcaagttgttaccgtggtcccaggaagatcaaataggaaccaacacctaagcctggcgctgtgagagcttcctgacaccatttaacactgagccaatcgttttcaccatccccatggccgcagaccctgtcgtcaccatcctggggcccacatgctctgaaacccagctcgagccccccttccaggaagcatgccccgacaaccgctccccctttctctgcactctcaggctgcttatttttagctgctgattacgtctaccttatatggttctctattcatgtcatgagcaggggctgtctcccctcctagtctgtaagctctttgaggacagagaatcccaaggatattaacagtcctgagcaggggaggcgtgttgatggattcccctggttggtcaagtttcatgatatttcaggaaactggaggcaaatatcaagttgccgcatactcacaagagtgataacctgtcattcttgtcatagtccttttaagcttagaaagtatctattatcaaaaaatattttaagcatccgatagccattttcttattatagtcacgaaacagccccatgctggaaatagagcaagtatcattatccccattttatgggtgaagaaacaaacgcagagatagtcagggacttggcggctgatttgtgacaaaaccagcatttgctctgcccccgggttccggtgctcccgctgggccccaccccaggccagccgctctgcctctgtgtagacagcgccaagcaaggagggacttggtggagtgctcaccagcttaactaccaattcggaaaggaaacaaaggcaggaaaggaggtgggctggtgtcttgggagcccgaggccaggatggtctccccaggacagggtgagtacttgacacttctccagttcttttccagattcttcccaagtcctagagagcactcccggtctcttgatctccttgggtaagtgcaagaaaaataagtaatcatctactacttgacactaagtaatcaacaaattggctagaggcctctctggtggacacagggacacaggtggtcacatcaggccctaaatgctgtgtaagttggaggcccatcagtggcatggcttccaaaggaatggcttggtcaagcctttacctattgccatctagacgaatttttttttttttcaacagagtcttgctctggcacccagactggagtgcactggcacaattacagttcaccgcagccatgacctcccgggctcaagagatccacctgctccagcctcccaagcagctgggaccacacgcataggccattatgcctggctaattgttgtatttttttgtagagatggggtttctccatgttgcccaaggtactcttgaactcctgcggtcaagggatctacccgcttcaacctcccaaagtgctgggattgcaggcaagagccaccgtgcccagcctaggggaaattctatgggagaaaactgagctggcctaggtcctagccaaatgactacctgaaggaggaccgggggctgcagttttggcagcaatccagtggtggggggaggcgggggctcccaaaccccgggactctcccctgagctcccagcacaagccacttcctacaagcccagaactccaggccagactttgtctgcacctgtttgagctcagagtacagtccctgctctagaagcatccaaaaatatctgagagagcggggaatagggaggggctatctggaagaaaacaggctagagtcttcagagggctgagagaaagagccacttggctcagcattcaaggttcttcccaactggccccaactcatcagggtggcctaatctcccccgaacacgagccccacactctagccagagctagtctcatcctgtccctggcagtgccgtgctctgagcttcctcacctcctggcttttgtcaccatcttcaggtgtctctgcctgcacaaatcatctgtcattcattagaccttgttgactgccttgaatgagccaagcgtcatgctacactgttcgtgatgaaatacgggcaaattaaacaaaggcacagcttccaccctccccaagctgaccgtccagcaattgtcccctccctgcacgttgggctgaaaccctgtccctctgcacagccaaccttcccaaccatcttctgaacttcaaccagagtgagcatagactgctggtgggggggtgttagttacatttttttttcagtgcgtgtcatctccccaaatagaaggtcagctcctgagggcagagacacaactcattcccgcctgcacagtgcagctggccaggacctcacagggctgacaaggggctgagagatgggcctcacagggagggacccacagctgccttacacctctccctgctctcatcaaatgccccactctctctgctccctgcagtctctgaggcatctgagtctgagattgtgccataccctcatgcttctatttgatccttttgtgccttcatccctaacccgagtccatcctgcttttccagcctaaagggggactccctttagggagcatctctcatttcttcaggatttggcacccaatctctcctctcctgccagggctggccatggcctgcattcattctgtgttctctctctcttttttttaaatatggggtctcgctctgttgcccaggctagagtatagtggtacaatcttggctcactgcaacttcgacctcctaggctcaagccatccttccacctcagccccctgagtagctgagaccacagtgtacccactacatccagctatttttaaagtttttttgtagagacaagatctcactgtgttgcccaggctggtctggaactcctgggctcaagcaatcctgccgccttagcctcccaaagtgccgggattacaggtgtgagccactgtgcctagcctattaattaaatttaataaattattgctttaattctgatttaatttggtgctttcattctgattctgccaccttccctgagatggggtggctcagcaattgctgctctgggagtccctctgtgacagacaatgaggaagtcacaggcaacaggcatgtccccaaggtaggggggcagctgggaccttgactccgagtaaaaccaccttcagggctgcagagggatgagggaggctgaaaatagatggaacaggacttctctgatattagagaaggatgacagcacaggctgccgccatcgaggaaatgaatcagtctctagaaactcagttaaatccgtcccatttgctaaactgcacccacccctgtcacgtcctactgaggatacccagctagggatgagcacaggggactgggacctctcgagcactgggcagatcatgcttagcagccgtgctcgccatggctccaattcattcattcattatttcacccattcaggacccagaagagaaacccctgctatgtagctcagtccctctgcgctcagaaccggtgaactatttaccacctccgtgttgagatttaggaactttgggtgagaccttgcctgccaaatgggaaattccatcttagagatatcttccttgagctgaaatcttctgaatcctctgaaacacagacagacttgagcaaagtgcccatctgtgctgcgagtcaccagcctccactgcaatgagctgcagctccccccatgaccagtgtcttggtagcagggacaggggtcggagcaggggcccagcctgagtagggaagggagacccaagagggaatgaaggagccaaatagggcggaggcagactctgaagatcaacttttagctctaagaagacaggtgaggccaggggcgaggtccctgagaagacaggactcccagagcaaactcgggagagaacagaagccagcccaccaccttgagccaaagtgagtcctcatgccaaagtgagtcccaccaatgggacacgagagggcacaggcctcacagccaggaacacatcatgaaggggacctgaggctggactcccatccccagtccacaaagaagaatgaaaaccaaagtcagctgcgtgcagtggctcacacttgtagccccatcactttgggagaccaaggcaggagaatcacttgagcccaggagtttgagaccagcctgagcaacatagtgacatagtgagaccatgtatctacaaaaaataaaattagctgggtgtggtgacacatgcctgtagtcccagctactctgaaggctgaaatgggaagatcacttgaacccaggaagttgaggctgcagtgagctatgattgcaccactgcactccagtctgggagactaagtgagaccttatctcaaaaaaataaataaaaattaaaaaaagagagaggactacagtcatcatctgagtaactcaggccacatatccaccgcgccaatttccacttaaaaaagctagccctgggccgggcacggtggctcacgcctgtaatcccagcacttgggaggccgaggtgagcggatctcgaggtcaggagatcgaaaccagcctgaccaacatggagaaactccgcctctactaaaaatgcaaaattagccgggcatagtgtagtcctggctactcgggaggctgaggtgggaggattgcttgagcccaggaggtggagactgcagtgagccttgatcaaccactgcactccagcctgcgcaacagagtgagtccctgtctaaaaaaataaataaaaagaaaacgtaaagaaaaatattttctctacctcagtaaacccatctgcttttaagttactgttgctggcctttatttatcccaaacttaatttttaaaggtttctatgtctaaagatgttgcctcctcatcctcactaaataccctcaaaccctcctcattggtcagtgacctcctggttgtcagaaggaacagctcctctccctcagcatctctgtgatatttaatcctgctggccactcgcccttcttctagaagacctgggcttgcaggtcactgtctcttcttgggtcccttcctatctttctgaaattcatttatcttcttcctcttcctactcctcaaacttagcgttgatcaaggactggtccttgaatctttgtctctccctggtacagctccatgggtgacctcagagcctccctctcatctttacgtaaatgaatctcactcctaaatgccctgacctgacttccctcctaagctccagtcctgcctaacccctgccacctccttccagatgccccacgagtaaccaatcttcataatgacccaaactgaactttttttttttgagacagagtcttgctctggtgcccagactggagtgcagtggcatgatctcagctcactgcaacctctgcctcccgggtacaagcaattctcctgcctcagcctcccgagtagctgggattacaggcgcatgccactacgcccggctaattttttgtatttttagtagagatggggtttcaccctattagtcaggctggtctcgaactcctgacctcgtgatctgccctcagcctcccaaagtgctggaattacaggtgtaagccactgcacccagccgtgaacttttttttttttttgagacaaggtctcactcagttgccgaggttggggtacaatagtgccatcacagctcactgcagcctcagcctaccaagctcaagcgatcctcctgcctcaacctcccaagtagctgggactacaggtacccgccatcatgcccagttcattttttctattttttgttttattttctatgttgtccaggctggtctcaaactcctaggctcaggccatcctcctgcctctgcctccgcctcccaaagtgctgggattacaggtgtgagccacttcatccaagcccaaactggactcaaaatctgttcctctctcttatgttcccagtctatttttctggcaagatcattctcccagtgacctcaatggaacctgtaagggccccctcccctggcctggctcccaagctgggaaggccagggattctacaccagctgtcagctgggtccaccccttctctccactcccaacccctcgcccaggtccacactccctcacctacctctctggcatggctgactaatcagtctccccctccctactcttcctacaaacaactgccagacggatcttccctgagcccttggtagtgacccgctgcccacagagcaaagccctgcttagcctaacaaggcccttcacacttcagccccacccctgccttccgaacacgtcccgccaccccacttccatctgcccgccttcatgcaagacagaacaatgctccccttccctgggtctcaccagagccccgttgctctggcaccgtgagtttgctcatcttgttccctcaactcagaattcccttcctgccatctttctgttctgaatcctgctttcttcaaggcccagctcaaatattccctcatccgtaaaaccttttctgatccgatccactcagctcaggatggtctcctccctgccttcagccccaccttgcttttcctgtgcctccccagtgacactgatgtgtgtcccatttgactagattcagctacgtgcaagggagaagacgcctcctctcccctactggactataagcactgaggacaaaatgcctgtctcaattcccctagtaccatacttcaaaaacagcagggatgcagcaaacgagggatgggttcacgaatgatggaacacgttgaggtgtttgaatgacagggttgcacatacgagcgatgtttacaggtaaggacttatgctgcgatgaggcctggatttgggtttggagcagggcatgtgcccaggagagagagctaagtaagcccaggcgctccatcccacagccatggccctccctgctccccactcccccagccacctgcctcattccagccaggatgcacagggcctagctctgtccttagcctgcaggccaggtcagagaacggaaacagctgtccccctcctgagtccataggctgactctccccagcccactacacccaagcaggcatcaaacggccagctagatgctaccggcctcatctggacctccctctgggggataagcgggtaaaagcactggccaaggagtggaaaggactgaattccagctctggcctgccatgaactcactgtttgaccttcactgtaatacctggatgtaggaaaaaaccagcagttcctaaacagcagttccacaggccaccatgcccggtgccactttttttttttttttccttgagacaaggtctcgctctgtcacccaggctggagtcagtgatgcaatcacaactcactgcagcctgaccacccaggttcatgtgatcctcccccctcggcctctcaagtagctgggaccacaggcatgcacccctacaccgagctatttttttttttttttagagacagggtctcactatgttgtccagactggtctcaaattcttagcttcaagcgatcctcccaccttgggttcccaaagcgctgggattacaggtgtgagccactgtgtccgaccaccgtgttaccttcttgagggatgtgttcattagcaagacccagtctagtgcattccaggctcactgtgggaccagatgtcccctacaggcttgcccggctgcaccaaatgaggagtcagggaaccagctgtggggaaaaggcttctggggtctgttctctccccaagacccctgagcttgctacattttctcagcagccctgccacagctaggctgccctgatgaggaaactggagtgctggcctctttccagaaataaccagccaggggtgggagagaaaggggcggggaaacagcttcctgaccgtcactgcacccttgtctcacatggcgggcactgagctgtgggcactcacagaggggcagccccagcatgcaccagccccttgccattggggtggccgggtggggccagggcagatgggcaagtctgaagctagggctggaggtggaggaaggatgagatggacaggaatccccagatccccaatctccgtatcaagcaacaagagggacaacaggaagcaaagaggtcccaaattctgcctttagcagtaaacaccaatggcttaaacccgaagaaatgaaatgctttctcagcagacttcgctctccagggaaaccaaaagcatagctcttcgccctgcaaactagggaaactcccccaggacggtcttatccactgcaccctttctcctcctttcacactcaccgtacagggagagaggggcttgggagtgcaggcagggtctgtcacagagagacgggctgaggaaaggagaggaccctggcccgggtgtgcctgtcactgacgcgctgtctgacctcggaaaagttttcctgtttctctgggtttccttcccttccctggatggtggggagaccgatcaaatcattgctaggggcgtttcccactgctttaaggaggaacagccccaagccaggactcccaaagaggagggcccagtgggtggtacaaaggcctgagtgcagcagcaggtcgggaggtggaaaccgggtaaggccccacctggctgctccttccccgtcctggcatgggcacgggcgacgggtggttggtaacagaggggcgcttgtctcctcacagggaggcgagaaggagggctgcagagcccaccaccccagccagagctgcacacgagcaacaaggaggagaagccggaggagaagctctgtggggtccctggcctaggaagcagatgggagtggtgagcgagaatatctgccgccacccagccaaggagcaagcatgatagggagggaagttagcacacagcggagagatgagggaaagaggtcaggagccaagatgtgacctttgggtggggtggtatttaccggggtggcacaattctgaaggggaaatcacccagtaggaaggactgtcatgatgggggcgtgaggaagccaccttgtgggttagaacctgccggtggatgcaggaggaggcctattctggggtatacagtccacagtggggcagagtcctgataaaatccaccacagtggatgaaacccacagcccaagtgctgagcaggagcagggacagagggaagctttacgccggaggttgggccaggggcagacgcacgctgtgggacccaggaaggaaagacagcagagagaagggacctttgcacaagcacctgcctgcgtcctttccccacgacaagagcccccagcgaggcctgcagaacattccagatgaccagttccctcggtgggaggaaagataaaggatgtccctaaaaggccaaaaattcctggggcccagtgtgtagcagcccagcagctggggctggggggcagcacaggagcggccacgaagggagagggtggcagcggcttggggctccggatccaattacgcggctgtttccatacttagccgcctgacagccgcctggaatactcagcactcaagccgctgcagccctgcagagcccaaattaactcaaggacagacaagggcagggcccagcagcacatgcagtggctggagccccccaccttacatcttgagtccccgagaaatagcttttgttcccacccactgcctgctctccctgcagggactgtgcccctgcaaccccctattcaacctcaaagacctgagaggctggactctgggcctctccagtcccaggtacggacctaggctcagagcccagcttgggggaagactgccgagtcatgaaaagactcggtgggcagtccggatcctagggggatccccggagcacctccctaaaagcattccctcggggaacctggcctcaggaaccttaggaacaagagaggtggcaaaacaatctggcatctcctccatagcctatagataacccccatgctgcaacccaagccaccacctctgctacccaaagtgctgagatgtcaaagggaagcctcagcacacagagccaagccccttttctgatggaagcccccaccccgagcagaggctctactccagaacgggccccgttcctcttctgaattgcatccaatgctgtttccagcccaaccgccaactctatttccgatcttatcccaaaccaattccaattctatctcactgctcccaaaacggtccccacctttgcccactgtatccccttctgtccacgcaaacccagttctcttacccgagtggggcctccgccttatatcccaccaggtgggagggtcacctcaacgacctccagctcccagactgtgctattttgtccgtctcagaggctcccccgtctcgactttgagggccctctttcccacatctactggccagactcctctctgaccctggctcacagctcagctctgtttgccgttcccacttcctctggccttcctgagggccccgcaactgtgctgctattctccagcacccagctctttctctgaggccccaggcccggggaaaagagaagggtaagaagacaccagccaagagccagggtttgccatcagccccgaccccctacccaacccatggtagacagaaaaccttggaggaagcgtgggggaccagtctgggctgggtcatgctgggaggggccctacctgcttgtcctgagaacaggagcgaggccaggaggcagccgagcaggaccagcgccctcatggtgactgccaagagagcccagctgctcctcgcctctatttatacggccggccgtggcagcaggcggtggaggggggagaggggtcacacagtcaccagggcaactaggagggtgtgatggggaagaagcccggaccccagaaggctgtgcagaggctcaggctgcgccactgctgtcccagctgccaggccccagaaggcagggccgtggctggattctcttcccccgaacccctgcagccctgggatcacatgacatgggtcacagggcgtgggtgacaggcataaaatggagcatcccttgggctcaggcggtggagctgggaagctgagtcttcccagaacttgcaataacttgacctgaagtctcggcaggttaaggaccttgacacgcctgcactggaaggaggaagttgtaaggccacgcaaaagaaatcctatttaacagccactgatccacatgctagagagtggtcagctacggcaaacccgcaacatgtgacctctgaggtccaaggctgcagccctggaacaaccttcccagcctctggaagagagagagcacagaccagagggagaggggcacactgagacacaagctgaggctacggtgtaaactggaggatggagcaacagatatccatttccaatggcccaggggttccagaacattcagtcacctctgcaaagtgcttttttgtttatttgtttttgatagaggatctcgctctgtcacccaggctggactgcagtggcacaatcatcactcactgcactcgacctcccaggctcaatcaatcctcccaactcagcctcccaagtagctaggacagtagtgccaccatgctgtactaattttttaaaattttttgtagatggcccagagagccagttgtaagaagccaagggaaagcagacacttgcttgtctggtcggggtacagtgtcactgtgtggggaagaggtagaagccagccttggaggaaaggaactaaatcagggccaggcacagtggctcacacctgtaatcccagcactttgggaggccgaggcgggtggatcacctgaggtcaggagattgagaccagcctggccaacatggtgaaaccccatctccactaaaaatacaaaaattactgggtgtggtggcgggtgcctataatcccagctcctcaggaggctgaggcaggagaatcacttgatcccaggaggcgaaggttgccatgagccaagattgcaccactgactctagcctgggcaacagagcgagactctgtctcaaaaaaaaaaaaaaaaaaaaaaagaattaggcatctggtaggcacttgactttttttttttttttaatcttttttaagagacagggtctctgtcaccctggctggagtagtgacacgatcatagctcactgcagccttgaactcctgggctcaagccaccctctcacctcaacctccgaggggctgggaatacaggtgtgcaccacatctggctaatttttttgttttttgcaaacatggtcttcctatgtcactcgggctggtctccaactcctgggctcaagcaatcttcctgtctcgacctcccaaagcactacgattacaggcatgagctactgctttttcaaagacaaggtcttgggacttttcctcttggaagtcccctctctctcactaaggagctgtttttctttctctttcttttgcctgttaaacctctgctcctaaactcctcatgtgtgtctgtgtcctaaattttcttggcgtgagacaatgaaccccaggtatttaccccaaacaatgtagctgcttcatgttggggacctcatccgggatcccaaggtacaacactcatcaaaacgagtcaagaaaacttattgtgaactatttatggcctttaataattgaataaggtatactcctgtgaagaaaatttggagcatgtttgtttctctctgcctggtttctctggaatctggaaactatctcaacatctggtggaggcaaaccagtgttacaacccatcagaatggctgacagtaatcaaactctaaatggtgctgcagacagaaccatgcacggacatgccttttttccgaggacccttagctcgaccccaggaggagcccttagcttctgttccccacacaacaccccttttaagtatgaagtagccagaaagagtcatcatcaaacaaccccgaagagcagttagggttaccactccagagtggggaatgatacaggagttaagaggaaattacttagatagtgaggatacagaagtcctcagtaaggttttccttttactgaaaagcagccccaaatcattttcctttctaacaaagagcagcgtgtaaaatcgagctgcagacatagatgcaggcagttgtgccaatcatgttcaaaatggcggctccatcttcccttctctgccagccacgtgcacagtaaggagcagacaagatggtgctggccaaggggaaagttcatttgcataataagattagagtggggaggtcagccttccccacaccccagcgctatgtaaacatcatacctgactgaaccaatctgtgagccctatgtaaatcagacaccacctcctcaagcctgactataaaatccagtgcatctgctgccggtggcgttttcctttcagaagtaccctctctctcactggagagagctgttttcctctctctctttcttttgcctattaaccctctgctcctaaaaattaaaaaaataataaaaacaaaaaatttcaaaaaataaagatgaggtctcactgtgttgcccaggctcctctgaacttcccaggctcaagtgattctcccaccttggcctcctgagtagccgggactacaggcgtgagccaccatgcccagctctgctcagctcagctcagccttcagacagaagctgccagagccctcagcctaaaagaccccaccccattttcagaaaccatgcatccctaggcacacctgctcctgactgtctcagactgacattcctcagatgactggggaggaagcatgtttgagaacaagacgtggggcagaagaaaaaccatgtagcccggctactcctttccaatggtcccatttctgatgccctggagccagcgtcagccagctgcttctataaggggccaggcggtaaacagtttaggttttgttggccatctgcaactcttccactctgcctgtgtagctagagcagctggcaccacagagatgaatggatgtggatgcatcctgataaaactttattataaaaaaaaggcagcttggttccaagctgtagtttgcaaatctctgcccatactctagggaaatcatttggtgaattactttgtaaagcagaaaatcctttggtaaaggaccacccatatcagcgctttatgaatctgggttttcctacgtctggctgcttcatgtgggggttcagagctagaaaggggaaggcggtgcaatatctcggggccaggggatgacgtgtgtgtaacgaggctgctgtggatttgagcctgggagcacatgctccggggagaaatacgtgaggagtttcatcatctttttttttttttttttttttttgagacagggcctcattctgtctcccaggctagagtgcagtggcacaatcatagctcactgcagcctcgacctcctgggctcaagcaaacctcctacctcagcctccaagcagctgggactactacacctggccattttttctttttctttttgtagcaacatagtctacctacgttgcccaggctggtctcaaacaatcctcctgccttggcctcccaaagtgccaggattataggcgtgagcctgacaagaagagtttcttgggggaaagaagtaggtttaaccctgaaaaactttctccgatcaaatgagaagaggtccccagaagcggcaagtcaacatcacagtcacaaatgtttatttggaggacctgacagccaggtctcaattgctaaagtgttgccacaagaaggaagtattaggcttgtcctgtgtggttcctgagggcaaggccaggtttgatgggcaagggtgacaagaaacccattttagctcaaggtgaaggaggatgttcaggttgaagctgcccaggagaggaacaggattgctgataaagaagtgtcctgtccctgcatgggttccagcagaggccaggtatgcagggacgggcactgctcaagtgctttccctccctgcttgtgcttaaagtctgattctagggaagactctggggctggtgcctcctggaggccctctgcctctgtccctacatcatttcctctggaactccggcctcactggtttctgcgggaggcgcttacgtgcaacaagcctggcccgcatccttgtctcaggaccgtgggctgtctctagggtggtgagggatttatccagcaagcagtgtccttgagatgaggctgcatctgccagcgggcatctgggtgggcagggactcttggaaagccaggggctgtgaaggaaaggagagcttctgcacgccgcatcccagccatttcagcaagggtcttgggggagggtctggatgggcctcctcgcctgcttcctttttttccacttcacttgcagagggctgctcctctcaaagctcaaagtgctcctcttctctgatggagaaaatccctgggacagggctcagagccacacgtcggtgattccggggaagatgcgggcctcagttgtcaaacagggcagccagcctcatagaactgctgtgagggacacgggagatgctggaggacacaggtcatgagtatgagctcactgaattatcacaaagcacgaagagcaggtgatgggggggacagggagtggagatgataagaaaggccacagcccctttaccgttctgggcacgcacttcctgtggctaagcccctctttggcagctgacttgctgtatcgtgccacacctcaaacggttcctcaaagggctaggaaaatcagattgaacatgacaactcaggtctctgaatccattttgtactcaagactgacccagcgttaacatgtaaccctcattgaaagtattgtcccatttatctcagaaatcataggttatctgtcttagagggacccaaattcccacccaagcagaaatcccttaacagccagccatccagcctctgaatactcccagcaacagagagctcactaccagacagctacagctctgctgttctgaagagtgtagggcctagaactagccacggtgctccaggtctcctcccaacttctaagtctcaactttcagccaaaagccaggagcaggccgggcgtggtggctcatgcctgtaatcccaacactttgggcagccgaggcaggtggatcacttgagtgttgcaggccgaaagagtgagggtcgtgatcaactcagtgcaccactggaggctatatgagtaaacagcaaactgttttcatgaaagcagggtgttggcaaactgacaaactgcgtctgccacccagaaggaatgctgagggcagtcacgacccagcacaagtgtttcttgtaatgagataaggtgaacctgtgatcaatcaagcagctgaccaattgttacctcctccaccctgctctttctaccgaatgagtatgaagggcggtagaggttcaaggcggctgcccttgctcactagaagcagggagccctcttcttcttcccctggccccttcctttaaaacagtttcttttgttttaagttttcatttctacgttcgtaccccttcgtttagtcccgtggtaactgtggcaaaccgcggcacttgaggtcaggagtttgagaccagcctggccaacgtggagaaaccccatctctactaaaaataccaggcgtggtggtgcacacctgtaatcccagctactcaggaggctgaggcaggagaaatgcatgaacccaggaggcagagccgagtaagccgagtattgtgcctctgcactccagcctgggtgacagagtgagactccatctcaaaaaaaaaaaaaaagccagggacatgcaccacaaggatcccatggagaatgagcactacctctctcctgatcgcaaccaagccaccccctgctaacccttatacctgacatctccttctcctacaacagaacagcagatacagagactcactctgtcgcctaggctggagtgcaatggcgtgatctcagctcactgcaacctccacctcctggatgcaagcaattctcctgcctcagccttctgagtagctgcgattacaggcgtgcaccactacagtccggctaattgttttgtatttttagatggggtttcatcatgttggtcaggctggagaacagcagtttgtcaattctctttgcaaccagaacgttcagagcactgtctacatctcccatagggcaggagacaataggagagataataaatgtgtatcaacagactaaccgctgatgtgtgtggcacctgcaaccccttcaaccttcacaaatcacctgcctatttattgaggccatccaccaagatagccggcaccctggggaaaacttgacttgggccccctaattcaggcaactttgcagctgtcattcttagctcctaattttttttaatttatttttatttatttatttttttggagacggagtcttgctctgtcactcaagctggagtgcagtggcacgatatcggctcactgcaagctccacctccagggttcaggcaattctcctgcctcagccccctgagtagctgcgactacagattttttgtattttggtagagacgggtttcaccgtgtagcccaggctggtctcgaactcctgagctcaggcaatccgcccgccttggcctcccaaagtactaggattacaggagtgagccaccacgaccagcctttgttgttgttgttttgagatgcagtcttgctctgttgcccaggctggagtgcagtggcacgatctcagctcactgcaacctccacctcccaggttcaagcgatcctcctgcctcagccccactagtagctgggattacaggcaggcaccaccatgcccagctaatttttgtatttttaatagagacggagtttcgccatgttggccacgctggtcttgaactcctgcccttgggtgatgcacctgccttggcctcccaaagtgctgggattacaggcgcgagccaccatgcccggccagctccttgttttctcaatcgggggtgtggtgggagaagctgctttggggaactcattcctttcttcagctgccagatttagagctggtcctgccgcagcccccagtcctatcccctcctctgtcagcacaggttcttgtcaaccaacagaataaacttgcgactcagcagggcaagaggagaaaggagacaaaggcagaggatgatataacgccatccctgcccaggacctgcaggacaagggaggccaagccggccaactcaacagagtgaaaatgacaaatgctacaaggccacacagcatcgaggaaagcacagacagacagctggttcaagaaaggacaggaggatggactaggatgcgggggaacaccgtggagccagaaacacaaaaaaatctgaagctgaggacagcatggccagctggctccaagaggctgtttgaggatttgcatgtgctttacatactggtctggggccagttagtcaactgataagggggccaaggtcacaggaagggacccctcttccactcaatagcccttcaaacatctagcagagctggggcatcgctctgctgcacggccaaagacacccccaaatcatggcaccaaaggcacgtttttattataacccacccagtaccagaaagacatagaaatggcctttctctataaaatatagcaagaaagcacgaactggaagtactagtggaagaaaaacaggaaggcacacagtatggaaccattcgtaagactaacgggaaaaaatgacaccatatatttcagtccctcacatgtgtgtaacttgaccacctgcccaattcagtgtccttaaaataagagcaaaccaaatgcttggaaggagtgaaattatttcaactattgagactcggcaagaatttcttctgagaatcctcgtaaagaggaaacagatacagcacaaggtaatgacacttgagaacattcttagaacagacatacattttccatgaagtttatccctaatagagactcttaaaatagggcaggggaccagccaggcgcggtggcttatgcctataataccagcacttcgggaggccaaggcaggtggatcagttgaggccaggggttggagaccagcctggccaacatggcaaaatcctgtctgtactaacaatacaaaaattagctgagcacggtggtgcatgcctgtaatcccagttactcgggaggctgaggcaggagaatcgcttgaacccaggaggcggaggttgcagtgagccgggatagcaccactgcactccagcctgggtgacaaaagtgaaacttcatctaaaaaaaaaaaaatagggcaggggaggccacagagaaccaagaatgcctggccccgcctcaaagaaatcaccccccaaacagggtccatgacacatgcttaggacacttctcctgaactgtcaccttacatgctgttggtaggagagaaaattggtaccatgcatttgggggatggtagctactaaaatctagttataatagccctaagttggaaacaacataaatgtccaccatggccaggtgcggtggctcatgcctgtaatcccagcactttgggaggccgaggtggatggatcacgaggccaggagttcaagaccagcctgaccaacatggtgaaaccctgtctctactaaaaatacaaaaagtagcagggtgtcgtggtgtgtgcctgtaatcccagctactcgggaggctgagacaggagaatggcttgaacctgggaggcagaggctgcagtgagctgagattgagctattgcactccagcctgggcgacagagcaagactctgtctcaaaaataaataaataaataaataaataaaaataaataaaatgtccaccactaggtgaatggataaacaaactgtggtctattcatacaatgaaatagtacttagcaagaaaaatgaacatttatgtttacataaaaacataaataaatctcagagatattgtgttgagcaaaagaagctagacaaaaagaacttacgtgttgtatgactgatacaagcttctagaacaggcaaaactccagcctggccaacatggtgaaaccctatctccaccaaaaaattgaaaaattaggccaggcgcagtggctcacgcctgcaatcccacaactttgggaggccgaggtgggtggatcacctgaggtcaggagttcgagaccagccaggccaacatggtgaaaccccgtctctactaaacaaaaattacctgggcgtggtggcgggcgcctgtaatcccaacaactcgtgaggctgaagcaggagaatcacttgaacccaggaggcagaggttgcagtgagctgagattgtgccactgcactccaacctgggcaacaacagtgaaactccacctcaagaaaaaaaaaaaaaaaattagccaggcgtgctggcacacacctgtggttcctgttactcgggaggctgagacgggagaatcacttgaatccaagaggtggaggttgcagtgagctgggatcatgcccctgcactccagcctgggcaacagagcgagaccctgtctcaatcaatcaatacacaacagcgaaaactaatatactgtgacaggaattaaaaccaaggccaggtgtggtggctcatgcctgtaatctcagatctttgggaggccgaggtgggaggactgcctgaggacaagagttttcagaccagcttgggcagcatggtgagaccttgttcctattttttaaaaaaagagaagaaattaaaactatggtgagattccaccatacacctaccagaatacctaaataatgataaatctgacaatactaagtgctggtgggaatgcaaggcaactggaactctcataaaaatggtagagaatagagaactacatacacataaaacattaaaaaacgtgtaaatctgagtaagtcccatgtacagtaccaatgtcaattacctggcttctatgctaactgtagctatgcaagatgttaacactgagggatactgggtgatctccctatacatctctttcttttaaaaaaaaaaaaaaaaaaaaagataggccaagagcagtggctgacgtcgtaatcccagcactttgggaggccgagacgggcagatcaccttaagtcagaagtttaagaccagcctggccaacatggtgaaacccgtctctactaaaaatacaaaaaaattagctgggcgtggtggcgcacacctgtaatcccaaataactcgggaggctgagaaagaagaatcacttgaacccgggaggcggaggtccactgcgctccagcatgggtgacagaccgaggctctgtctcaaaaacaaatagagatgaggtcttgctatgttgtccaggctagtctagaaatccagggctaaagccatcttcccccttcagcctctctagtagctgagactacaggttagaaccaccaacccagacttctccctgtacatttcaataattatttcaaaacttaaaaatctgaaagaaagcaaactgcttgatagtggcagaaagcaagcatgaggggattctggggcttgctgggggtgttggctacctgggtgtatgttcagtttgtgaaaattcacggagcgcctaagctatgcaccctcttctgaatgtgttacccagtactccaataaaaggcttttggccctggagaggtggctcacgcctgtaatcccagcactttgggaggccaaggcgggcggagcacctgaggtcgggagttcgagaccagcctgaccaacatggagaaaccccgtctctactataagtacaaaattagccgggcgtggtggcgcatgcctgcaaccccagctactcaggaggctgaggcggaaaatcgcttgaacccgggaggcgggggttgcggtgagcccagatcgcgccactgcactccagcctggtcaacatgagctaaattacgtctcaaaaaaaaaataaataaataaaacagccgagctggaggtgtgtgcctgtaatcccagctactcaggaggctgaggcgggaggctcgcttgagcccggaaggtggaggctgcagtgagccgagatcgcgtcactgcactccagcctgggcgacacagcacgactcttttaaaaacaggttttgttgagtgccgcattgatccggtccctcccacgccccctgtgcttcacaaaaacgtcaggtccgagctccggcgcggcggtctcctcctccgcgggtccgggccggaactcggcagaaggacgagcagctccttggggccggcagtctcccatcgcactgagattgacacggcaatgtttcggatactctgggtaaaaattaaatgtcttacgaaaagtcctgtcacccgtttcttgattactttttacggcggcttccagaacctttcgtcagcgcgagctccatgcccggaggccgccgtcacctgctctccgggaaggccctgggcaggcaggcagcgcgctgaaggagtccgggagcagatcgtgcgagagagcgcgcgggcgccaggcgcgggggcggggccagacgtgcgtgctggcgggagcgcgcgcgccatggcctgaggcgtctgggaacatgcgcggcgaggggacgggcggggcgagtccgggaaggggcggggccgcagccgcgcccctgacttccaccgcctgcgggtgagaccgcctaccatcgcccggcgcgcttgagcatgcaaggggaggtgggattcccctggcccgcccccaagccacgcctctggcctatgagaactgagctgtcccgcagggaccgagagaggagcctccgctttcgcaggggctgggcgttccgggcgcactgcgccctctgttgatcctcttaggagctgcgtggggaccgtcgggcctgccgtttcgcacctggccgaaaggggtcgctgtgccgggccagatcctatgtaaatttagctggataatctcagcaagagaaaattggctgcagtgcaaagaagccaggctcaaaaggcagggttatcccatttctatgacatgtcacaggtaagactatggcaacatagatcagtggctcctaggggctgggttgaccaccaagaggcatggggggcattggaaatgaaggaactaattcatatcttttttattttgctttggttttatttattatttatctatttatttatttttgagacagtttcgctcttgttgcccaggctggagtgcaatggcgcgatctcggcccaccgcaacctccgccgcctgggttcaagcgattctcgtgtcttagcctcccgagtagctgggattacaggcatgcgccaccacgcccggttaattttgtatttttagtagagacaaggtttctccatgttggtcaggctgctgtcgaactcccgacttcaggtgatccgcccaccttggcctcccaaagtgctggaattacaggcgtgagccaccgtacccggcctgttttattttttctttaaatcatatcttgatcatagtggtgggtaggaaactatgcatttgcgtgtaggaaacacgcaaaaccaaaaatcagaaagtgtgacttctactaaatgtaactactttcatttttaaaaattatttatttatttatttattttttaagatggagtgtcgccctgtcacccaggctggagtgcagtggcacaatctcagctcactgcaacctccacctccccggtgcaagtgattctcctgcctcagcctcaccagtagctgggaccacagttactggcattcgccaccatgccaggctaatttttgtatttttagtagagacggggttccaccatgttggccaggctggtctcaaactcctgacctcaagtgatccgcccacctcggcctctcaaactgctgggattacaggcgtgaaccactactgtgcccagcctaatttttgtattttagtagagttggggtttcaccatgttggccaggctggtcttgaactcctgacctcatgtgatccacccgcctcggcctcccaaagtgctgggattacaggtgtgagccaccacgcccagccaactactttaattttttaaaaaagatattaaaaccagaaagcaggtggttgctggagactgggaggagggggaaggagtgactgcttcatggagtcattttggagtgacggacatgttttggaaccaggtaggctgtgtaacactgtgaatgtatgaagtgccattgaattgttcactgtaaaattccaagaaaacctgcagactcctgcctttctgtgaagagttcgtgtccactgtcatcgtggggtgagctgtgattctgccttctgctctggcctcagtccccaagcacccagcactgtgagcatgaggcataggaggggaccacggtgtaaatcgatctctggtcacggaagagtgaaggatttaaaggaccatggcctagcctgggcaacatggcaaaaccctgcctctacaataaaatataaaaaagtcagccgggcccaggccaggcacggtggctcacacctgtaatcccaggactttgggaggccaaggtgggtggatcacctgaggtcaggagttcaagaccagcctggccaacatggtgaaaccccatctctactaacaatacaaaaattagctgggcatgatggtgggtgcctgtagtcccagctactcaggaggttgaggcaggagaatcgcttgaacctgtgaggcagaggttccagtgagccaagatcgtgccattgcattccagcctgggtgacacagcaagactccatctcaaaaaaaaaaaaaaaaaaaaaaattagccaggctttgtggtacaggcctgtagtcctagctactagggaggctgaggtgggaggatcacttgagaccaggaggtcaaggatgcagtgaactgtgatcaaaacactgcactgcagcctgggcgacagagcaggaccccatctcacaccaaaaaataataataaaaatttaaaaatagccaggcatggtggctcatccctttaatcccagaactttgggaggccgaggtaggcggatcacttgaggtcaggagttcaagaccagcctggtcaacatggtgaaaccctgtctctactaaaaatacaaaaattagctgggcatggtggtgcactcccgtagtcccagctacttgagaggctgaggcaagaagattgcttgaacccaggagatagaggatgcagtgagccgagatcacgccactgcactccagactgggagacagagactctgtctcgaaataaaggaccatgccaatccccaataggatgcaatgtccttgtgccgttattatcgccaatttttagaagaagaaattgaggctcagaggaagcggtttgtcagagggggaactgacctctggcagaccaattccaggatcttagcacttaaacaccacaccacgggggggcaggggggtgctgggggggtgcggttggagggggtggggttcccctcctaggggaggagaggatgaggctcagagaagttacagaagcccaggaagtggcaaaacctagggattaaccaaagcgtagggaccaagcagggcccctgaacacctgtgtcctttcccaggttttcggaatcggtggcttggttgtccttctctccttgccgcccaccaaagagccactccccagcctcaacaccatcttccatctttacagaatacccagggtcatcccagggaaactgaggaccccaatttttcatcgcaacaccacacacaagctgagggagtaactgtgctcacacacacccagtccgctttggggggcccaaggagcccccctactctagatggggtagccctgccctggtcttcaggccagcccacacccaggagactcagaatctaaaaaacaaagtacaaactttattttgtttctttacaaaggcacggtggcctcttggtttttttctccccactttcttaacaaaatataatagcttctccttgaacacgaagacctcaaaattgtaaaaaaaaaaaaaaaagaaagaaaaaaaagaaaaacaaaacaaaaacagaaagcaaaccaaaaagaaataaaaaaccaacaacaaacaaaacaaaaagagagagacagacatttttggggtggaagatgagacctggaggcagaggtgggggctggggggtgggagagtggcgaattctagtgccgagatggggaagggggaggggggcacagcagcagcaaaccccaaccaagaagcaacggagacctccgggcccccagaatgccccagcctagtcttacccccaaccatgtaagtgcttaaaggagaaagaagaaaacccaaaaagaggaaggaaaggggattgaaggctgacaatcccaggctggctctgggcagggaagaaataacctggggttttgtttaattttccctgttcttaaaaaacatatttaaaggaaaaaatgctttttggcagagagaggccaggcatctccgtgtcagcttcctccagcccccggggccgaggccccgccctggggtgccgatgctcccacacgctctgcgacaccccagccccgggacctcgggttgagtggcttcgttcaaaggtcgatttacagtattgaaaaagaggtcataaaagagacccaaatgacatcgtaattttgtaaaaatttctcactcattcgcccatgtctctccctgtggctgccccggctccctccagcccccagaagggagaggagggctgggggggtagtcagggaagctccccgtcccccgacggctcctcccggctctggtccatggcgtcactgtctgaggcctcggagtcggaggcggtgtcagaggtgggggcctccgggcagctgcggacaggcttcacgatgacagctcgccgctgctcctcctccagctcctgcttttcctgggtgccctcgatgtgctggattgcctggacagggacgaaccactgagaaggctcggccggggatacatggccagccaggagacagtgggggctctcagccagccactgtcacccccaaaacacatagcccagaaaaaagcctggcaaagcagcaggggaggcccgctagagtacaggaaaaacaaactccttttactttttttttggagacaagctctcgctatatcacccaggctagagtgcagtggcatgatcatagcttactgcagtcagactcctgggctccagcgatcctcctactgctccctccctagtagctggaaccacaggggtgcgccaccatccccagctaacttctgtatttttggtagagacgagggggttcttgctatgttgcccaagctgatctcgaactcctgacctcaggcaatcttcctgcctcaacctccaaaagtcccgggattacaggcataagccaccacgcctgacccaggaacaaactttcaaaacccctctgttaagttgaaaaatccattctgggaagatgacagtcccagtgctgcttagaaattatattatatgtatcagccaggcgcagtggctcacgcctgtaatcccaacactttgggaggccaagacgggaggatcacctgacgtcaggagttcgagaccagcccctcaacagaggccagaagcctactaaaaatacaaaatttgccaggcgtggtggcacatgcctataatcccagctacttgggaggctgaggcaggagaatcacttgaacctgggaggaggaggttgcgatgagctgagatagcaccattgcactccagcctgggcaataagagcgaaactctatctcaaaaaaaaagaaaaaaaaagaaataatatggacctttcatatgtttttgtttgtttgttttttgagaaagagtctcaccgtgtcacccaggctggagttcagtggtgcaatctcagctcactgcaacttccacctcccatgttcaagcgattctcctgcctcagcctcccgaatagctgggattacaggcgtgcaccaccacgtcaggctaatttttgtatttttaatagagatggggttttcaccatgttggccaggctggtctcgaactcctgacctcaagtgatccacccactttggcctcccaaagtgctgggattgcaggtgtgagccaccacacccggccatatgtttatgtattttaaagcttgcctattaacttattaaaggcgtttgttattaattgtattacacaatttgcaaagtttatgagcaattaaaattcgaggagattgatggattttttttcctgttttggcttttttggttatttatttattatttactgatttctgatcttgggctcctcaaggggccctgttcaagggtgaatgcaactgtaacttcaggcttgacccacaaagcttcctcctctgtaggaggcccaactatcaccagccctgccacctgtatctccatccaggtcctaggagatggagctgagacaatgttccggaccaacccaagagctggatgcaggaactctgtaaccagggggctctgggagcaaaggaccctctccggaaaccccatattgagggaagggacagtcttcctggccaactcctcctactggcgtggtaggccctgccccgatctctggccctcacattctccacttgcagatccagggacggggccccccaaggcttccagccctccaccccttcccacacaagcaccatcttcctccgcttctgcccctcttttccagtctcccctaaagagcctgttcccggagtatgacccccacaagctgcccctttctcaagctcaggtacctgcacgatggtgtccagattttgccgggatgtggaaacagagttgatgaccgaggaggggcccatggtgacgacattgatgtggtgggagggaggaggaggcggtgctggcacgatcaccgtggggtggtgggtgggggccggagggggcagaagctgcaagacagaggccctcagcctttctctcaaggcttctcttggcccatccacctccctttcatgcagagctggccaatgtataactgcctctgcccctttatattaagaagcagagaggacgtggcctagggagaggcttccgccattcaagatcacctgtccccttcccggtccccagagcccactcccgggcgcctcctgctcacctgggtccgcagctgctgctgttcccgctccagcttctcctggtgcagcagcctcacctgttcctgctgctgctgcagctgcacctgctgcgcaatcaccttgagcttttccgggtacatgtgggcctccagcgagcgcacctggaggcaggacaacctgggctcagggccaaggccgggagcacaccctgccctgtcagtctcacagcagctcattcactcctgctgaaaaccctagcacagggcgggcccctctcaacagaggccagaagcctttccagagcccttcagcccccggctcctctcgcctcccacctcggcctccactggaccatgctccctcctgcccgagtctttgcctatgctattccctctgccgggaacacctttctctgtcctttggttaactatgagactcaacttcccacttccatggagatgccgtggggcgtcccttgaaaaacccctcctgatgccacagctccagcctggccttcaatatggttttttgtttttgttttttggtttttttgagccatggtctccttctgtcactcaggctgcagtgtagtggcacaatcatggctcactgcagcctccacctcctgggctcaagcaatcctcccagctcagcctcctgagtaaccgggactacaggcacaccccaccacacctggctaatttttgtatcttttttggtagagacagagtctcactatgcttcccaggctgatctcaaactcctgggctcaagcgatcctcccacctcagccccgcaaagtgctgggattataggtgtgagccaccatacccagcccatcacggttacatttttttttttttgagatggagtctcgctctgtctcccagactggagtgcagtggcacgatctcggctcactgcaagctctgcctcccaggttcacgccattctcctgcctcagcctcccaaacagcggggactacaggcacccaccaccacgcccggctaattttttttttttttgtatttttagtagagacggggtttcaccgtgttagccaggatggtatcgatctgctgacctcaggtgatccacccgcctcggcctcccacagcatggttacatttttgagatcctttggctaatctcccccaccccaacgcagacggtggcccccaagggcagagacgtgtctggcttgctccccactcctaggcctggcaccgcagtaggtgctcctgtaaatagggctccaccgagggccgcagagcaagaggcgcgaccccaggctccacgccctctgcaccgcgcgccgtgcccagcagagggcgctgcctcacctgctcctccagcatcatgcgcaccgagcgctccttgtccagctgctgccgcagctcaatcatctcccgccgcaggtcctccgccttctcgtcctcccagatgtccggggagcctatgccttcgtccttgtcctctgcccgccgtcgcttgggggacgagccgctcagctcctggggaccccaaggagtcggtcagtgtgcctgacacctcggtaccaccacggagattggggttccatcgcagccccccaaagctgcccaacacaggtgaatcttcattagggagccccttctgcaagtccaacaaaccagccaaatgccaggagaatgggctgctttacataacagtcacctggctccttccagagcccactccaccgcacttgaccgatggggaaactgaggccggggcaggaaaaaaagtgcctggaagtacttgtcagtgggcaagaaggggcctgcagccacacctgagtcccaggcccatggctgggtccaaggcatgcccatgccagggagagggagccatgaaggacagggcgcacctggatgaagcgcttgagctgtgtgttctgctgcaagagcctggtcttctcctgctccagggagaagatgtactcggctgtctgctggagaatggctgcctgagggcgtggaaaagccgagagtcaggctggcagtgtttaccagagctcactttcctctcccagcgggaacctgccggctcctccaggaagccctccctgctctcacccaccttgctgagcttctctccgtctgtgtgggggatgagggtcttgagggactggaatcccgcgttgatgctctgcatgcgtctccgctcgttgctgttggcgatctcccgccgaatccgccgctcctggtcccgctgagtctcgggggttagtggaatgttggcaaggctgccagagaggacagggacaggctcggccaaggcgccctcttcatcattcatctccagagggccccagtggaaactgcatccctcccctgctgcaaaagatgccaggccacccccagagagtgatggaggggtgctctctgggacaccggggcggactgaatcagctggctgcgggtaagatagtccgctcagaacccaccccgggccaggcacagtaatcccagttctttgggaggtcaaggccaaggatcattgagcctaagagtttgagatcagcctaggcaacgtagtgagaccctgtctctacaaaaaaataaaattagccaggtgtggtggtgcatgcctgtagtcccagctactcaggaggctgaagtgggaggatcgcttgagcccaggagttggaggctgcagtgagctatgatcacgccactgcacttcagtctgggcaacagagcaagaccttgtctcaacaacaacaacaaaaacccatcccctccctggctttcctcacagggagcagtctctcctccggaacagaattcccagtgtgtctgagcatcaaaacatccaagagcttagaaactatgcagacgacgggtgctggccccagcgtctgactagcaggcccggtggggcccagaaacgtgcgtggtgtgattctgatgcacgcgggatgcagacgacattcagggacgctgtccccgctcctggaacacttctgagtgatttgctaggcacctggagcgcctcttcagcgtctcaggctttgccaccccaggactgaggaagacgtccccactcccttcctaccctcacggccacgcctcccaccacaagccccagccccgctaggctaagacttcacagaagacaagtaccactcactccccaaaaagacaccaagccaacaacccctggggacacggctccccacagcccacccactccaagagatagacccaccctgcgccggagaagcgaggctcccaccatgctgtggggagcgctgctgacccttgcaggagcagtggccagtgcggtgagaaggcagcctgggggaagagggcgtggctgctggctgggggcgtggcttcggacgagggcggggcgtgtgcgccagggggcggggctgcgggccagggtgcagaggcagcggttgtgggcccaaggccacgctcccgagggttgggcttgtgtgtggcctggaggaggcatgtccccctccctggacctcccctgcaactccccccgcccctggcctgatggcttccagatgctgggctctcagcagaggctgccggccccacccgaagccgcagccccggcctcttcctgaggggccctcccggggtgccctgttccaggactgggccaagggggctcatgcccctgaatgtgggagaacaggaaaagggttctgggcagctcctgctccattgatgaaggcagtctggggtcaaggggctgccaagtctaactcccctgctgtgtgccctggccccttcgccagcctgcaggcggaaaggagtttgcacggaccccggaggcagcacatctgcaacagctggaaacagccgtggccttcctggccccacccagcctgcccatctgtccagccttggctccctgtgggaccctggacgcatcgctgccccttccccggcctcggcttcctctcccaatagagaggtgtccaacgccggaagtctggatgcaaatcagcctccttccgtcctcatcaagccaagccccctcctccatcaggacccaaaggcccagggcctgcacccagggtacaagtctcttacagggtcttgaaatgtccgcactgcaaaaggggcccgggccccccactttccatgagactttagggtgcagggcagagaggggatggttttagggtcggtcagctggatgtcagtgctctcacttctcccggttcccctgccctgaagtggaggtgatagggggactggagcaggcctgctgcacggctgtgtgtggcccagccttagggcggagtccaggctcccaggcctggcacaaactcagaccataccatgtctgagaggccagcaggccaaggggaccaggactgctctgcagtgggtggcttaaagctggggctctttggaggtaagaggtgggaagagatgtccataggaagccacaacacaaggtaagtgcaatcttgaggcatcaccatccccctcaggagagatgtggggagagacccctgcccacccagcccctgggtccctcctggcaatgcccaaaagccagagctgactagggggtgaaaagggagcaccaagtccagccttgggccacctgagagctggccctcctggagggtccacaacagagggatacatttttttttttaagtttttggcgagaattttctcactgaattgtcacaatgttcctgagtcaggtggcctgaagactcccatgtaaagaggggggcacagaggtttgggtagggtccagctgcagcaagcgctgggcgtgaaccctgaccccagagcaggtgtcaggccatagggcagaatgagctctgaccggcccacagagccagatgccccaactggcaggtgacagttatccctgtaaaagagaagactaggccgggcacagtggctcacacctataatcctagcactttgggaggccaaagtaggaggatcgcttgagccccagagttcaagaccagcctgggcaacatagtgagaccccatcactagaaaaaattaatcagccaggcatggtggagtgtccctattgttccagcaactgaggaggctaaggtgggaggatgtaataagcccaggaggttgaggctgcagtgagctgtgatcatgtcactgtactccagcctgggcaacagagtgagaccttgtctcaaaaaaaaaaaaaaaaaaaaaaaaaaaggaccaggcattcggaaatcgctgtaatcgtgtaactctttttattattcacagacctcgttgacatttttccctgcctgattctcacaaaacccagtggggtggccgagattacagtgagcaagcaatgcagggtcgtgggaaggaaggtgatgatcccaaggtcaagtagccagacctggcacaacagcaacctgcagatgccaacccactgaagcgcctctactgactgctagttcacacagcccgccacttatcagaagcgggtgtgtgactgcaagctcagccatcacccctgcccctctgaacacaagcccacaagtgaggtgacttgcccaaggtcacacccagcagctgggcagggcagggtgcagccagatgcacccttctgcacctcccggcccaagtcccaccaactcctctgctcttgggagctgaccctcagcctcttccgtcccttccccgcaaggcagcccactaactgggagaccaaaggagaccaccagaccccagtcccgaaaaccccagccggaagttctcacaaggaagaggagctggggctgggatcaggggcctgtgtcgcctcctcctctgcatcagaatctgccggcccagcttctccaatgctccatcctgcctccttcctctccaaagccatcagcccagtctcctggctcagaaaccagctgctggctaacctagtgcttaacttaggttaagcactttcttaaatccaagaaagcaaatttccccccaaaaggtacagttcctcgtgggacctgaatctgccaccaagaccctcaaatataactcacctaaattgccctggaagtacccgccgacagagtcctttaatagaatgcattctaaccaaggcttctgattggtggaataggagctaaccaggggttgtgattggtggagtgccgctaaccaggaattcttattggtggaatgctgaccaaccagggcttctgatggctgaccaaccaggggttcctgttgatgaaggatggttgattgaaatttccaggtgatactgcactgaataaagtggatttttctgcaaatgcctgaaagtttctgatagctctttctggggttttgcatttacggttaaggtctgtaaacgtcctacacacacagtaaaggtccactatcctctctctggccacttcagactcctccaggtgaaaatcaaaggtgacccaagtccaccaacaccgaggttctcttttttcttttgactgagtctcgctctattgcccaggctggagtgcagtggcacaatcttggctcactgcaatctctacctcccgggttcaagcgattttcatgcctcagcctcccaaataactgggattacaggcgtgatccaccaagcctggctaattatggggggcggagggggggttgagatggagtctcgctctgttgcccaggctagagtgcagtagcacaatctcagctcactgcaatttctacctcccgagttcaagcaattctcatgcctcagcctcccgagtagctgggattacagggacccaccaccacgcccggctaatttttgtatttttagtagagatggggtttcaccatgttggtcaggctggtctcgaactgttgacctcaaatgatccatccgcctcggcctcccaaagtgctgggattataggcatgagccaccatgcccagccacaccaaggctctcttgcttcttgcaagccagcctcctgggtccaaacaggggctgccctagatttaggaataaggtcactgagcagccaatggccaaggaacaaaatttgggcaccagccttggatgctaaggcaagagccgccacacctaccaccacagcacccacagaatctgctgagactgacgctggcgtcccaaccagacacttggaggcatggggcatgcccttcaagtctagaaccctgccaggtacctatccctcctgcccaggccaaagtcaagtacccccaatccctctacacctgcctgcccagctccagcctcaaaccggccactgagaactttcatttcacactgccctgaagtcactcacatacctcagggtcacttaacatctacacagtcaacgtgggaaagtccacacgggattctcccaaacccaaaaaagcactaaggcactcatccttctctaacctaatcagcccgaggttctcatccatgctccatccccgctgcttctacactactcacccatactctgtactctgacctggccagtctgctgcccttcccctcggtcccagaacacaccatgcccaggctgttgccatcagaaacatccctgcctccctcccttccccaaagctcctccagcccatcagtgggaaccctgcactgggctcaagtgaaaaagtccagccttgccacttactagctgtgcaacaccaagcctcggtttcctccgtctgtaaaatatggaaacactgcttcacttcacagggtcatggtgaagtttaaaagagatcaagaaaggccaggcacggtggctcatgcctgtaatcccagcactttgggaggctaaggtgggcagatcacctgaggtcagaagtttcagaccagccaggccaagatggtgaaaccccctctctactaaaaatacaaaaattagccgggtgtcgtgggacgtgcctgtaatcccagctactcgggaggtcgaggcccaagagttagtttgcacccaggtgtccaggacaacccatgaaactcttagggggtctacaagaccttttaagaccacaaggctgtgagctgctgaggacaggagtcacatcctgttcatggctgtatcctcagtcccggcagaatgttgttgcttcataaataaatcagggacccaataaacactccaaagccttcaattttcttgaactccttcttatgggagctttttaagttttattatttttttaatttatttttatttatttatttagaggcagggtctcactcccgtcacccaagctggagtgcaatggcatgatctcggcttactgtagcctcaacttcttgggcccaggtcgtcctccttcctcagcctcccaagcaactgggagtataagtgcacaccattcacacccggctagttttttgtatttttagtagaaacagggtttcgtcatgttgctgaggctggtctcgaactcctgggctcaagtgatcctcccgccttggtctcccaaagtgctagggttacaagagtgagccactgcacccagtcttactgttttttttaagagacagggtctctgttacccaggctagagtgcagtgctatgatcatagctcactgcaatctccaattcccaggctcaagccatcctcctgcctcagcctcccaaggagctgagactacaggcacatgccaccatgccgggctaatttttttattttttgtagaggtggggtcttgctatgttgcccaggctggtctcgaactcctgggctcaaatgattttttccccttggccttccaaagcactgggattacaggcttgagccaccgagccaggcctaggagctttatgatacagacagaggccaggcgcggtggctcacgcctgtaatcccaacactttgggaggccgaggtgggcagatcacgaggtcaggagatcgagaccatcctggctaacacagtgaaagcctgtctctaattaaaatacaaaaaattagccgggcgtggtggtgggcgcctgtagtcccagctactcgggaggctgaggcaggagaatggcgtgaacccgggaggccgagcttgcagtgagccgagattgcaccactgcactccagcctgggcgacagagcgagactctgcctcaaaaaaaaaaaaaaaaaaaaaaagatacagatggagagtccgggcacggtggctcacgtctgaaatcacagcactttgggaggacgaggcgggcagatcataagatcaggagatcgagaccatcctggccaaaatggtgaaaccccgtctgtactaaaaatacaaaaattagccggccatggtggagcgggcctgtagtcccagttacttaggaggctgaggcaggaaaattgcttgaaccccggaggcagaagttgcagtgagccgagattgcgccactgcactccagcctgtgcgacagagtgagagtccatctcaaaacaaacaaacaaacaaacaaacaaaacacaagatatggatggagactaccatatacctgcccatatacctgcttttaagactcagtggctgggcgcagttgctcatgcctgtaatcctagtactttgggaggccaaggtgggcagatcacctgaggtcaggggttcgagaccagcctggccaaccactatggtgaaaccccatctctactaaaaataaaaaaattagccaggcatgctgacacatgcctgtaatcccagctacttgggaggctgaggcaggaaagtcggttgaatctaggaggcggaggttgcagtgagccaagattgcactccattctgggtgacagagtgagactccgtctcaaaaaaaaaaagactgagtgtcatttttacagctaccaggcacttgccatacccatagctaattttctcacaggtgctctgtttcccagagactgagaaccattaggcgacaggtccaaaacctgcagcttgtgtgtgcagcaccgtgccctacaatcccctctggcaggcctgggagacagaaagacagggagatccctgctggtcactgagggatggagcaaagcccaccagcctgagatgaccctgagaagcaaatgcatctggccagaaggtcctgcctaatgaacacatttgatcccagactggcttcccacctcaccctgcaacccctactgaaggtaaacaaatccagggacccccaactccatgcctaatgcacagctgacaactgtcttgcaatggacgttgccatgtccaaccctggacgaaggccctacaccttcaagtccttggcctaccaagatccagctaccctgggggactgctggtatgctccaaaggaacgcttggggcagggataaattgaagccagaatctcagggggccctgagaggactcacccaaggcccaggcatggcagccagagggccccccaaccctgcccaggatcaggcccagaatgtcttctccagtaggcacagcggctcaactgcacctccgcgctgcccagcccagccctgcagcagcagcaaccccaggacaagggttcaagttccagttccaccacctgctgtagtggtcccttctccagtctctgtgtccgcctctttaagcggaatcaaaagacacttttgactcatagaaagattatgacaactcagtgagaaaattctagcaaagtgagtccccagaacataaaaagagctcaagaattttttttacttattattactgggccctccaggtgggcctcgtgcaagggccagccctcggggcatccctgccagctgccaaacccatcaactggcccaagtctaggtattgactgggaacttcagagtagccttaaggtggggacccccggggcagagggttgggcaggagtgtctacacgtgtgcagcaaccttccctccaggccggattctgcaggcgctagcgtccaccagcctgtgccacaccggcgggctcctcctccctcaatccccgcccagactgcctcgggcggcagagcacgtggctccagccctggggagccatttcgctcctggagcagcgcggcaggaaaggggccacaggtcccaaacttgcgcacgccgtagaacgcccacctcccccacaccacgcccagggggtcgttcaaaatgcagatgtccgggccccagcgatcagagttccaggcatgtgcattttaagaagtgtgcggggtggtttggctgtgtgtggtccttgagtccatcaccctttgggtttagagcaacctaggaccaaagcttgcaaagtggcttctggggaggcctgcggacctcgggccacccacccggctgggggacccgacgctttcggtttacggcaggggggaggggcgttggatgggaaagtttgcagaggaaacccacgtgcggcgggaagctgccctgcgaggctaggggcggcctcaggtgtcccttccccaaatggcctgcccacctggcctgccttgcccatcgtgcccgcgggggccgagctttgtgcagggaaagcgtggcccaggagcgcctacaaatcccacaatgctgcaccagcaggacacggagaactacagctcccgcgaggccgcgcgcagaggtccgcctactccaagagggctgcagagtcacgtccaggcctcgctagtaaacagcgcccgggcgcgggcgggcgagcgagcggcagccaacgtgccccgggccgcggcgcccctaccggccgcgcgggcccctcggggtccgcccacccccaacacccacacgcgagcacgcccccgaccccgctgcagccccgctctgcaaacacgcacagtgcccggctccccgcccccaccccgcgccgggagccgcggcatggctgcattgtagccgccctagctacacccccacgcgcgccccgggcccccagacccccttggatggggacgacctcagatcccgaggaaggaaggagaggaaggaagccgccgcaggagggggaaagaggaagcgcgggggggaaggccaccagcaccaagcatggccgggactgctgcagaaccacgtgggtctgtttgcaatttacaaacgtcgcgactcgcccgcctgcagcggacaaaagtggccggggccgcttggggcccccatgctccaaggaaggagggtcccggggcggcgcggacccggcgtgtggggctgcagccgtcccggcagctaagaaaggctagcggggtcggcggcgcgggccatgcgtgcgcacacgcgcgcccgcccgggcgggctggccgggggctgcagtggtaggaagggggtggggggaggaggagtacacacctacagagccctcctatcacttctttctctgttttcctgaaatgttgcaaagagggcaccttctgagtgggcaccatgaaatactccatagcgatcggcccccctcctctgcacgagccaggtcccgcgatcagccggagaatgcaagatggaaatccgaatcaaagggcagcgccggacggaggtgcagaatcggccggtcccagatgctggcggcggcggcggcggcgaggggagggaggcgggcgggaggggcgggagggaggtctctccggcctgcctccccgggcgtgtgtatgtgtgtgtgtgtgtgtgtgtgtgtgtgtgtgtgtgtgtgtgtgtgtgtttgcagctgatcagatgtctgtttcaaggcgggaaacagctggtgaaaactcagcactcccccggcctccttccgcggagtaaggaattgcatgtaaacaaaggactatttgcagcgccccccgggcggcgcgaggccggggcgagaggggcgcgggcccccggggaccggctgcaaccggggtctgcaggcctctcgcggggcgcagggggccgggggccgcgggcgggcttgcggggcgcggcgtgaatggagcgagctgcggccgagctacatgcgccactatgggtgatgaggtccatcagctgacaggttggcaagcgttgcaaaaaaaaaaaaaaaaaggccagccaccgcgcagggagcccagcccgtgcagcccggagtccagcagcgactggcccagagcagggtccgcgcgctcggccggcccgcagggaggagggggcgcggctgggtcgggcgtgcagcggcagcaaggaaggcggcctggggttcgcgcttggggcttctgctttttcaccattgcagctgcacggagcggagcctctccggtgtgctcccttcgagccgagcccagggccccctggaaacttgcgtcacagccaccgcttcccacatgtaactcggggctgacttcggaggccggccagcttcctccctcccgccttgcttagctggccgcacggccgggactccggatcctgggaatcttggacccggcgacgggacggcaaagggcgcctcggatgctggggccgccctaggaagccgggggccccggcagggaggggagggtggaggcgggcctgaacggcagcggcccccgggcgcaggctgccagcgctgcggggaggtctgctggttgctgccgggtcccctgctattcccccagacccgcactgttccctccgcgggctgaaggctgcagcttcccattcataacaaagcccgtgtgggacttgcccctccgccaggatgcgctccccaagagggggtgacgacttggggcagggacggggaccctggcggcgagcttccgtcctccgctcgcacgccgcaccttccggccccaggccctcccctggctcctggagggttggctcctggctcaggaagcccacgcctgccttggaatgtcctggatcctgcccaccgccttccaggttccgcctaaatcgcgcctcctaatttgacttattcctactagtaacaatagttactgttattattgggaaatattgttattagatgttgccagcacccggtggatgccgagcagttttgcttacacgctctccaatccttgaagcaacctgttaggcagtttctctaaggagagatcccagaccacttgaccaaaaaaaagtctctggaaggcttactatgtttctacttaaaaaaaaaaaaaaaaaaaaaaaactttcggctgggcgcgttggctcacgcctgtaatctcagcactttgggaggctgaggcgggtggatcacctgaggtcgggagttcgagaccagcctgaccaacatggagaaaccccgtctctactaaaaatgcaaaattagccgggggcctggtggcacatgcctgtaatctcagctactcgggaggctgaagcaggagaatcgcttgaacccgggaggtggaggttgcagtgagccaagatcatgtcattgcactccagcctgggcaacaagagtgaaactccgtctcaaaaaaaaaaaaaaaaaaaaacctttttactgtttttcaacaaatagagataggagtctcactgtgttgcccagcctggtcttgaactcctgggactcaaggaatcctacctctacctcccaaattgctgggattacaagcatgagccatggatggccctggtgggaagcctatttttaactgcccttagtgagcaagctattcttttttttgttttgttttgttttgttttttaagacggagtcttgctttgtcacccaggctagagtgcagtggcacgatctcggctcactgcaacctccgcctcctgggttcaagtgattcttctgcctcagcctcccaagtagctgtggttacaggcacacaccaccaagcccggctaatttttgtatttttagtacagatgggattttgccctgttggccaggctggtctcaaactcctgacctcaggcgatctgcccaccccggtcccccaaagtgccaggattacaggcatcagccacctcacccagcagtgagcaagctattctggtgcattactgtctccttatcctctcattttgcacatgggaagacagaagctcacagctgcagacaagaatgcactcaggagtgctggctgcaaaaagccctggttctttatatcacactcatcctcccacctgccacacctcacctctgatcagggccttattttgtacttgcttttgttattttccagagcaaagcattctgtcatacttagttatatgtggccttcagagtgttctctggctgtctccctggttcaatttttttttttttttttgagacggagtctcacactgtcgcccaggctggagtgcagtggcgcgatctcggctcactggaacctctacctcccaggtttaagcgattctcctgttctcctgcctcagcctcccaagtagctgagattacaggcgcctgccaccaggcctggctaatttttgtgtatttttagtagagacgaggtttcactatgttggccaggctggtctcgaactcctgacctcgtaatccacctgcctccgcctcccaaagtgctgggattacaggcatgagctactgcacctggcctccttggtccaattttgtctcccagagacgagggactgtgcttttactcttttctctcttcacgggggatggtacagggctgggcacatgtgtgaactgcagagagtgatctgcaaagctgatatccctggagacagccttggcagaaaggatgagagggagaccctaggcacaagtgggtggcccaggcagacccgggagctggctgcccacactgaactgggtagtaggcactcatcccctctcctaataaatcaaggaagcccccgcaaagcagcggcatttggagtccggccaggggatggcagagacctgctttttcatttgtcttggaagtcatttctaggcccacacagaatctggttcctggggcaagagttgacatcgcaaaatgtaagagagtgacaaaaatttcaacacccaagataaattatgttgggttttctttgttgttattgttgtttttttttgagacagagtctcgctctgtcacccacgctggagtccaatggcgcaatctcggctcacggcaacctccgcctcccgggttcaagtgattctcgtccctcagcctcctgagttgctgggactacaggagtgcgccaccatgcccaggtattttttgcaatttttgtagagataggatctcaccatgttgcccaggctggtcttgaactcctgacctcaagtgatccaccagccttggtctcccaaagtgctgggattacaggcatgagccaccgcgcccagcctcaaattacgtcttaatttaacattttaaaacatcaaaattggctgggcacagtggctcatgcctgtaatcccagcacttcgggaggcccaagtgagtggattgctttagctcaggagttcaagaccagcctgggcaacgtggtgagacaccatctctataaaaaatataaaagaattaacttgtcgtggtgatgtagtcccagctgttcgggagggtgaggtgggaggattgcttgagcccagggaggttgaggctgcagtgagctgtgatcgtgccgctgcactccagcctgggtgacacagcaagaccctgtctcaataaaataatacataaataaaataataaaataaaataaaataaattactgccaaaaatccatactaaacacactctccacattttaatgactatctcagtattactgatttttccctttccctcaggcttcagtatagctctccaagacactgttgctgatccttagctttaaattcaaataatggccaggcacagtgtctcacacttgtaatctcagcactttggaagaccgaggcaggaggatcccttgaggccaggagttggagaccagcctggacaacataaccagatgctgtctttacaaaaaaataaaaaaaaattagactggcacggtggtgcatgcctaaagtcccagctacttgggaggctgaggcaggagggttgattgagcccaggagttcaagactacagtgagctatgatcacgccatggcccttcagactgggcaacagtgtaagaccctgtcttaataatacattttaactgggagtccaaagtaggtagatcacaaggtcaggagattgagaccaccctggctaacatgatgaaaccccatctctactaaaaatacaaaaaaaattagccaggcatggtggtgggcacctgtagtcacagctacttgggaggctaaggcaggggaatcgcttgaacccgggaggtggaggttgcagtgagccgagatcgcaccactgcactccagccttggtgacagagcgagactccatccataaaataataataataataataataataataaaattttaaaaattcaaagactgggccaggcgtggtggttcatgcctgtaatcccagcactttgggaggcagaggcagacagatcacttgagatcagaagttcgagaccagcctggccaacatggtgaaactgtctctactgaaaacacaaaaattagccgggcatggtggcaagtgcctgtagtcccagctactcaggaggctgaggcaggagactcacttgaacccgggaggcagaggttgcagtagtggagatcgcaccactgtgctccagcctgggcgacaaattgagactgtctcaaaaattaaaaaaataaacattcaaaagctggttcaacattgatttctaatactgatttattataaatcaataaatgtgtttttaatttgtaattcagatattttggtcattgtaaatttttggcattaatttcaattttttcttgagacagggtctcactctgttgcccaggcaggaggagtacagtggtgatacaatagctctttgcaggccttgaactcctaggcccatgtgatcctcccaactcagcctctcaagtacctgggactacaggcatgccaccaccatgcctggcaatttttaaaattttttgtagagacagggtctcactatgttgtccaggctggtcttaaactcttggactcaagccatcctcctgcttcggcctcccaaagtgccgggattataggtgtgagccactgttcctggccagttttgatttctctaaagtattgcattaaagttttgtgaaacttgattactgaggggtttggtgctcccattaacttttgttccccaagcaagggcctcccttgtattaccctagccccaccctgctgcttgtgattcccgcagctactgaggtctcactctagcccaggcagaaggcagcagaatcagggctgcccgtcagccttccgggacccactctgtgtccccaaggaacatgggcatcatttgcacagccctggagagggactgtccaatcagtcctggctacttctttctgtgttcacatatcctacttggccacacggaaatcaaaccagaaatgctgccctcgagaagctgccgaccacactgcagtgacaggagctgtgctcaggaaatgatgacatttggagacaatcaatatatgccatagggccacaaaaccaaatgcactgaatgacctctccggtgcctgaaaaaatgagtgaatgaatgaatggcaactggagcaagcgtgtctacctcctgctcctcccttacagaattgccttgactaggccgggcgtggtggctcacgcctgtgatcccagcactttggaaggctgaggtgagtggatcacctgaggtcaggagttcaagaccaccatggccaacatgacgaaaccctatctctactaaaataaaaaaatagccgggcgtggtggcgggtgcctataatcccagctacgcaggaggctgaggcaggagaatctcttgaacccaggaggcggaggttgcagtaagccaagatcgcgccactgccctccagcctgggcgacagagtaagactctgtctcaaaaaataaataaatacaataaaaaataaaaataatcaatcaggccaggtgccgtggctcatgcctgtaatcccagcactttggaaggccgaggtgggcggatcatttgaggtcagcagttcaagaccagcctgaccaacatagtgaaacccaatctctactaaaaggacaaaaaaaaaaaaatctaggcatggtggcacatgcctgtagtcccagctacttaggaggctgaggcaggagaatcgcttgaacccgggaggtggagattgtagtgagccgagattgtgccactgcactccagcctgggagagccagactccgcctcaaaaaaaaaaaaaaaaaaatcaggccggtagcagtggcgcatgcctgtaatctcagcactttgggaggccaaggcagatggatcacttgaagtcaggagtttgagaccagcctggccaacatggggaaaccctacctctactagaaatacaaaaattagccaggcatgatggcaggcacctgtaatcccagctactcgggagagtgaggtatgagaatcccttgaacctgggaggcagaggctgctgtgagccgagattgcgccactgcactccagcctgggtgacgaagcatctcaaaaacaaacaaacaggccgggtgccgtggctcatgcctgtaatcccagcactttgggaggctgaggcaggtggatcatgagttcaggagattgaaaccatcctggccaacatggtgaaaccccatctctactaaaatacaaaaaattagctgggcatggtgctgtgtgcctgtagtcccagctacccaggaagccgaggcaggagaatcgcttgaacctgggaagcagaggttgcagtgagccgagatcatgccactgcactccagcctagcgacagagcaagactccgtctcaaaaaacaaacaacaacaacaaaatgaataaatatattaggagtcagcaaggttttttccctaaagtaccagatagtaaatattttaggctttgcagaccacacggcctcctgcaagcactctattgtccctccggctggaaagcagtcctagatggtatatgaatgaatgggcatctctgggtgccaataacactttgcttatggacacaaatggaatgtcgtataatttcatgtgccacaaaatatcatttgatcgctttccaaccatttgaaaatgtaaaagttctatggcctccgtaacaagttactacaagcttagtggcataaaacaacataaatttgaccaggaatcatggctcatgcctgtaatctcagcactttgggaggctgatgcaggaggatcacttgaggccagcagttggagaccagcctgggcaacaacatagggaaattccatctccacaaatatatgtctgtgtgtgtgtgtgtgtgtgtgtgtgtgtgtgtgtgtgtgtgtgtataattttaaaaaacaacacaaatttattctctgaaggtcagaagtccagatgggttatgtttggctaaattcagggtgtaagcagggttgtatttctcctaaagttctagggaagaatccgtttccttcccttttccaacttgtagatgccactcacattccttggcttgtggccccttcctccatcttcaaagtgcacttctcagtctctgcttctgccatcccatctctctcaccctttcatctccctctcttgatgaccttgggcccacccagataatgcagaataatctccccatctcaaaatccttaacgtaatcacaactgcagagtcccttttgccacataaggtaactattgataggttctggggatggggcatgatcttcattgggggggccattattctgtctaccacaccattcttggtttgtgagccatgcaacaggcagtagttatcataggccccagcaattccactcctaggtaaacatccaagagaatgaaaacagggactcaaacagatcatggtacacccatgtccacagcagcattattcatacgagccaaaacatggaagcaacctagtatctatcaactgatgaatggataaactaaatgtggtctgtccatacagtggaatattattcagccataagacagaatgaagcactgacacctactacagcattacatttattgcataccttatttctattattacactataatatataataaaataactatgcaactcaccataatgtagactcaatgggagccctgagtttgttttcctgcaactagacagtcccatctgggggtgatgggagatagtgacagatcatcaggcattagattctcataagaagcactcaatctagatcccgcacacccacagttcattcacaataaggttgcactcctatgagaatctaatgccaccgctgatctggcaggaggcggaactcaggcagtaccgctagccatgtggagtggctgtagatacagatgaagcttggctggctggctcacttgttcacccaccaagagttcaacaccagctgggagaggtggctcatgcctgtaatcccagcactttgggaggccaaggcaggcagatcacctgaggttaggagttcaagatcagcctggccaatatggtgaaaccctatctctacaaaactacaaaaattagccaggtgtggtggcctgtgcctgtaatcccagctattcaggaggctgaggagggagaatcatttgaacctgggaggcagaggttgcagtgagcagagatcacaccattgcactccagcctgggcaagagagcgagactacttaaaaaaaaaaaaaaaaagagttcaagactgtcccgggcaacatggtgagaccccgtctctacaaaaacaaataaacaaacaaataaataactggttaaacagtaagtctttgttatgtatattttaccacaatagaaaaaggtttgttataaaagcagtgggctgggccaggctcagtggctcatgcctgtaatcccagcactttgggaggcttgaggaggtcagatcacctgaggtcagaagttcgagaccagcctggccaaatggtgaaaccctgtctgtattcaaaatacaaaaactagctggttgtggtggtgggcgcctgtaatcccaactactgagggggctgaggcaggagaatggcttcaacctgggaggcagaagttgtggtgagctgagatcacaccattgcactccagcctgggtgacaagagcaaaactccctctcaaaacaaacaaacaaaaaatgcagtgggccatagtcggctgaccccattgatcctgctaactcctgcagctgtgacccagttcatctcacactgcctgctcttcccctctccctacctgaaagaaacagccaaatatggctagaaagaggaaatcccacaaccttgctgattggtttgtttttattttttccctccagtcagcaacagttgtattagggatgttgtcaaagtcaaagtcacccgctaggtgacgggtttttggatttttgttttttttttttttgagacagggtctcactctcactcaggctggaatgcagtggtgcacggcttattgtagcctcctgggctcaagcaatcctcacgcctcagcctcccaaagcactgggattacaggcgtgagccactgcaccagaccctcttttttttttttttttttttttttgagacggagtctctctctttcgcccaggccagacggcagtggcgctctctctgctcactgcaagctccgcctcccgggttcacgccattctcctgcctcagcctccagagtagctggggactacaggtgccagccaccgtgcccggctaattttttgtatttttagtatagacagggtttcaccatgttagccaggatggtctcaatctcctgaccttgtgatccacccatctcagcctcccaaagtgctgggattacaggcatgagccaccgtgcccggcctccaccaggtcctttttttgagacagagctctgctcttattgcccaggctggagtgcaacggcacaatctcagctcaccgcaacctctgcctcctgggttcaagtgattctcctacctcagcctcccaagtagctgggattacaggtgcccaccaccatgcccagctaattttgtatttttagtagagatggggtatcttcatgttggtcagcctggcctcgaactccagacctcaggtgatccgcccgccttggcctcccaaagtgctgggattacacgcatgagccatcgcgcccagcctgccactgctcttatttttaagtgcctgatccataccctcaagtgggtctgggggttgctgtgactgcatcctgttgccctggccccttcttcctacccttccttctcctctcccctcaagccctctagcacctcctccttgcttgtagctcacttcccgttcctctgagggaaatggaagcaattagaagagaccttccacaggctgccatgcccgccactgcctccctctctgtgcctgggaactgccatcggccagtgtctctggatgagcatccatgctgttcatgcacagaagacccttctacttgcacaactcagagccgtcactccagaaactgtcctctctcctttgtcttcagtgcacaccgtcttttggatcatacccattactaacaagctgttactattctcctttcaaaccaacggactgaccctagatccccttagctctgctctcttttcttggttttgagacagtctcactctgtcacccaagctggagtgcagtggcatgatctccactcacttcaacctccacctcccaggttcaagccattctcttgcctcagcctcctttgtagctgggactacaggtatgtgccaccacgcccagcccagctctggaatctaacagcaaaactccttgaaatggatgttcacactcactctctccccttccctcctgctcactccatcacacccccatgactgcatgggggcagtgactcacttctgtaatcctagcactttgggaggtcaaagcaggaggcaggaggatggcttgagcccaggagttccagaccagccgggcaacatagcaagacttcatctttataaataattaaaatattagccaggtgtggtgatgcacatctttggtcccagctactactctggaggctgaggagggaggatcacttgattctaagaggttgaggctgctttgagccaagagtgcaccactgcactccagcctagaccgcagagtgagaccctgtctccaaaataaaacacatatggctgggcgcggtggctcatgcctgtagtcccagcactttgggaggccaaggcaggtggatcacgaggtcaggagttcaaaaccagcctggccaagatggtgaaacccccatctctgctaaaactacaaaaattagccaggcgcaagggcaggcacctgtaatcccagctactcaggaggctgaggcaggagaatcgcttgaacctgggcaacagatcgcacctgagccgagatcgcaccactgcactccagcctgggcaactgtgagactgtctcaaaaataaataaataaataataaaacacacacacacacacacacacacacacacacacacacacacacaaacccttctcttttcaaagtcacgaggacctccaggatgctacatctgggtctctgttttctgccttcactgcatctgaccttcttgaaattctttttttgctttgcgtctaggacatgcccacggcacagccctcagacctgtctctgtctacacacactccctgctcttcagacaacagacttccagaaaccactagcagccacgaagtgtggtacagaatccaggtcctgcctgaaccccaaccctactaacctgactctgctctctcatctgcaaaatgaaagccacacagcatctccctggcagggctgttgtgaaaagctggtgacagcctggcatgtcacggcatcaatgagtgttggttgctgtcatccctggcaccaagttgccatgggcggcagtggccagaggcgtctgagctgaccttggagaacgacaagatttcctgatatgtagggaaggtcggaggtggggctcagcctttccccttcccagctctacgtggcagcaggtgggaggcagcaggcatgcgctgggctttgctgttcacacagggtgcacctgcttcccactcgaaacaccctcatgtggtggggcagtgaaaattggcaaacaaaccacttgccctgtaaaaggtgggtctcttggccggtcacagtggcttatgtctgaagtcctggctactcaggaggctgaggcgggaggattgcttgagcctaggagttaaggctgcagtgagtcgtgatcatgccactgcacttcaacctgagcaacagagcaagaccatgtctcaaataaataaataaataaataaatacaaataaaaggtgggtctctgtaaaaaaagaaagtaatcagcagagtgtggtggcacacatctgtaatttcagctactccagaggctgagacagaaaaatcccccaagtccaggattgcaaaggcagcctgggcaacagagtgaaatacttcaaaacaaaataaaataaaataattaaaaaaaaaaaaagggaaggccaggggcagtggctcacgcttgtaatcccagcactgtgggaggctgaggcaggtggatcacctgaggtcaggagttcgagaccggcctggccaactggtgaaacttcatctttactaaaaatacaaaaattagtcgggcatggtggcgcacgcctgtagtcccagctacttgggaggctgaggcaggagaatcgtttgaacccgggaggtggaggttgcagtgagccgagattgtgccactgcattccagcctgagtgacaaagcgagactccatctcaaaaaaaaaaaaaagcaactttattgactgaccctaaagatggccacaagtccaggaagccccagaaagcaagcatgggggattccttagagcagaggattcaggactccttcccttggctctttcctcactggctcggaggtgtcagctgctctgaccatgccatcagcacagcagttttcaggacaaaggctacccccaaccccttcccaggctggttgggagctgctggttggagatgggaaatcataagaactgcagccaggaggaagagctgtcggcaaaggtggctgctgcagaggtgaggataggttgttctcatttttacacttaggtttttgggtcttttttttcggggggtggggtttgatcgcagtggtgcaatcatggctcactgcagtgtcaacttcctgggctcaggccgggcacagtggttcacacctgtaatctcaacactttggtaggtaggggcgggcggatcacttgaggtcaagagttcgagatcagcctgggcaacatgatgaaaccccatctctactaaaaaattacaaaaattcgccaggggaggtagcacacggctgtagtctcagctactcaggaggctgaggtagaagaatcacttgaatccaggaggcggaggttgcagtgagccgagatcctgccactacattccagaacgagactccttctaaaaacaaaacaaaacaaacaaaacttcctgggctcaagcgatcctcccgcctcagcctctgccaccacacctggcttttttgtatttttagtagacacggtgtttctagaattttcttttcttttttttttttgagacagagtctcgctctgtcgcccaggctggagtgcagtggtgtgatctcagctcactgcaagctctgcctcccgggctcacgccattctcctgcctcagcctcgcgagtatctgggactacaggcgcctgcccccatgcccgactaattttttgtattttttagtagagatggggtttcaccatgttagccagaatggtctcaatctcctgacctcttgatctccccgcctcggcctcccaaagtgctgggattacaggtgtgagccaccgcgcctggctagagacagcgtttcactgtgttagccaggaatggtctcaatctcctgacctcgtgatccacctgcctcagcctcccaaagtgatgggattacagtcgtgagctactgcgcccggcctaatattattcagcatttttttttttttttgagacagaactttgctcttgtcgcccagtctggaatgcaatggtgcaatctcggctcactgcaatctccacctccctggttcaagtgattctcctgcctcagcctcctgaaaagctgggattacacgcatgcaccaccacggccggctagttttttgtacattttagtagacacgggtttcaccatgttggccaggctggtcttgaactcctgacctcaggtgatccgcgcacctcagcctcccaaagtgctgagatgacaggcatgagccacagagcccagcctacacccggctaattttgtatttttagtagagacagggtttctccatattagtcaggctggtcttgaactcccaacctcaggtgatccacctgcctcggcctcccaaagtgctaggattacaggcgtgagccaccgcacccggcctatatgtgttaattttcttaatttttttgtagagatagggtcttcctatgttgcccaggcttgtctcaaactcatggactcaagcgatcttccagcctcagcttcccaaggtgctgggattacaggtgtgagccactgcgcctggccaactctgctttttaagagtgcatgtgattaggtcagaatcattgataatctctctgcctcaaggtcaaccatagcatgtcatgcatcctaaccacagaagtgatatatttgtaggttttgcccacactcatcaaaagggggttacaccagggtaaagggcattgggggtcacaggaaaattctcctgccccagatggggggtttgaaggtaggatagagtaagggaggagaatttcctgagaacatacagagaattggagatggaacccaggcaggaatctatgtcctcagtcttaacgaggcttgttccgctatagaaatttgctgggagcagggggatgcagcacctgacctttccggccctgctatactcccgtgcatatggggaaccatagcctctttggggtggtggcgggggcagggacaccagtcgttggagccaggttgagaagcaaaaagtccctgcctgggaaaggatcctggatgctcccaggaaggcggaacgggggtcagatgctcctactggggttcggagcaaagccacttccggtcctctggccctcctctccccaagtcagggggacatctctgggctcacagggctggggctcccccgaccagtagggggcgtccggcacacgcgctgctttgtggatgccgagcaggaacacggtgggggagccccaggcaggtaggtgttggggtgaaggggctgaccgcagccccccacaatcccgaggccctgcagatccctacagtgcctggcttgtctagggagacctgtgatgcgcgcctcctcctcctcagttggatctgattcactttggccatgagtaagcactgaaaatgcagctggttcccgatggctcacacctgggatcccagccctctgggaggccagatgagaggatcatttgagctcaggagttccaaaccagcctgggcaacatagcaagatttcatctttaaaaaaaattagcagtgcgcggtggctcatgcctgtaatcccagcactttgggacgccgaggcagaaggatcatttgaggtcagaaattcgaggccagccgggacaacatggtgaaaccccacttctactaaaaatacaaaaatttgccgggcgtggtggtgggcagctgtaatcccagctactcaggaggctgaggcaggagaatcacttgaacccgggaggtggaggttgcagtgagccgagatcgtgccactgtactccagcctgggcaacagaatgagactcagtctcaaaacaaaaaaaaaaaaaaaaaaaaaaaaaaaaaaaaaaaaattagctaggcgtgatggtgtgcacttgtagtcccagctactcatgaggctgaggcaggaggatcacttgagcctacgagttcaagaccagcctgggcaacatagcaagcccccatctctacaaaaaatgttttaaggccaggtgtggtggctcatgcctgtaatcgcagcactttgggaggccaaggtgggcggatcacctgaggtcgggagtttgacaccagcctgaccaacatggtgaaaccccatctctactaaaaacacaaaattagccaggcatggtggcgcatgcctgtaatcccagctatttgggagactgaggcagaagaatgacttgaacccacgaggcggaggttgcggtgagtccagatcatgccattgcactccagcctgggcaacaagagcgaaatttcgtctcaaaaaaaattttttttttttaattggctgggcacagtggctcactcctgcaatcccagcactttgggaggccgaggtaggcggatcacctgaggtcaggagtttgagaccagcctggccaacatggcgaaaccccatctttactaaaaatacaaaaattagttgggcatggtggtgggcacctgtatttccagctcctcaggaggctgaggcatgagaattgcttgcgcccgggagacagagcctgcagtgagctgagatcatgccactgcactccagcatgggggacagagagaaactccatcttaaaaaaaaaaaaaaaaaaaaaaaaaagggccagcatggtggctcacgcctctaatcctaacattttgggagggcaaggcaggtggatcacctgaggtcaggagttcgagaccagcctggcaaacatggtaaaatcccgtttctactacaaaaaatttaccaggcacggtggcgcgcgcctgtaatctcagctactcgagaggctgaggcaggagaattgcttgaacctaggaggtggaggttgcagtgagctgagatcgcgccattgcactccagcttgggcaacaagagcgaaactccatctcaaaaaaaaaaaaaaaaatcagctgggcctggtggcacatgctgtggtcccagctacttagggagctgaggtgagaggatcacttgatcccaggatgttgaggttggagtgagtcatgattgcaccactgcattccagccttggtgacccagggagaccttgtctcaaaaacaaacaaacagacacacaaacaaacacacaaaaatggggctggctgcaaccctatttgaggtggctggagtcccctgcaccctctctctctggccccagctatgggcgcctgccagccctctccctctccttctccctctgcctctccgtctcccctccatcagctcacccgccctgtccttttcagcactcaatttctcttcctcctcccacactcgaagaggatttcagctccctttagggacttttcccctagggaagtgcctctctgcttctcagtgtccacaaggaggaaccaggtgcccaggccttcaaccgagtgcactccctctagaaacactcaattcacagccatgctggctggactgtttctgctttacacagaaatggccatcaaactgctttatcaattgattatgaggccatggggcagttacaataatttcatcaagcagagcagagcctgttgacatggaggatggacatttctgaagaccctcaaagaattagctgtaaccatgagaccagatctaagacccctgacacccagcctggggccttctcaccaggaggcctctggttaatagaaaatgagagtaaatcaggccaggcgttgtggctgacacctgtaatcccagcatttgggaggccgaggcaggtggatcaactgaggtcaggagttcgagatcagcctggccaacatagtgaaaccctgtctttgctaaaaatacaaacattagctgggcttggtggcgtacccctgtaatcctagctactcagaaggctgaggcaggagagtcgcttgaacccaggaggcagagattgcagtgagtcgagatcgtgccactgcactgcagcctgggcgacagagtgagactacgtcaaaaattaaaaaaaagaaagaaagatgaaagaaagaaagaaagaggccagacacggtggctcacgcctgtaatcccagcactttgggaggctgaggcaggcagatcatgaggtcaggagatcgacaccatcctggctacatggtgaaaccccatctctactaaaaatacaaaaaattagccgggcgtggtggcgggcacctgtagtcccagctactcagaaggttgaggcaggagaatggcgtgaacccaggaggtggagcttgcagtgagccgaaattgcgccactgcactccagcctgggcaacagggcgagactccatctcaaaaaaagaaaaaagaaaggagagagagagagagaaagagaaaagagccagccaaggaaccaaggcagtgtggccagagagagtggagggtcaaaggaggcccacaagaaatcaaggggagctaggggccgtggctcacacttgtaaccccagcacttcgggagactgaggtaggaggatcacttgagcccaggagtttgagaccagcctggacaacatagcaagactccttctctacaaaaatttaaaaattaactgggtgtgttggtggtgcacctggcccagatacttgggaggctgaggaggtaggatcacttgaggccaaaaggttgaggctgcagtgagccatgatcatgtcactgcactccagccagggcaagcaagtgagactcttgaaaaaaacaaagagccgggtatggtggctcacgcctgtaatctcagcactttgggaggctgaggtgggcagatcacttgagtgcaggagtttgagaccagcctgaccaacatggtgaaaccccatctctactaaaaatacaaaaattagccaggcgaggtggcacactcctgtagtcccaattactcaggaggctgaggcaggagtgtcccttgaacccagggggtggaggttgcagtgagccaggactgcgccactgcactccagcctctgacagagcgagactcaatctcaaaaaaaaaaaaaaaagaatgaaagaaaccagaaagttgcatttggggatcagaagaaaggcaggaagcagaggcatgtgggatgaggacacctgggaggtgccatctccagtgtccctctgggtgactggatctcttcacatggagtagacagaggttgggaacggaaggtggaatgtcatgttccacttgagactggaaaagggaaggctggggctgaccaggccagaggagggctggaggcctgcgctcatgaaaaccaaagctgggtgagtttccagctgggagaggcagccaggaaacagggccagctctccctggggaggggcaggctccaagccccagtgtgggtccgggggcgggagccatagatcatcaccagcgcaggccagtgctgctgtgggggctttcttcgcactcctagtttctttttttttttttttttttttttttgagacggagtctcgctctgtcggctcactgcaagctctgcctcctgggttcacgacattctcctgcctcagcctcccgagtagctgggactacaggcacctgccaccacgcccggctaattttttttttgtatttttagtagagacggggcttcaccgtgttggccaggatggtctcgatctcctgacctcgtgatccacctgcctcggcctcccaaagtgctgggattacaggcgtgagccaccgcgcccagcctcctagttattttctttccttccttccttcttttcttttttgagagggagtctcactctgtcacccaggctagagtgtaatggtgcgatcttggctcactgcaaccgcagccttccaggctcaagcaattctcccacctcagcttcccgagtagctgggattataggcaccagccatcatgccctgctaatttttgtatttttgtagagacagagtttaactatgttggccaggctggtcttgaagtcctgacctcaggtgatctgcccgcctcggcctccctaagtgctgggattacaggcgtgagccgccgcgccccacctgcactcctagtttcatcctcaccatggtgccctgagtcctatgatcacgcccaaggggcttggccaagcccatcacagccagccactaccagggcctgcacttctttcaggctcctccagatccccccgtggctgccctggagaatggcttcctgttggcctcaaaactcaagagcttacctggtcctggtggctcaaccgtggccaggtaaatccgggtacaagaggagggtcccgctgggcatgacaaggcatacggagggagaaaacatggccatgcatgaaacgacaaggtcagctaccaggtgaaatgtagccccttcctgtgggctgatggtcagagccagactgtcagaggaaggagcaactcgtaggggtcagaaagggttttggcttcaagtctgtgcagacaaggaagaagcaagcgcagtaagcactgtggagtggggaccgggggcagcaaagggaccggctctgggattgctctctcctccctcaagcccgccagagcttgagcccctggtgcccctttcctgctgtgcagctgcggccgccagcgcatcaggggttaatgtctggctggtgccggcttcagcagcagcagcagcaacagcagcaacagacagtggtgccagtaactcagaggctgaaatgtgagaagcaagacgagaggggcagggctgggaaaggctgagcagcagcgagcagagagggtttccctggcaggagccacaggaggctgcctggtcctcccttccatggccctgccgtacagctggccctccagcctcgggctggggtatggcaccctctcagggtggtgggggtgtccatggtcatggccagcgtccaagcccttaggccaccgggaagcagttccctactgcagatctagggaaggggcacaggcgcccaggcaaccagcagagaaggcacccggctctgcccggctctgcaggaagctctaggtggggagatggggcagtggcagagtggggcctggagaaccgaggaggaggacagggagatccctcggggtgtcccaaccgcagaggcctggcctcgacttcacccttccccaccttgggaaagctgaggcacaggaagcttccctgataaatggataaatgagcctcctgctgcttgggggcagggaatgtcgcagggctgctgccccctccacgggcctgggtgtccgcctgcctttgcacaggcacctcagggatgcataagcaccaaccagagaggtgagaggtaccaggcacagcgcgagtgccttatccatactctttttttttttttaataaaaaaaataggccgggcgcagtggctcacacctgtaatcccagcactttgggaggccaaggcaagcggatcacctgaggtcaggagtcggacaccagcccggccaatacggtgaaaccctgtctctactaaaaatacaaaaattagctgggcgtggtgatgcacgcctgtagtcccagctacgcgggaggctgaggcagaagaatcgtttgaacctgggaggtggaggttgcagtgagctgagatcatgccactgcactccaaaatgggtgacagagcaggactctgtctcaaaaaaaaaaaaaaaaaaaaaagctgggcacggtggctcatgcctgtaatcacagcactttgggaggccaaggcaggcgggttgcttgaggccaggagttggagagcagcctgggcaatatggtgaaaccccatctctactcaaaatacaaaaatcagctgggggtggtggtgggcgcccgtaatcctagctagttgggagactgaggcaggagaatcacttgaacccaggaggcagaggttgcagtgagatgagattgtgccattgcacttcagcctgggggacagagggagactctgtctcaaaaatagatagattagatagatagatagacagacagacagacagacagataaaggccgggtgtggtggctcatgccgccctgtaatcccagcattttgggaggctgaggcgggccgatcacttgaagtcaggagtttaagaccagcctggccaacatgacgaaactccatctctactaaaaacgagcaaaaatagccgggcgtggtggtccacgcctgtaatcccagctactccagaggctgaggcacaagtatcgcttgaacttgggaggcagagcttgcaatgagcagagatttcaccattgcactccagcctgagcgacagagcgagactgtgtctcaaaaataaaaaggaacaaggtgctgatctatgctacaatatagacgaaccttgaaacattaagtgaaaagccaatcacaagagaccaccactttatttgaaatgcccagaatagggaaatccatagaggcagaaaacaggctggtgcgttgccagggcctgggaggaaagaggaatggggagtggctgcttcttgagtatagggtttctttttgggatggtgaaaatgttctgaaattagatgttgatgatggttgcacgactctgaatacactaaaaaccactgattgtacacttcaaagaggtgaattttacggtatgtgaattatatcttatttttattttttaatctttttttgagatggagtctcactctgtcacccaggctggagtacagtggtgcgatctcagctcactgcaacctccacctccctggttcaagcgattctcctggctcagcctcccgagtagctgaaactacaggcacccaccaccacacccggctaatttttttagtagagatggggtctggggtttcaccgtgttagccaggatggtctcgatctcctcaactcatgatccgcccgccttggcctcccaaagtgctaggattacaggcgtgagccactgtgcccggccaaatttttgtatttttagtagagacggggttcaccatgttggccaggttggtctcgaactcctgacctcaggtgatctgccggtctcagcctcccaaagtgccgggattacaagcatgagccactgctcccagcttgattttattttttatttttattattattaactaatttatttattttagacagagtctctctctgtcacccaggctggagtgcagtggcgcgaacttggctcactgcaagctctgcctcctgggttcacgccattctcctgcctcagcctctggagtagctgggactacaggcgcccgccaccacacctggctaattttttgtatttttagtagagatggggtttcactgtgttagccaggatgctctcgatctcctaaccttgtgatttgcctgcctcggcctcccaaagtgctgggattacaggcgtgagcgactgcgcccggcctatttttattttttgagacagagtctcactcttgtcacccaggctggagtgcaatggcgcaatttcggctcactgcaacctctgcctcccaggtttaagcagttctcctgtctcagcctcccgagtggttgggattacaggcacgcaccaccatgccaagctaatttttatatttttagtagagatggggtttcgtcatgttggccaggctggtctcaaactcctgacctcaggtaatccacccaccttggcctcccaaagtgctgggattacaggtgtgagtcacccttctgacccactcccaggttccaggaacaagaatacaggtcctctaatggacaaagctcattcagggaccctccaatgtgaatcgaccagacacagtcctcatgtgtcatgggagggggacaggcagcagctcctggagcggaaggacgcctggcccctcctccggccccagatgcagctgcaggtacagggagggcctcccagggcaggccagagcctgcaggcccccagctgcagccccagctgggaccaggcttctaacctcacccctttcttgctcctcccgcctccaccatctctcctgtggagcccccaagactctggaggagaaatcaaatacaaaactcctaggagaacagaaagggggctgctgctgctgcgtgcagacacactcatgcacacccacgcacacacatgcaaacacacacatgcacaccatccttcgagcccacaggcagatcacagagaacctagatgtcaggatgagaaaggaactagacgtgagctatcatctgcctccttggggcaaggcctgtgccaagggatttgccaggattgtctcatccaatcctgaaaagaagcttggagatttcagagatgaagaaaatgagcatctgagagcttaagggagagactcaaccaaagggacacctggggacgctaaagcccatgaagctgagcacagggcctggcagccagcatggtggaggcagcttagcagagctggggggtcgctcttgtatttatgtttttttgttttgtttttgagatagggccttgctctgttgaccaggctggaatgcagtggtgcgatcaaggctcaccgcagccttaacctcctgggctcaagccatcttcccgtctcagtttcccaagtagctgggaccacaggtacacaccactatgctcatctaatttaaaaaaaaatttttgaaaatacaaaaaaattagccgggcgtgtggcaggcacctgtagtcccagctacttgggaggctgaggcaggagaatggcatgaacctgggaggcagagcttgcagtgagccgagatcacgccactgtgctccagcctgggcgacacagcaagactcccatctcaaaaaaaatttttttttgtagagacagggtcttgctatgttgcccacgctggtctccaactcccaggatcaatcgatccttccacctcagcctcccaaagtgctgggattccaggcgtgagccaccacgcctggccggtgtggttcttttaagggacagcccccctcatttccatttgctccatggggctacaggggtattgccctgtgctgggcaggctcctgacccaggcctgtcccatcaggagtacggtgatcgctacagggctgggttgggacccagctccagccaaagagaggcaaacctaggattctgctggaacccgtggtagacacaagctggaggttcacaggtctgtgacatcagggcctcctctcaggaagcgctggcccaagagcaaagcgaaaacggaggaaacctggctgggagatgcaagccagtgttcctgtgagcactggacccagctagaccctcggcctctgcagttacacgagctgtcaaggaactggtctttatttcatttatttacttatttatttattttttaatttgtttttgagatgggggggtcttgctctgtcacccaggctggagtgcagtggtgcaatcttggctcactatagcctccacctcctgggctcaagcaatcctgcctcaggagtagctgggactacaggcccgcaccaccacacctggctaatttttctatttttttgtagagatggggtctcactatgttgcccaggctggtctcaaacttctaggttcaagtgatcctcccacctcagcttccaaaagtgctgggattacaggcatgagccgttgtgcctggcccagaaactggtctttgaatccaggtctgaacgctgaagctcatgctctcttccttgcgccccagctgtccgcatagaggctctgatagatcaggggctcaggcaagtctggggagggggcctcacctccctcccagcccctggagggagtgttggaccctctcacccccctcaaagcagttccattgctccctttgaccttcaaagttggcatctgcttgcaggaatctgtctctctcctcctggaattcagcctccagatgtcagatccgaggcggtggcggcagcatatggctcccctcagagtgaatcagccacattccaaaggtgcacacacagacgccacaccctcagcagcctggctgcagacttcctcccagccccagcacccggcacccgccccagcccccacctcttcccagccagacccgacttcgggcttcctttccagagactttctcctggaactggaacagagagaaagccactagggctggagacaccctgagcagccctgctctgctcactcgctcccaaccgctcacagctgttatcaatatatctatggtgcatccactcaacaggtgtgcactgagcacctatgatgtggcagacaagatacagacaagccccgaacctcacggaactcagctgggcaagagcccaacaaaatcaggtccagaggcagaaaagaattccaagtgtgggaagagctataaaaggaagaaacaggcctggcgcggtggctcacgcctgtaatcccagcactttgggaggctaaggctggcagatcatgaggtcaggagatggagaccaccctggccaacatggtgaaaccccgtctctattaaaaatacaaaaattagctgggtgtggtggtatgtgcctgtaatcccagcaactcgggaggctgaggcaggagaatcgcttgaacccaagaggcagagattgcagtgagccgagatcacgccattgcactccagcctggcgacagaacaagacttcatttcaaaaaaaaaaaaggaagaaacaagggctcagacacgtgacaaagtgacagagggagggttatggggtgggggaggcttatcttggggtaacttgtaagctgaggtctgaaggatgaatagaaacgtcctctatcggctggtcatgggattgcacacctgtaacccgggagctccgggaggcccaggcaggaggactgcttgagtccaggagttcaagaccagcctgggcaatatagcaagatcccatctctactaaattaaaaaaaaaattttttttaaagaaacctcttctatcccgtcacttctgtaatcacttcacgagaattacagaaatataacccaaaaatattttccccagtcactcaggaagttattgggtcctcttctcctgcccctcttttttttttttttttttatcactgaagcagggaatctggctaatttttttaataagacctttggtgaggccgggtgcagtggctcacacctgtaatcccagcactttgggaggccgaggtgggcgcatcacgaggtcaggagatcgagaccatcctggctaacacggtgaaaccccgtctctactaaaaatacaaaaaattagccagacattgtggcaggcacctgtagtcccagcgactcgggaggctgaggctgaggcaggagaatgtccaccaacctgggaggtggagcttgtagtgagccgagattgtgccactgcactccagcctgggcgacagagcaagataccgtctcaaaaaaaaaaaaaaaaaaagaaaaaaaaagacctttattgagatataatccatataattcaccactttacaattacaccacagtagatgattcagttgtttttaaatatccacagatctgtgcatctataactgcaattttggaatattttctttttctttttttttcaagacggagtctcactctgtcacccaggctggagtgcagtggcatgatctcggctcactgcaacctctgtctcccgggttcaagcgattctcccgcctcagcctcccaagtagctgggactataggtgagcaccaccgggcccagctagatttttttgtatttttagtagagacggagtttcatcacgttggccaggctggtctcgaacccctaacctcaagtgatccacgtgccttggcctcctaaaagtgcttggattacaggcatgagccactgcaactgaccaattttggaatattttcattaacccaaaaagaaactccacttagcagtcactccccgatgctcaccaccaccccaggccccaggcaacccctaagctaccctatctttttatttatttatttttagagacagagtctcactgtgttgcccaggctggagttcagtggtttgatcatagctcactgtagcctctacctctcagggtcaagcagtcctctcctctcagtctcccgtggagctgggactacaggtgggcgccaccacactcagctaactttatttttttttagagataggggtctcactctgttgcccaggctggtcttgaactgctggtcttgaactcctggtctcaagtgatcctcctgccccagctttccaaactgctcatgcctgtagacgtaagccactgcccctggcccttaatctacttccagtctctatggatttgcctattctggaaatttcatatgaacagaaacacacaacatgcgtcctgtgtgtctggcttgtcactgggcataatgctttcaagggtcatccatgttgtagtatgtattggtgcttcgtttttttgttttgttttgttttgttttgagacggagtctcactctatctcccaggctggagtgcagtggaacgatctcggctcattgcaacctccgcatcccaggttcaagcaattctcctgccttagcctcccaagtagctgggtctgcaggcatgtgccaacatgcctggctaatttttttagagacagggtttcaccgtgttagccaggatggtctcgatcttctgacctcgtgatccactggcctcggcctcccaaagtgctgggactacaggcgtgagccactgcgcccagctgcttcgttcctttttatggctgaatcatattccactgtttggagagaccacagttgatttatccattcatcaggtgagggacacatggttgctttcactttttggctcttatgaataacactgctctgaacattcccatgcaaatttttgtgcagatatgttcccattcctcttagatatacacgatatatacctaggaggggcactgctgcgtcatatggtcactccatgtttaacattttttttttttttttgagatggagtctcactctgtcaccctggctggagtgcagtggcctgatttcagctcactgcaacctccacctcccagattcaaaggattctcctgccttagtctcctgagtagctgggactacaggtgcctgctaccacacccagctaattttttttttttttttttttacatcaagacagggtttcgccatgttgtccaggctggtctccaactcctgacctcaagtgatctgcctgcctcagcttcctaaagtgctgggattacaggcctgagccactgtacccggcctccatgtttaacctttcaaggaaccagactgtttgaaaggggctgcagactcccagcagcaccacactctgcccagattcactgagaccccttcgcatgacccccagttcacactactcagagaagcaccttaaaattagctggcctaaaggccaggcgtgatggctcatgcctgtaatcccagcagtttgggaggccgaggcaggtggatcatgaggtcaggagagtgagaccatcctggctaacacggtgaaaccctgtctctactaaaaaaatacaaaaaaattagccgggcgtggtggcaggcacctgtagtccagctactccggaggctgaggcaggagaatcgcttgaacgtgggaggtggaggttgcagtgaaccgagatcacaccattgcactccagcctgggcgacagagtgagactccatctcaaaaaaaaaaaaaaaagaagtatcagaaccaagagaggatggcagcaggggatggcaaggcgctcagtggtgaaagcgtcaggacttgaaccccaccgccactactttgcagctttgcatttttgcatgaaccacgcggcttctccaagcctccctctcttcatccacaaaacaggcctgattgtgacaatctactcaatagggtgattttgaagattaaacatagtaatacaaaacaagttattctgtttgccaaagacattacagatgaggtcatgtagccaataccatgccaggaaaccaaaactcacctcaagaaatctgttgggtgggacgggcatggtggcttattcctgtaatcccatcactttgggaggccgaggcaggtggatcacgaggtcaggagtttgagaccagcctggccaacatggcgaaacccccgtctctactaaaaatacaaaaaaattagccagccgggcgtggtggcatgcgcctgtaatcccacctactcgggaggttgaggcagaagaactgctttaacccaggaggcaggggttgccatgacccaagattgcgctaatgtactccagcctggatgacagagtgagactccgtcttgggggggaaaaaagaaaagaaatctgttgggtagccagggcatggtggctcatgcctgtaatcccagcactttgggaggccaaggcgggaggatcacttggggccaggagtttgagaccagcctgggaaacacagtgagaccctgtctttactaaatataaatgtaaaaaaaaatagctgagcatggtggtgtgcacctataatcctagctacttgggaagctgaggtgggaggcttgctataaccccaaaggctgaggctgcaatgagctgagatcacaccactgcactccagcctgggcgacagagtgagaccctatctcaggagaaacaaagaaaaagaaatctgtcttgtcctaaggctgacaggggcaaaaccaggatctgaatcacgtgattcccgacagggctttggccagcgctgtgtgaatactcacacagatgggggatgctgggcagcttcagctcagaaggaacactgagtgagggacagatggactggtccggcaggggacccgcccattcagcagatgtccctgggcacagctcacatgtcagttctctgcaaagcggacaggcggctgagaagtgtcagagcctgctaatgagggctgggcaagagagaagcagaagcgaacttgcctgggtcgggggaaggggatggtgcaaagcaaccctgaggccgaaagcctgtgtagctagaaccaacgggggtgggggcgggcgctcagggctcagggctcaggaaaatgaggtggctctcctagttttaccagggaaaggaaaacaaggcaggaatttccggcagggaaacctggctactcggtgggactcttaaagatgacactttttcctctatcctcgagtgcagcctcaagacgggccctgctggtccatcctggggcgacaggtgtagccagattcccctccaatcaaggagtccaactggaaagctccagtgggttacccaagggcagataccaagcaagtccctaaaaatggaggccagtgtgccctggagggcaagtataaatatggggaactctgagccgggcgcaggagctcacacctgtaatcccagcactttgggaggcagagggccgatcatctgaggagttcgagaccagcctgggcaacgtggtgaaatcgtctcaactaaaaatacaaaattagtttggtgtggtggtgggcgcttgtgatcccagcttctcgggaggctagggtggaagaatcacttgaacccgggaggcagaggttgcagtgagctgagattgtgccattgcattccagactgggcaaacaaagagtgaaattccgtcacgaaaaaaataataataaaaaatatgtggggaactcttaagtagagatgggggttcccctcacttttgcctcttccacggagttaaagtgtcaaggaaaggggttcccaggataaaactttcaggagtattcggttttaggggctacaggcagaggcgcaggaccctagagggattttttttttagctggagtctcactctgtcgccaaggctggagtgcagtggtgcgatctcagctcactgcaagttctgcctcccgggttcatgccattctcctgcctcagcctcccgagtagctggggctacaggcgcccgccaccacgttcagctaatttttttgtatttttagtagagacagggtttcaccgtggtctcgatctcctgacctcgtgatccacccgcctcggcctcccaaagtgctgggattacaggcgcgagccaccgcacccggctgctaaagggatttaggaggtgggtggaaccacaaaggaaaagctagctgctggtggggtctcagcttggaagacgtcagggtgtgaactgtcacttaaggaacagtttaggatagagcaagggatgaggaagcccacctggagttcggcaggagtgggtgacctcaggtagccccctcttttgagaaacctggccgggaaggttggagacatggctgtggcttgaggctagtgtttttttctttttggggacggagtttcactcttgttgcccaggctggagtgcaatagcacggtctcggctcactgcaacttctacctaccaggttcaagggattctcctgcctcagcctcccaagtagctggaattacaggcgcctgccatcatgcccagcaaatttttgtatttttagtagagaaggggtttcaccatgttggccaggctggtcattacaggcctgagccacctcgccgggcaagactagtgtttgattgttcgttttgagatggaatcttgctctgtcagctcactgcaacatctgccttccaagttcaagcgattctcttgcttcagcctccagagtagctgggactacagccatgtgccatcacgccccgctaatagagatagggtcttaccatgttgcccatgctggtcttgaactcctgggcttaggagatcctcccacctcggcctcccaaagtgctgaaattacaagtgtgagccactgtgcccgtcctggagtcaaaggctttggacttgaatgccatctctgctactttagagctgtgtgtgcatgtacttttaacttctctctgtctccctctcaaaatgggcccgatagtaggttccattttggtctggtcccaccaggacctctgactcgctggcgacctcaggtaggggctcatgtaatagcccagctcctcaaacacggaggatgggtcccactcctgacccagcctcattttacagcagagcgtgaaggccgagactagaggctgcaccaggctggggaaggggcaaattctagattactcaccaggcccgtacccatgagagccctcaggcctgcagcaccgtggatccagaggcagagacagagctttgtagaagggtgaaaacacttcctccccgcttccggctgcagaaaagccactttctcgcggcagagcccagactggcaacccccaggccttctgcacctcacctgggcagcaggcacgctgactgtgtgtgtttcaatctctccaggctcagagggatggcgggggatgctgcctgcgcggttgctagtggcggacacagctgcctggctgacactgcctttgtcatgctccagagcactcagccagcccggggcccctcacccactccctctctcctcctgccaccagaagcagcctcttcccggctcccaccctttctccccgaagccacttgtacctgctccagagcctggagaggtgacaagtgcttcccagacaacaaaagcatctcccaggagaacagatgttacgcacactcagctacacccttgctctgtgccctgattttaagctgtgtttgggcagctctttgggatgaaactgaggcaaggggtaaagggcctgtcttggtcaaggtcatcccaccttgggactcctgggtgtgtttcagacatccgtccccttgggttccaatgctggtctggccacttacaagctgtgtgaccttgggcaagttatttgacctcccagagcctaatttccccccagataacgacagataggtagtgaacccacctcttgctaaaaaatgtgagccattattgtcattactccatccttttaattcctctttctctccactccagccacatccgcctcaatgcctgctgcccctggaccttaggcttgggatgtgaaatctttctggaatgttccttcgttagttcctcgcatggcttgttccctcgcttccctcttttgagtcttgactcaagtcacctccccagggaggccctgtcctgccctgtcctccctgggcgcttatgtgacatccgaggcggtttcccaattcgactacctgtggctcttgcgcctggaacgtaagccccacgaggacaggactgtttcacttctgactcccgtgtccgcagcgatggaaagaatgactgtgggcgcctacccccggaggatgctgtcggcgcccagtctggcggctcccggcgcgcgcccgcgaggtcacgtccggggcgcgccggccggaaggaggccccgcgtgggggtaggggcggggcgtccgagccaggccacgccccccggactcgcgcccccctctcagcggcagagccagccagcctggggccgcctcgcacttccgctcaccagccggcttgttcatattcatgaggcgggcgagaggcggggcccgggtcaccggcggcgccccgcccctggcttggaatcccgccccggcggaggcttgggccccagtggggcgcccccagcttccgcctcggggagggagtttccacttggtcacgactcaaaaatgtgtcgctcgcgcttctccgccccctcgttcctgccctgggggggtctcctccctcggaaggcaggaggggaggggccaagggagggacggctcctcctccccggggcaggtccttagggatcccgggcggactcctctccctccaagttagcgccttcaacaatctttcccctaccccgtcagacagtcttctgtcgcccagagctggagtgcaatggcgcgatctcggctcactgcaagctccgcctctcaggttcaagcgattctcctccttcagcctcccgagtagctgggattgcaggtgcgcgccaacacgcctggctaatttttgtatttttagtagagatgtggtttcaccatggtggccaggctggttttgaactcctgacttcgtgatctgcccgcctcggcctcccaaagtgctgggattacaggcgtcagacggcgcacccagccctgcaataatcttaaatttttttttttttttgagttggaatctcgctctgttgcccaggctggagtgcaatggcgtgatctgggctcatcgcaacctctgcctcccgggttcaagcgattcgcccacctcagcctcccaaagtgctgggattacaggcctgagccactgtgaccggcctttttttttttttttttttttttgagactgggtctcactccgtcccccaggctggagttcagtggcacaatcggctcactgcagcctccacctcctgggttcaagcaatcttcccgcctcagctgtccaagtagctgtgactacagtcatgcaccaccacaactagctaattttttaattttttgtagagatggggcagggtcttagtatgttgcccaggctgttctcgaactcctgggctcaagcaatcctcctgcctcggcctcccaaagtgctggaactacaggcgtgagctactgtgcccaaccaaaactaccttttttactttttatttatttattttgcgatggcgtctcgctctgtcacccaggctggagtgcagtggtgcaatctcagctcactgcaacctctgcctcctggtttcaagcgattctcgtgcctcagcctcctgagtagctgggattacaggcgtgtgccaccatgtccagctaatttttgtattttcagtagacaccgtgtctcactatgttgaccaggctggtcttgaactcctgaccccaagagatccacctgccttggcctcccaaagtgctgtgattacagggatgagccaccaggcccagcccaaaactacctcttttaaacttcccaaggatctgtgcaatattatgataccgagaagttcagagcagttgagtgactcacccacgtcacacagccggcctcaggttttccagaaaggttggtcctgctgggttggggtggcaggtgcatgtctcccacggcctttcaggaaatgaggcttacctaaggcactcctgtcttgctggatgtggctgaaggttgggtctgtgcgccacactgatgggagggagaagctacatgctaggagaaacgaaaccatgaaggcaggacaggctgcgtaatgtaaaatgaaaattcgcgggccatgttctaaaatgattaagaatttcaagacggtgacagcagaacattcagccacactcaggcccttctaagggccagccctgtgcaactgcatagctcacatggcttccatgaagcaagcctctgatgaaggagcccaagggtgacagcgctgccaccagggacatccccacctctgatagaactctcccccctagcccaggcgccccatcccgtccccgccctggaatgcaggacccagtctctagacttccaaaagctgagcattttaggctttgcaggacaggttcttggggagtcaggtgggtcaccctgggagtgtctcacatctgcaagtcccagccaggcccctggggctgcacctcctgggcattttcagctctgggccctgcgggcaggtggcgctgtgttgtacatgccaggcccagcatggcttcggttctgacttgaagccctcctttctccctggggcagggaatgagaagcagccagggccgcttcctagaataaacaccccacccgcagacagccccagctctgtaggctcagccagccagcgccaatggagagagaggctcgccaggccaccggctcagggttgataagtcatcctgatctcactccctccatcactcctgccttgtgactgggctctgcccgctgtgggctgcttcattcataatagctaccatttgcgggctctttctcccagccacgtgctgctggaagccctttctgtgcacttcccactgagcctcacagaggccagtggtaataggtaccctgaggactgcgatttcatagatggggaaaccgaggctcagagaggttagagggcttggccaaggtcaagggccagaggtctggatctgccaccattcatccattctgattcctgtcatctctcctacatctacaatgtaggtctcaagggttacttcttttgtttttttgttttttttggttttttagagatagggtctaagggccaggcgcggtgcctcatgcctgtaatcccagcactttgggaggctgaggtgggtggatcacctgaggtcgggagttagagaccagcatggccaacatggcaaaaccccatccgtattaaaaatacaaaaattaggcggatgtggtggcacacgcctgtaatcccagctactcaggaggctgagggaggagaatagcttcaacctgggagacagaggttgtaccactgcactccagcctgggtgacaagcaagactccgtctcagaaaaaaaaaagagacagggtctcagctgcatatggtggctcacgcctgttatgaggctaagacaggaggattgcttgatcccagaagttcgaaactagcttgggtaacatagtgagacccctgtctctacagaaaatatgaaaattagctgagtgtggtggcacatgcctgtagtcccagctccttgggaggctgaggtaggaggatcacctgagtctgggatgtcaaggcagcagtgagccgtgatcgcaccactgcactccagctcgggcaatagagtgagaccctatctcaaaaaaaagagagcttaataatctgttggagctgggcgcggtggctcacgcctgtaatcccagcactttgggaggccaaggtgggtgggtcatgaggtcaggagttcgagaccagcctggccaacatggtgaaaccccatttctactaaaaatacaaaaatttgctcggtgtggtggcgtaggactgtaatcccagctactcaggaggctgaggcaggagaacctgggaggtggagattgcagtgagccgagatcatgccactgcactccagcctagtcgacagagcaagactctgtctcgaaaaaaaaaaaaaatgaatgtgaacctaggtgatgttcaataaatgtttactggtaaaggattaggggaccaagttcagcccccaaagtgtatctatcagcgatactcaggaagcactgacaacatgccaggccctgggcaggaccttgcagggggagggacaaagcagacaatgtccctctccttggggatcttaccgtctaataggagagaccatcctccctccaagaggggcctactctgagaggaggacgcccagcacaatggcagggaggggggacatgcctccatgcctgttgttcacctagaaggagaaatggggcctggctctcctgcaatggcagctgctgcctcctggaaaagcagaacctagagaaaacagctcagagcctggccttgttggctgtctccactgcctgtcccccacctcgacagctacctgatgctccagggaagtagtgggttagagagcacaagctttggattcagactgcagacacatggagactgcaatctggactatgcctcctactagcttatacaaccctggacaagttagtgaacttctttgtgctgttgtcatccatataatgaaaatgtccagtagagagaaagagctggggatggctcacacctggaatcccagcactttgggaggctgaggcaggaggatcacttgagaccaggagttcatgaccagcctgggcaagatggcaagacctatctctaaatattattattattttgagacatattctcactctgtcacccaggctggagcggcacagtctcagctcactgcagcttccacttctcgggttcaagtgatccttctgcctcaacctcccaagtaactgggactacaggccaacacacccagcttattattattattatttgagacagagtcttgctctgttgctcaggctggagtagagtggcgctatcttggctcactgcaacctccacctcctgggtccaagcgattctcctgtctcagcctctccagtagctgggattacaggcgcacacaaccacgcccagctactttttgtatttttagtagagacggggggcttcaccatgttagccaggctgatctcaaaccctgacctcaggtgatctgcccgcctcagcctcccaaagtgctgggattacaggtgtgagccaccgcgcccagctattattattttttttagatagggtcttgctctgtcacctgggctggagtgcggtggcatgatcatatagctcactgcagccttgatctccagggctccggtgatccttccaccacagcctcccaagtagctgggattacagatgtgtgccaccaggcccagctaactttttattttttgtaaagagatgtggtctcttgggaggccggagcgggtggatcacctgaggtcaagagttcaagaccagcctgagcaacatggtgaaatctcatctctagcaaaaatacaaaaaattagccggcatggtggcgagcgcctgtaatcccagctacttgggaggctgaggcaggagaatcacttgaacccaggaggcagaggttgtagtgagccgagatctcgcaccattggactccagcctgggagacaagagcaaaactctgtctcaaaaaaaaaaaaaaaaaaaaaggtctggggtgtcattatattgcccaggctggtctcaaactcttgggctcaagtgatcctcccaccttggcctcataagagtgttgggattacaggcgtgagccactgtgcccgccctgtctctatttatacaaataaaaataaaagtaaaaaaataaaatgtctggtagagaaaaagaactggtctggaagtggctcacacctgtaatcccagcacgttgggaggctgaggtgggaggcttgcttgaaccctgcagttggagggaggctacagtgaggtaggatagagccattgcagtccaacctggacaagagaaggagaccctgtctctaaaaaaattcaaagaaaaataaaaaaagaaagactggtcttgccaagaactggaagtttcttttttttttttttgagatggagtcctgctttgtcacccaggctggagtgcaatggcatgatctcagctcactgcaacctatgccttccaggctcaagcgattctcctgcctaagcctcctgagtagttgggattacaagcacgcaccaccatgcccggctaatttttgtatttttagcagggatggggtttcaccatgttggccaggctggtttcaaactcctgacctcaagtgatctgcctgcctcagtctcccaaaacgttgggattacgggcgtgagccaccacgcccagccaatttttaaaaaatataatagagactaggtgggaggtgggggtcttgctatgttgcccaggctggtctccaactcctggcctccagggatcctcccacttcggcctcccaaagtgctgggcttacaggtatgagccaccgcgcccgaccgataaacatttttgctaacagatttaaactagcgtctcctgtaccttttttctacacacctcgaccccagggctgcagttctgcctgcctgaggtcggatgcggtcggctgcagggcagggctccgggctgaagcgcagcgattcccgccgccgtgagggggcgctctgcgggcctcggcctcggcccttccggacgcccgcacaggtcgccggacccagagagtcggcccttaatagccccctcctggaagcgctaggtcccgaaactggccttcccccggggcccatctcccggctaatgtttaacccggccacactccacattatccacactcaggagaccggggtgaggtgagggtggaggctgggggaggtcacctccaaatcgccaacttccgagcctttgctccaggcaaacggccttcctacatcccttccaggtatcaacctacagctcctgcgcacctactatgtgcccatttccacaacaggtcatgagcacctaatatgtgttcattagaccaaaacatgagcatccattacgagtccacacctactatgtgtgcattcacccacaacgtcctgagcacctactatgtgtgcattctcttaaaatgcaatgagcatcgattgtgtgtccacataacccatgagcacctgctatgtgtccatctgggcaccagcccatgagcacctactatgtgtgcattctcttaaaatgcaatgagcatcgattgtgtgtccacataacccatgagcacctgctatgtgtccatctgggcaccagcccaggagcacctactatgtgccaagccttgtgcctgccatggatgccttgtgatcaagagccacgtgcttcgggctctggcggggaccgcagcatcaaatgcacgaatgaagacggacttaaaaccagcgtcagatgcctcacctctaggggatgctgattctgggatgcctttttcgtctcctaggctcctcaaggccaactgcgctgggaagagggggtgtccaacagcaggagggctgtttttttgaactacaatttgccagcatacagcagagcagcaagaagataacagggcggggggcacgggattagcccaaacaaaacacactcaagaacgcgagtctgtggttcaacacgaggcagaaaacagctgggccgggtgcggggcttctccctcgcgtgtatccgctcactgcactcgctgccctggccgcgggcgccgcgcagggtgctgatgtccaggagggatctagacctcccgcggcgctcgggctagtggacgcaggtggtcccaaatgctgggaccaagctaggaaccaagcggaagctcggattgctcggcatcgggcctcgtcgttattctaccgtgagggaaactgagaccgagggcacggcagggagtcgcccgccgtctcaccagcgtgaggggttgcgccgggccccgaaaactggtttgcgccgcccggcatcgggatccgggacctctgcccgccgggcgctgcctgcgcgttcctggaactgggctgggcggagaaatcagggcccgcagagaggcattcctgccgccttccccgccgcccggggccgcaggggggcctggccaaggtgaccccgcgggaggaggcgaggggtccccgcccgctccgccgccgcgacctcctccatcttcccggtctgcggggcttttcctctgggcccgcgcgcccggccccctcctcgggcttccccgagggcgggacgtctcgggctcccccgcccccccaggccacctcccggccgtgtcctagcgctgccctcgggccgggggcggggccgcggggggggggtggcgtgaggatggggccgaggaggacgcgcgcggctcggcgccccacttccctccctcacccctccctcccggtgcccgctccccgcggccgcgccgccctcccttccccctccctcggcccagcgccggctcccgccgccccctcccccgacgcgcacgccccgcctggcagctggcgccccgggcctggggccgcagcggtgagaggggttttgctgggagggagggagcgagcgagcgaggggaggggtggaggccgccccccgcgcccctcctcctcgccctcctccgcggccggcgggccctcctcccgccgcctccctcctccctcctcccgcccgcccgccctccctctaagacatccccgcacggcccggccgccgcggccaccttccctgcccgagctgcagatgtggcggagcggccgggcgccgggcggccgtgccaggggagcccgcgccccgtgaggcctcgcgccccggcccccgcccgtcccggcccctcccccgctcggctccccgcgccccccgaccgccggagcccgcagcccggatcccgaccgcccccgccgctgaggtaggaagccccccgggcgtcgcgccgtggggaccgggccggggcgggggggggggggcccgcctgtcgcgccggggctgcggggcccgagggtctcctcccccgctcgcgtccgcgccccgggccattgtgagccctcgccgaggcccccgcgttcgctcgctcgctggctcgcgcgctccctccctcgccggctccccggccgggtccctcgagctctcggtctttcttctccctccttccttccctccgtctggaggccgggccgagcagcgcccgggcccggggcgggcgcaaacttcagctgggaagttgggcggccgcggtggggggcgtgcggcgaggtgagaggggggtacccggagcctgggcatgaagttgtccggggcagccgcccctcctctcggccgcgccggggctgctgctaggaagggctttggaaggtgcctcctcccttggccgggagagtctccctcctgctgcccctcgcaagcccgggtccttccttggacctcgggaaggggcgtccctggggggtcaggactgggagtttgggacaagtcaggcacttgttactcccctgcggtccgggtggacgcaggcgaccggcctggcagggaggagatggcaaggggtccatactcgccggagggcgggtctggagcgggtggaggagggggcgaggcaggtgcatcccgagggaggagaagcacgcacagcttccccgctggccccctgggatggggctggaatccaggctggcacctggaggccttggcatgctgccctgcccagcagggtactcgggccacagcagggcagcgtgcagcctgtctgcctgtccaggagggcccgcccagcctggccagagggtggccgggaagcaatggtttcaaggagttgcccagccctgccctggggcctgggaagctggaagggatgctgggaggggccctgggcccccagccatcacagcccaggatcttggctctggagggaacgcttgacactgagggggcagccaggccggctggggacctggccaaggcctgggcttggtctgggccatggaaagggcctgggccatggttcttggaggctggcaccctgggtagtaggccgccatcctgcgtgtcctggcatcctggagggaaggtggggccagcctgcggctggggaggaagcccagagacactgcgcttcggagggccttccagcccccgggctcaggggaggggaaactggccccttgggtcacccctccccaagccccattctggtgccacagtgccacagctgtccaggcccagcccacacacccatcccgggtgacctcggacctccccctctgcttctccttctccccagagcccaggctgggcctcctagctggcctggcctgcacagggggaggggctgcacctgggaggcccctcccaggacaccctttgccaagctccagcctggcccatttcactgcccacctccagctcaacttggccctgtctgcagccagccaagcaggagacagtgccagggacttgggatggtgttttggggggtgtgcggaccccttggaagcaaccctgtttttcttagcctttcctcctccccctcctttccggagctgccattagcgctgaccccctgtgcctgcccgcccttccctgtctgtgacctttgacctttggtgttaaatccctccagctggggctcttcggcccctgagtgaccctggcccaggccccctggggagttctctccttgctcctggctctctacacagggacacctgccagtccctccctcaccaatggggagggggtgccctgggaagccagacagtgagtcaccccacttccaggcaccgctgcttttggggtcagtggcttctggggattggctggagcccagtcacagcttggagggtgaccggggaaagcccctggcctgggagtctcctgccctgggttcaagtcttggctccaccaccaacttccagtggtccttgggtcagactcctcccctctcccggccttgtctatgaaaccaaggggtcagaccaggtgagctcccagagtccatgagaagcctgggtggaggggggtcagggggaggaaagagggtgtaaatccagcaaaagccaactctcaattatccgagggtggagcccggatgaataactggatgccacagacatcccaaaacctcattgcaaacaatcgtgtgaaccgcgtccccccaaagcttttgtttctgagaaacccagctgcaactgggtagccacagcgatttcttcccccgcctgaactccccttgcagggaggacaagtagagggctgagagtgaacaggccggagggaaaacaaaggtctcccagggccccttcttggggcctggagggaggcctggaccccatttccaaggcccccactctcccctccaccctccttcccggcctggccttggccccgggcggtgggagtgtcctctcaccacctaatcctctcagggtctgggcagccatataggaggaagaatgtgttttcccggcaacaatttcccatgtgtatttctagccacccgctccactcgcctggaatctgaattccccacttggaccagggggtgagggccagtgccggccagggtttggggcaatctctggatgagggagggtggcgacagctgtgactgggggaccagatgtggagctcttgtggggcatcttgggggggctcctggggaggcacttttgtgggtcgcctggcctgacccccagccccagaggctgcctccgaaggttcctgcctctaaggggaggcccaggggtctctggcacctaaggaggaaattgattccatgggagaggccctgtgctgggtggaattggggcgggggtggctgcagagaaaagtgtcccctgaatcccttcctctcctcatggctataattgttactttatttcacagcaggtgactgagaccacaggggaaccccggaaggtcctgggtggtcttcccctcacccagataaatgcccttctcaggggtagggggcatccccagcttggcggggctgtgtattgagcagtaagagaccctctccctgctggctaggggatctgtgggaccagctgaaagatgctctccaccctctgcctaagttgcctcccttcccaggggctatgaaagggtccacagagatgggttgaggccctgatgtgtatctgggggttcacgtctctgggaacttgcgccctgccccagcctgctgccagccctgggtgtggggaccacagccctagcgagtctcccgggccacatctgcctctcagtggtttctgaggtggccgcctccgccccaccctggtgaattctaagtcaggcgtggctgggggcggggactccgcgcttccaacaagcacctctagtactctgctggggggccagcgtgggggcactgctttgatcccagggactggagagggatcatggtgatgatggtggcagggtctgcagggcacagcctggaggagacccaggtttctctcctggctccggcttagcccctgggtgaggctgggcaggcacggaggccgggtactcgccttccactcccccactcccccagatgggctggaggattctggttagctggtggccaggctaagtgggcctggggggcatggagatgggaagtgattccagctgaggggtgggggcttcccatctgccccagcagcccctgctgggggatgggtgggggctgagactcttccagttcgatggctggggggcgggtgacttgggctcctcgtgccctttgtcttcggtgcttgagaggccaggtagtgcccaccgcagggaggggccggcctgtgagtgtcacatgtgcgtgcacacggactccagccttggcagatggctgccggggaagggacggagacccagccctggccccttcctccagtcatggccaagggcgggtgggaagccagcagaggccccaggagaccgctgagtggactgagtcagcccccggccgggagcctccggaaaacagtcctgcccgtcacatggagggtccccaccgctggcacagcacgctcccagggcagcctcgcttggaccctggtagtcaagaggtcgtcggaggccggtggggggaaactgaggctctgagacatttgagggtttggcccgaggtcactcccaatcggggaagaacagaggggaactggagtctggggctgtctggccctgacccctgaaatgtcggtttagcctgggaatccccccagctccactcctgccccccacgtccactgcaagggcatgacgggggccaacgtgtctggaagaagcctctccccttccctgcatcgtctgcctggggctgtctagcaagtcccggcctgcctgggccagttctcccctgggccactcccaccttcatccagagcccccattccccaccccaacttccaggcagaccgactctgagctgggatgtcccctccccgcaaggctgtaggggcctccattgtcctccctattctgaagtccccccaaccctgtgctggtgctcgtctccctgccagccccggcctcccccagcaccccccggagcacctagtggtcaccctgcttggttctagggccactgggccccgagggcctggagccaccaggcctggcagatcctgccagtgggtgttcccctttggaaggaaaaggacctcgatggctttggaggctgtccccggcttctggacttgctttcttccagagtaggcgagcagagaggggcgggtggctgaggaggagggcatgggctggagtcctgtgtgtgcggtgccctgctgggcctgctcttgcccagctatctggggctgggggccagggctgggagggcgtggcaggagatggagctgggggggatctgggcccttcccaccatcccagctggccagggtggttcctaggggccaccacacccttgtccagctctgttcctgggtcccttgcctgggacagggagaaagaggcatctatgtcaggagaccagcccctgcttctagccttgaccttgggcaagtcacattcctctttgggcacgaacccctccatacctacccctcccctcctcacttgggggtaaaggcgggaatgtctgtcgagtgaatgaatacatgaatgagacggactcattcgcggagtgccaggtgttgggatatgtgaagggcaggtaccactgtgccacctaagatgagtggttggggttgttggagcttcggctgtcctctcagcaggccccctcctgtggatggggaaacccaggcctagttttctcattctgggttccctgcctcactgcccagttcactctggtggatggggtgggctccgtgccaggggccgtgggaactggggcaggggtctgctggtgaggccttctcttcagtagccacagcgggtttggagctgcccggcgtcccagacatgtcccggcccactcccaggctcccttcttggaaggaggctctggataccagggccagtgggaggcctggggctgaaggtcggcgctgtgtacaccacgctgtgcacaggtgacactggcttcagtgatgcattggcaaggacttggacccgggacagcctgcctccagcgggggtggacagaggcaagtctttgcccagcaggccctcaggtacctggacccacagcctgtgtgcagctccagaaaccgaggctggggagggtgaaccagggagcacttggtggaggagggggcagaaggggatggtggctggaggaaagagaacaggggggcatggatggtggtgagggaggagctggcacctgggagcatcaggttcccagggggcaggggatcctgaggaaggggggtgccaaaggagagggcctggggcaggaggctctgggctgagagagcaggtggcactcttctgtgtagagccctctgtggctccccagtgccctctaggttctgtcccagcctctctgaggggcctctttctctcctgcctcctcgtctactccatgactggtagggtcactgcagatcagccgggccatagcctctggtcctctgtggcactgggctttggggtctgctggcgaacccagctgtgccccttgctggctgtgacagtggcaggtttccccacatggaaaatggggaaaatggcatccattcgcggggtcatcagggtgatggactgtgtgcagcaggcatgctgaccgggcgccgacccgcagggctcccacctccccaaggctcttcaccccatatccatgaggctgacccggatctgtgcccaaccccctgcaggagcagccccccccctacactgtttctcccaccccaccttggtcggggcaccctcaaggtccggttcgatctagcagggcctggcgttggaatgcatgaatgcgtggttggagaaccgaggcaggagggcaggccaaggtccaccgcccgccttacccactcctgctctcggagttggcgggtgccgttcccagtggacctggtacctggccccaggcaggggaggcgtgggccacgggcctgccccgaccccccaggacttaggagctccttgtgggatctgcctgcagccaggcgtggcttgggaggcgcggtgtttccttcgctctggggacccggcctcatccctgctctcccccagaagccaaggctcctgagtcctggccccgacactggggcaaggggttactgtgatgtcctgtgtgtgccacatttgtgcacaggtgtctgtacatccgggggtgctgtgggtgcctgctcatgtcctgtgctacactggcccatccctttgctggcctcagatagctctggctgggtctgctgagaatggcagtgccgcctggcagggcctgggctgtctgtgccccagccttgctgggcgtgcatccctgtctcgctccctggtgccagcccctcccagggatttgggtggcagggcccagtgctctggtcccctcccctcccagcccgggtgggtgggcaggtgtgggggctgcggggcgggctttcctctggctggggcccaggtgcaggcggtgatcatagctccaagcacccccccaaagctgggcagacaggaaaataccagacatagttgtgcaaaggtgcagcagcgggcaggcagcgggggggtggaggccactgcagcaggggcccggagccaccaggatggggaggcctctgtgccaggccggccctgcagctggactgccatggccatctgtgtgagtgtgcgtgtgtgtgccggggctcccggagcccggtgtcaccctccctgctggcgttggagaaggaagtgcctctggtggggcatctcctaggaagcccgggctggtgcaggccagggaagccctccggcccgtcttccagcttcagctctgcctgaattatctgggtgaccttggcaggcccaagttgctgtgcagggaacccccagcctggggccggaaacaagaatcctttaggttaccagtagctggcagcttctttatggcaggcatgaggacaaggccctcccttgcaagatgccctgagtcccagggaccattgccgtggtgtctgttacctacaaggaaaccaaggctcagagacagcagggcctttctgagttcccacagccaggggtggcacagggggctgtaaccaggcagcctggccctggggcacactctgtgaacacgcagaaaaaagatccctggcacatcccatcttcaggtgctttcccgaggaccccacggcagagggcagaggtcagccctggctgggtcacctcggaccccttgtgttcccaccccgggagggggtctgccctcccaaaaggtccgggggtgctggctgagtgccccgtcttgggagggggaggggctgcctactgagccaaaggttcccagggacggtgaatcccccactcttccaggaagtgccgcctgccctggcccctctcctgggatctgctgggccaggcctcaggataagctcctccccctccagtcctgggaggaggcctgtctgcggccagctccttccagggttgatcaggccttcccggggccttgtagtgctctttctttgatgcagttgggctctggaaggtggttagggccagctgtggtcactccccaggattgaagaggcctgaggttctttgaggggcataggcttgtttagggtgcacgctggctggcaggtggcagagcccaggttctcctggttcagggtgagactgcagtggcatagaggggatggccagtccccactcagctgccctcacagcggtagatgggccaaaggctatggactcatgcacactggcgacgattcattcagcacgttttattaagcacctactatgtgccaggcactgttctccgtgctgaacgttacggacgaaggagaagcactcaatagtgattggatgtgcagcactgcattggtttctccctgaaacccaacatgggggtcctatataatcccatttgggatgagggggatgaggcgcagactgaagagacacgcaaagggagtagcagagccgggtggggccccagatttcgagtccggttctgttgcctggtcaggaaggggggccctgagaggacgagccctcctgcctggggcccccagcaggccctgcccctgcccgccagcccctgctgctgggcggccaaggagggtggagctcttggccagagcagggagccgcagctggttcccaggaatctggggctgtggggccgtttgctttggcagcagatctgccctcggctctccaagcctcctggtgggccccccaccccagccagcccctccagcgcccacccactgcctgctctgctatccctcctagccccacaagtccctgggcggggagggggtaccaagcctgagcccctgacataggaagggccaatagtgaacatggcttctggacttacctggggttgaaacccagctctgccacggacaagctgtgggaccttggatgggtcacttcactcccctgagcctcagtttttgcatctgtaaaatggggatgaaacagcacctgccttcacagtacccgcacctggctatgggtactgtcctcatgctgcttgcccgtggcttctggttgtgggtttgccacctacttgtgcagcctgggctggatgcctcccccttcagccctcagtttccccatctgtaagaccatactgctgaagtgatggttccagtaatagactcagggacacccacagaccagggtttctctgactggttcaggagtgaccagggactcacttcctctttctgttaaattagaagatgacgggctgggcgtggtggctcctgcctgtaatcctagcactttgggaggcagagacaggaggatggcttgagtccaggagatcgagaccagcctggatgacacagggagacccccccatctctgcaaaataaaaaatttaaaaatgagctgggtgtggtggtggtgcacctgtggtcctagctgctctgcaggctgaggcaggaggatctcttgagcctcggcggcagttagccatgaccacgccactgcagtccagcctgggagacagagcaagactctgtgtcttaaaaaaaaaaaaaaaaaaaaaaaaaaaggccagacttggtggctcacgcctgtaatcccagcactttgggaggccgaggtgggcggatcacgaggtcaggatatcgagaccatcctggctaacacggtgaaaccctatctctactaaaaaaatacacacaaaaaaattagccgggtgtggtggtgggcgcctgtagtcccagcaactcaggaggctgaggcaggagaatgctgtgaacctgggaggcggagcttgcagtgagctgagatcgtgccactgcactccagcctgggtgacagagtgagactccatctcaaaaaagaaacaaacaaaaaaaacaaaggtgaccacatagacttctgagagatgcatcttgaggccttgtctccaagttctcagctaaatggccactgctgaccaaaagcgcactcgcaggacactccaaggcaaggggtgttcctcacattgcccttgacaacactgccacgctggtcactcacctgaccccatgctgctgggagcggggcagggatgcagccccatcttacagaggacccgcttccttctgcaaagagaccaagtggttctcagggtgggtgcacacagccccccagtgcaccctgcacctccacaggcttagggcctgccagccaccctcccccaagcaggaaaggaggagctttttttgttgttttttgagacaggccggagtgcagtggtgtgatctcggcttactgcagcctcaaactccccaggctcaggcgatcctcccacctcagcctcccgagtagctgggaccacaggtccctgcttccacgcccagctatttttttttttttttttttttccgagatggagtctcactccgtcgcccaggctggagtgcagtggcgcgatctcagctcactgcaacttctgcctccctggttcaagcgattctcctgcctcagcctcccgggtagctggaattacagacacctgccaccacgcccggctaattttcgtatttttagtagagagagcgtttcgccatgttggccaggctggtctggaactcctgacctcaggtggtccgccctcggcctcccaaagtgctgggattacaggcatgagccaccgtgcccggccaccggctgatttttttacttcaaacgggatttttccatgttgcccaggctggtgtagaactcctgcactcaagggattctcctgcctcggcctcccaatgtgctgggcttacaggcgtcagccaccgcgcctggcctagaaggagctttattcagagcaggactccaaccagctccctattagcctagtgatctcaagcctcagtttccccatctgtgagatcgggaaaatgacagcagctactgccaggcagggttgtagaggggtcattgaatccatggacagatgggcctgacacgtggtcagtacctaatggtcctttaccccctctggtgtatgacccaccccaggccaaggggccctggaagagactgtcttttccgggccttagtttccctgagtgtgctgggtcgccccgtgccttccagtagggagggtggggacagtggccggccccgcctgccagggcgggatccttggctacctggcctggccggggactgcgggcggggggccgggtggctccgccagcgctgcagctgggggccgtctgctcgggctgcggtcgggcacacaatagcagccattgtctcggccagggtggcggggggcccgcccagcccaccctccgggtgacccccgccctgcggtgggtgggaagggcagggcccggtcccccgaagcccccgccgtcccggtggtccccgcggccgcccccgcgcgcttcctccctcgccgcagccgcttcctcccgctcgccccgctctaattagttccttttgcagctggaggagccgcgcagcggccggttccgcggccacccccaccccccaccgacaaccccagccctcgccccaacccctgggcccttgcgtgtgggggcgctgccctgggcgcatcccaggctgagtgctcgagagacgcggccctgggctctgtgcaccctccacgctgcgctgtcccaccggggggaaactgaggaacggaaggctccaccaggaggcgcagaggggcgtggggccggcgggccttgcgctgcgcccggggagcatccacggggtgcccccacctgaccgagagccggctcctgccctcgggaccccgcagtaattagcacccaggcctctggctgagcttgtccagagccaggctgtcggccttacgctggggagagccacggccacccgctcatgggcactcactcagggttccctggttgcaggcccgctgctccccgctctgggcctccgaggctttcaggagagcaggaacctagctctcgcctgcccccttcacccagccgggaacaaaagcacagagcagagcccagaactggctgctgccggtcggggcgggggtggaaggggaggctttaagcctggccaaggtcagaactgaagcagggtcactgaccgtctcccctctggggtggggcctccattggaggaaaaactctgggtggggagggcctggaacagggatgctgggaggtgtagggctgggggcagctccttcctttcccgggggcagggacgcaggccgtgtgccgggctctggcctgcattggaatgaacccctgcctccctggcaggacccagtggcaggaagtgtgtgggggtgcccctggggactggacctgctgatgaagggggtgcattggagtcctccctctggctttgggccgtgtggctggccccacctggggagacaggctcctcctggggaagtgtcccctgcaggccctaagaacaaggtgactcagggcccctggctccccgagtccccatctgtcctgggaaggcagtggggcaggtgccaaaggatgttgcttgggcagcgctgccagtgagtgtccccgtcagctggaattcccagttcccaaaccatcctgcccttgtggtccccttctccggaagggtgggggtgggggtgaggacagaggctgtggggaggcctgtggccccaggccagccaagggaccaggccaccagcccttcctggctcctgaattcttcatcagcataaatatttacttccttcctccccgtccaggcttccagcacagaggagcttcggggaggctggattgcgcctgtgtctaaaaataaacaggtagcaggacgatagacacacagatagacagatggaactggcaggggttcaggcagagggcaactccctgtccagccagagaaacagtggaggggaccctggtccatccatcactgtcacccacccacctgctagcgggggtgtggtccctaccccaccgcatctctgggagcccctggcccatgcatggcctgggaggcaaattcaaacaatctgacagctccaacaggggcgaatcgcagacctaggtcccacggcctagtgcagctgccctggctctgatgatgcagccttgggagaggtgggcagcccccctgtgctgagacccccgtgtcagccatgttggggtggggtctggggatgtgtccctagaagcagaggatctccagtgaaggggggaccattttatgccctacttgcttggagagtcagggcagaaggggaggacgtgggagctgccttcctgtcctgccctgtggacagcatctctccccactcacaggctatgctagcccccagggaaacacacgggggcatatccaaagtatttcaccatgtagtagttatgtccaccatggccgccctttggtattgagtaaagaccccaataccgcgaaagacgggatctcacagcgtgattgtgcggcagttagattttcaagttgtaataatcccaatgaacaaacgcaaggaaatgtcgtgtttaaccgcgtaggaaaagattgctgctctgaatgtgaagtttgggtttagaatgaagtgttgaccttgttcttgggtcggtggatactgttagatcatttgcatgtgaggaaaattacaccaggtggggcgaggtggctcacacctgtaatcacagcactttgggaggccgaggtgggcagatcacctgaggtcaggagtttgagaccagcctggccaacatggtgaaacgctgtcgctactaaaaatagaaaaattagctgggtgtgatggtgtacacctgtaatcccagctacttgggaggctgaggcaggacaatcgcttgaactcgggaggcagaggttgcagtgagcccagatcacaccactgcactccagcctgggtgactgagagactccatttccaaaaagaaaatgaaaattaaaccagtgagaaattctaagaaaaatgatgaaaattacagcatgggaagtgatactaaaagaataccatctccagtaaaaaataatttctacatatttatatattaaccgccagatacagctggtcaactccaccaaccctgccccagctggccaggccaggccacaatccccagctgccccctggtggcgacccagcgccctggggctccctggcttgcgatgcctctcctctaggcctctgcagggagggcggtggggcccctggctgtgcccactttctcggtttgcctggtgcgagttccttggtggtgagcgtggctacctgccggccatttcagaggatgctccttgccccctggcctggttctagatctttggggtcaaacagggcgggagtccggagcatggctcctgctctgtcagaaaaggctgttaggacacggctagccagttcccgggagatctggcttcaggccttgaatcttgttgggaacaggccccccaaaatctggctgtaaactagccccaaaactggccataaataaaatctctgcagcgctgtgacatgttcatgatggccatgacgcccacgctggaaggttgtaggtttaccagaatgagggcaaggaacacctggcccacccagggcggaaaaactgcttaaaagcgtttggctttttgtttgtttgtttgtttttgagacggagtcttgctctgtcgcccaggctggagtgcagtggtgcgatctcggctcactgcaagctctgcgtcccgggttcacaccattctcctgcctcagcctcccgagtagctgggactacaggcgcccgccaccacacctggctaatttttttttttgttatttaatagagttggggtttcagcgtgttagccaggatggtctctatctcctgacctcgtgatctccccgccttggcctcccaaagtgctgggattacaggtgtgagttactgcgcccggccacaggcgttcttgaaccacaaacaatggcatgagtgatctgtgccttaaggacacgctcctgctgcagataactagccagacccatccctttatttcccataaggaatactttcagttagtctataatctatagaaactatgctaatgactggcttgctgtcaataaatacgtgggtaaatctctgttcaaggctctcagctctgaaggctgtgagacccctgatttcccaccccacaccgctatatttctgcgtatgtgtctttaattcctctagcgccgccggattagtctcccgaccgagctggtcttggcaaatctgatagtttttccacttctgagctctgcgatctgaggcgatgcctgtaaaagacgcagtttcgccaagcgtggtggctcaggcatgtagtcccagcgttttgggaggccaaggcaggaggatcgcttgaggccaggagttcgagatcagtttgggcaacatggagagacccgatctctacaaaaaagaaaatttttttttttaattagccaggagcggtgcctgcctgtagtcccagctaccagggaggctgaggtgggaggatcgcttgagcctaggaggtcgaggctgcagtgagctatgattgtgccacttgcactccagcctgagtgacagagcgagactctgtcagcaaataaaattcagtttcatggcaaaatgaagaatgtgagctttgtcttccccaagagactcatgggaagcagatgcggaatctctgaggaggctgttggctctccccccatgatagctgccggccaggtcgctcggagggtctccctacccaggagacaacctcacactgccccctgctcctgctcctgttagactgtcatgagtacagcccgaggagaagcctggggtctcagtgccacagcacagctcctgtccttccccaggttcctgcgtgaagaccagctgggagcccactgcctgctgccacctccaactccggccccctcaccatgcactccctggacgagccgctcgacctgaagctgagtatcaccaagctccgggcggcaagagagaagcgggagaggacgctgggtgtggtccggccccgtgctctgcacagggagctgggcctggtggatgacagccccacacctggctctccaggctccccgccctcaggtactggccctgggcagggcagggggacttagccctgatccagtcatggtgacagggagaatggccaagtgtgtccaccagcatgtagctgcagcccctctcggcttccggttcatgggaagcccgcacgcttgtccttccatccgcccagcatcgtatgtctgcagggaggtgggagctgcagtgcccagctcacgtggctggcacacgatgcaaactgaggcctctaggcagatctggaacagagctggtcgggcaaccaggcattcagaaggagcggcagtagtcccaggacctgcaccctaggctgtggggtggtgccgctggccaacctgggcagtagaggctgggtctgagcccaggaggtgcctctcagggattcccggtgcttgggcccagggtggtgggcaccacttctgccctgcctccaagagcagagtcacccgaaaaccagattcaccgcttgtctgaaggggaaggctatgggagcagcccagcccgaacctgccactttacagaagggaacactgaggcaggaaggggcctgggaaaagctagaaaggttcctacctgcccgtctgacagggacccaggggccctgggttcgagtcctgttctgttattaaccctgcgtgccagaccattcccgtctgcaaagcgggcacttcccccctccccggctcacgggggccaagctctggcggctggtaaagctcagaggtggtgggtggtgtcacacacctgtcagctccacaggctgctcctcacattcgtgtggtctgggggcatggctggtgtctgctcccaaggtcacagtgggggttcggaggcaggagtacctggcccactgggactctacactccagcacaccctgaactgtgcctctccctcaggcttcctgctgaactccaagttccccgagaaggtggagggacgcttttcagcagcccctctcgtggacctcagcctgtcaccaccatctgggctggactcccccaatggcagcagctcgctgtcccccgagcgccagggcaacggggacctgcctccagtgcccagtgcctcggtaaggaggggtgagagttccggagagaggggtggactggtttcctggggttgccatgacaaagtaccccaacactgagtggtttaaaaaacagatgtgttacccctcataattctggaggctggagtctacctggaaggctctaggggagaaccttccctgcctctctcctgccttctggcagcttctggaaatgcctggcactctagcctggtagctgcttcactccaggctctgccctgtcttcacacggtctttgtccctctgtgtccgaatctctctctggtttctcttataaagacaccagtcatggccgggcacggtggctcacacctgtaaccccagcactttaggaggctaaagtgggaagatcgcttgagcccaggagttcaaaactagcctgggcaacatagcaagaccccatctctatttatttttttgagacagagtcttgcttcattgcccaggctggaggccagtggcccggatctcagctcactgcaacctccgcctcccgggttcaagcgattctcctgcctcagcctcccaagctgggactacaggtacacaccatcacacctggctacttttgtatttttagtagagacagggtttctccatgttggtcaggctggtcttgaactcctgacctcaactgatccgcccatctcggcctcccaaagtgctgggattacaggcgtgagccactgtgcccggccttttttttttttttttttaaacagggtctagctctgtcacccaggctggagtgcagtggcatgatctcggctcactgcaacctctgcctcccaggttcaagcaattctcctgcctcagcctcccaaatagctgagattacaggcatgtgccatcacgcctggctaatttttgtatttttagcagacatggggtttcaccatattggccaggctgatcttgaactcctgacgtcaagtgatccgcccacctcagcctcccaaagtgctgagattacaggcgtgagccaccgcacctggctatatattttttttaattaagaaaataaaaatttaaaacacaccagtcactgggtgttgggcccaccctaatctagtgtgacctcatgttaacttgattacatctgcaaagatcctagttccaaataaggccacatgcacaggtaggggctggggagaagaggacctgaatgtctctgtttggggacaccattcagtccactaccgatgggacggggggctctgggccagcaggaccttgactagccctcccctcgcaccccaggacttccagccactgcgctatttggatggtgtccccagctccttccagttcttcctgcccctcggctccgggggggccctgcacctgcctgcctcctccttccttacccctcccaaggacaagtgcctctcgccagacctgcccctgcccaagcagctggtgtgtcgctgggccaaggtgagtgggggccagcaagagtagtgtggagtctggggcaggtcaccccgcatgggctcagaacacttcccatcctccgcagtgtaaccagctctttgagctcctgcaagacctggtggaccatgtcaacgattaccatgtcaagcccgagaaggatgcggggtactgctgccactgggagggctgcgcccgccatggccgaggtttcaacgccaggtgaggtgggggagagaggggtagagggaggactggggtctccagtgagctgagccgtgccccccgccctccctggagcaggtacaagatgctcatccacatccgcacacacaccaacgagaagccacaccgctgtccgacctgcagcaagagcttctcccgcctggagaacctgaagatccacaaccggtcgcacacaggtaagaggccggggccgggcggcttggcccatgaagggggcgctcagctgagaccggctgggcaggtccccagggggaggggactgttaagtaaatcccgggcctcagagataagggttgatgtcatcgcccaggggtcccttttccaatgcagtttgctaggggaagcatcccctgggggtcagacccccacccagcacctgctcttggagcaccaatgccatttcctggttcccgtgggtatcttctgactaatgccacctctgtgatcgcagaggccaggtcggcttcactcctcactacagcccaggcccataccaggacagctctggttgtcagagccacagacataattttacatttcctaatcgctgcataaaacacagcaaaaataaatgggtgaaattaattgtaatatggttcgttgaccccggtacatccaacgtgttatcaattcattattaaagacaaatcagtgagatattgaagttcttcatttcatgacaaagcctcaaggagctgatgtgtatgttttttcctggtgtttatttcaccctggcagcacatctccaggtggagagccatgtatcaggaggtcagtcactacatgtggccccctgctctggccagggcagcagaagatgcctggtgaaccttcagccatttgttgagtgagggcagtagcgcccaggcagcactccctgtggccaggcccacgctgggcgcctcgtgccaggatgtgatctccaaggccatggtgtcttttttttcttgagacagactcactctgtcacccaggctggagtgcagtggcatgatcttggcccactgcaacctctgcctcccaggttcaagtgattctcctgcctcagcctctgaggtagctgggattacaggcacctgccaccacacccagctagttttcgtagttttagtagagacggggtctcaccatgttggccctgctggtctggaactcctggcctcaagtgatctgcctgccttggcctcccaaagtgctgaaattacaggcgtgagccaccgggcccggcctccaaggccatgttctgctgctgaaaggcacatcctctgtagcagagggtgcagggcgaggctaggcagagctggagtcaaccaggctgagttttcagcctctgtgccctgcctgggggcagatctcatgccatgtgctggggatgccccctgcccccagaattggggcatctatgttcccagggagtgcttggcccggggaaatgttgagtgcatggggtgagacccaggaaggggagagacccctcatggcggcactgcactgcaccaccctgcaggtgagaagccctacgtctgcccctacgagggctgcaacaagcgctattccaactccagtgaccgctttaagcacacgcgcacccactatgtggacaagccctactactgcaagatgcccggctgccacaagcgctacacggaccccagctcactgcgcaagcacatcaaggcccatggccactttgtgtcccacgagcagcaagagctcctgcagctgcgcccaccccccaagccgccactgcccgcccccgacggcggcccctatgtcagtggggcccagatcatcatccccaacccagctgccctctttggaggccctggcctgcccggcttacccctacccctggcccccggcccccttgacctcagtgccctggcctgtggcaacggtgggggcagtgggggtggggggggcatgggccctgggctgccaggccccgtcctgcctctcaatctggccaagaacccgctgctgccctcgccctttggggctggcggactgggcttgcctgtggtctccctccttgctggcgcagctggtggcaaggccgagggggagaaggggcgtgggtcggtgcccaccagggccctgggcatggagggccacaagacgccccttgaaaggacggagagcagctgctcccggccaagccccgatggactccccctgctgccaggcaccgtgctggacctgtccacgggcgtcaactcagctgccagcagcccagaggcgttggcccctggctgggtggtcatcccgccgggctcggtgctgctcaaaccggctgtggtgaactgagcccatcctgcggacagttgtggtgcccccccggcagctcccggcactgcccccgacgaacggaaactcttctgtgaaatagcaataatgtcctactgcccgggcagccccagcccagcccgccgggagcaaggatggtgctaggtcattcatggctggcctcccagcccccgggtggggacctggcctgtcatgcagggagagctgtgctcctgggtgctgaagcctcgctcctgtctgtcccccaccacctggccctcagcttctgagaggctttcccctgcccgacctcctcccgtttccctctcccaccctggcacctccctcacctagtgaccacccatggcaagttgccctctcccagcagagggggtgggtggggtggcatctgccctccctgctagcaccaggctcccccttcctgagaggagcccccagggaccagaggcctgcccttccctcctaggcttacccagcccctgccctgggggctccttggacccctttccctctgaccctgcctccagagggaaagcaagacagatgcaggcccctgcaaagccccaggtagaagcatgccccccaggacaaggcgcctcccactagttaggaggaggcccgctctgcagccgccgtcctcaccccaggccaggcctgcagtaccagacgggatagctggccactccacccctgcaccccagggtctcctccctctaccttttggggcaccctgggagcgtgggaagcaggtccgagggcccctgagctggcaaggggaggtgccaggccagctgtggtgccaagatactgagtgacctgggccctggctcagggagcatgtggggccaggcccagcgccccgtcttcctccttctacccccgctgggcctggcctgggcagcgccccctgcagaggcctttgggtccttggtcctgtaacaggaagggggaggctggctggggacgaccgaccacaggctgggacacagctcctggtctgggggctccaagtgacagcatgcaggggagggggctcccagtcagtgctgtgttgggagctttctggaggctgtggactgaaggccttgagggaagcagtggctggaggagggtgctggacccatgacacgttgcttcctctggcttttccctgctgggccgctttctcagaggcacttccccacccctaacacccagtgggcccccccaggttctgtgccactcagagggaccctggcaggggccagaaccacttaagggtggtgctggagggccttgtgccccagtcccatcccaggacgccctgagggatggacgcagccatgcaccccccatctggggcctctccctgctccctctcccacctggcagctgggagttctggcttctaggcctgccctgtcaccaggcctctgagtggccaggcccttccacctccccatctgtaaaacgaggcagctgcccggacagccttggggtccttagtggccctgcaggtcctctggcagctctgctgaccccaccctctcccggactgcccttctgtcccagaggggtcaccctgacccggcccaccttgccactgggctttggactccagccctgacagggcccagccacactggctctgcccctcgaaggggctatgagcaaggtaggagggagctggtctcctttcttcgggccccacccaggccctgagcaccccccacccctgtgagggccccaggccttaagtccctggcggggtcatgggtttgcgacttgagcagagcggaggaacagggcactggaaggccgacgagctcagcatgcgactcggtgacggaccaggctcggcagggccggtgtactttttgtggttgtcattggtgtgttgttgcacattccaggacgtcagtattttaacaggttctaagtgcctttctatcgtagcttatgttttcctcctcttggctccattgctgttagcatagagttttaaaaaaagagataagctaatgactataacaatatattcctccatgggagaggaagtttataaagaaacaataaaagtgagttgcaaagatggcttgtatgtcgtggatgtgccaggaacccggccctgacatgaggccaccactgccctgagcccctgcaggcctgatccgggctttctccccgaccctgcaggtgcccctccctctcaatctgccgcttagagcaggaactggaaggttgggaaggaggtaggtgctgagggcgcacaggtgacaggaactgagacagaagattccaggcggagcatcccaaggtccaagtcctcagcccactactgcccgctgcggctttggagagtggtgggcaaaggcccttctccccccagccacattctggggtactgtgcccagattactgaggtgctaggttcaaacctgccccagggacagggtggctgccgacaagagctctggggccaggagaccgccaccccgtgggaggggcaggggcgctatgggagggagcctcaccctggcacgggtgctgtggaagcaggagcggctgcatcctgtacgtgacaggactcagctggagcccactggctggctgcccgccaaccttacccagcccggcccttctgggctgttaaaggctgctgcctccccatctccagcacccacagccctgcaaccggcaggaggagcaacctgccttctggaatctggacacatgcaaacgagaaatgcagaaaagaaatttattaccaagctataaattagaggcggcggggtgggcggggggagccgagcagtcacgtatggggcatctgccctttttctctgtcctcctgggcctggattttgagttcctcatccaggcgctcctttgcgcggaccacctagtgggtcacggataatcaggccgggaggccaagcctccgccccataccccttgcccacatgggatggcctattcccatcagcccaggtccattttttgaagggcagtgggtggataccaatgcttccttcagtggcaccccagggtcggggtggcctggggagacagagctgggctgcagggcccagcgcatgctgtgacctctgtgagctgagagctgtttctagcaccccacccatgggggctcctgctccttcgaagtcccagctgctgggagggagggctctatctggggtgacacagcctgagtggctggaccccgcaaagctgaagcagtcagaggggtggcagttcagggggcctccctgaggctggggcaccatgggaaagcctggcacagttttctgtgtgccaagcccttagctggccagctcccccaactaggaattgagccccaggtgagaagaaggggtcccatgacttcattcctcccagaatcaaagaccactcacctttgactgcaggtagaaggagccacccacggatttatcattcaccttaaataagtgttcatagttctgcagaggagaggggacgggtgagagggctgcagactgcaggcaagagatgttgggcaggctatgtggggccacgtgagagaggcaacaggactcctctccaccctgtgtgccacacccagctgttgtggccactgagaggcagagatggggacgggtaccctggagggcaactgagctgctactggaaggcactctttgtctctagactgtcctgcctcaggcctaaaacttcacgagcaacagtggctcccgaaagttggagtccgagctgggtgcagctgcagcctccacatcggacctccctggccaggcctcccttcactcttcccaccctggcagcctctccctctcaaactttggggtggcccagtggcctcaccttctggacctcctcagggctcagcttggacacgttgagaatctgctgtgcctcctggaggctgaggccggagaggttggaagcggctgcagaccggtgtccagcgcgtcctcgggcatcagctgcggcccggctggctgtgtggacatgtgggtgatcgctcagtcctcagcagcccacacttcaccctgggccttccgagttggtggctcacccctgccaccagcacaggatgagagacacagggacaggtggctaggagctgcctcttctccaggagtggtttcctttttagggggtagaggctgggaaagtgaggacagacgtgcctcactggagggtaagggcaggatctgaccgctaatcctggctcctggtccccaacctagaccatgagatgaccctgtcccccaacccccatatcccaggggaacagcaaattggggagctttaggctacgatggagactgtatagtggggctgcgggcatgagagggctctgcaggggcccagctgcccacctgtcacctagaccaccaaagccactgccttgggtgacctctcccctttcagtgaccccagaacctagaatcaggagctgctaaacttttcctaaaggctcagagagtagctattttaggctttgcgggctaatgagcctacactggaaccattcaactctgccttgaaagcagcctgtcggccgggcacagtggctcacgcctgtaatcccagcactttgggaggccaaggagggcagatcacgaggtcaagagatcgagaccatcctggccaaaatgatgaaaacctgtaaaatacaaaattactaaaaatacaaaaatcagctgggtgtggtggcacatgcctgtagtcccagctactggagaggctgaggcaggagcattgcttgaacccgggaggcagaggttgcagtgagccaagatcgcaccattgcactccagcctgggcaacacagtgagactccgtctcaaaagaaaacaaaagggctgggtgcggtggctcacgcctgtaatcccagtacttcaggaggccgaggtgggcatatcacgtgaggttgggagttcaagaccagcctgaccaacacggagaaaccccgtctctactaaaaatacaaaattagccgggcatggtggcgcatgcctgtagtcccagctactcaggaggctgaggcagaagaattgcttgaacccgggaggcagaggttgcagtgagccaagatcgcactattgcactccagcctgggcaacaagagcgaaaactccgtctcaaaaaaaaaagatttatttacaaaaccagggccgggcgctgtggctcacacctgtaatcccagcactttgaggcaggcggatcacctgaagtcaggcgttccagaccagcatggccaacatagtgaaaccccgtctctactaaaaatacaaaaattagcctggtatggtgtcgggtgcttgtattcccagctactcaggaggctgagggaggagaatcacttgaaccaggaggcagaggttgcagtgagccaagattgccccactgcattccagcctgggcgacagagtgagactccatctccaaaaaaagaaaaaacaagtttacaaaatcaggtatccagatgggccagtgtgccagctcctgccctggatgctcttgctaaccaggtaccactgaagaatgccccggtctggcatcaccccccaccatgggaagtgcctcaggccacgcacacttcagaaccgccaggcctgaggtgcccatggctacggggaaaatctgacctggagaggaactcccagcccacaggggagacggacccatgcttacctgcaaactcctgccgcaaggcccgtgcaaaggccctgcccaccacctgcacgcccatcacaatgatctgggccaggtacttggcctgtgggcaaagcaggcacccggttagcaggccactccctgtgggcccacagagatgggccctggaaacggctgccgaggggcaaggctcccggagacccgaggtcatgaagcacagagctgcagccccaggccaacccctccaaagcaccctgaatgaaagcttccatggtgggtggcttagttactcactggacaggcaggcaggcgggtgaacttgaccgagctcccagaggcagactggccccacctcatccttcaggaaaggcgtagaggagcaaggcaaagtggctgcaaccaccggcttcaggaagaaacactgtggtctgggagccagaacacagggacagccctggacctggcagtaactcactctcgaccctggggccgaccatcactcttcctgagtttctgagatcatcaggcccaacctttactttaccaacggggaaacagatctgtcctaattctcccaagtccgaagactttaagtccattccattcaataaaacaaacttactatgcaaacctgtttccatcttcaaggagctaaaagcccactaggagggtatttaaacacactatggaccaaatcatgagggagagtcaggctcgttcatttgtgcagccattggttcacccattcattcaaacatctgctgagagtctactctgctcagcacttgagcacaaagctacacagaacctggtccctgccccgagtcagagcacactgctggcctggcagggaaccccactgtcacacaccaggctgaacatgccggaacactgcacgtgtgattccatgccccgcagaggccctggggactcactaagatgtgagcggaagcaacagagtcgagggaaaactcaagactgagatgggattcggtgagaggagggggttctgtgtgagaggagggcgttccgtgagaggagggggttccgtgagaggagggggttccgtgagaggagggggttctgtgagaggagggggttctgtgtgagaggagggggttctgtgagaggagggggttccgtgagaggagggggttctgtgtgagaagagggggttctgtgtgagaggagggggttctgtgtgagaggagggggttctgtgagaggaggggactgtgtgacaggagggggttctctgagaggaggggactgtgtgagaggagggggttctgtgagaggagggggttctgtgagaggagggggttctgtgagagaaggggactgtgtgagaggagggggttccgtgagaggagggggttctgtgagaggagggggttccgtgagaggaggggattgtgtgagggggggttctgtgagaggagggggttccgtgagaggagggggttccgtgagaggagggggttctgtgagaggagggggttccgtgagagaagggggttccgtgagaggagggggttccgtgagaggagggggttctgtgagaggagggggttccgtgagaggagggggttctgtgagaggaggggattgtgtgagaggaggggattgtgtgagaggagggggttctgtgagaggagggggttccgtgagaggagggggttcctcctgggctgggctttgcagggtaggaagaatcatgatggaaatactagggctttctaggcagagggactgggttgagccaaaactggcaggagagaaggcagaagggagttcctgcgagcagccaatagcctaggctggcctgggaaagactgggaatctggcggatgacatggaaagatgcacagatctttgtgaaacaaagcgattatatatagacagcacatacaaaggatcttgtgactgcaaagccgtagacgcaggggggtggcgcgggctggaggcagctcggcataggttgaaagctcatgtggcacagccgagtgactttccctttcttcctagtgcttttctgtagatttgccttcagtcaacaagtatcaactgagtccacacaccaggcacggtgccaaacacgttcaattcattgtgccgtttaattctgacaactcaggggtgggggactgctgactggcccgaggacgtaacagcaggtgcctcggaggcagatcggaaacccaaggctggtgctatctgtcacagcagtcactacgcagggtcccggggtctgaaggtagggcacctgggcaagccgacaagtatcaagaacccaaccccgaggccagaggggcttgctccagattccagtggattcgactccagagctggccttgttcagcctccgaggacctgctctttccttaacaggtgggatgtcattatgggccattaggggaatgaacaaacaagtgggttaagatttcaaaagtaggtggaaacttcataacttctggatttcacagcagaaagagcccagagaagaccctcctgtgatcacagcgaggggcagggctgtggctgtactgcagatgagggagggtcagggatgcacctgatgacacctgcggtctcacctgacttcgcctccttcctaaagcccctcccgagtggaacaggaggctcagggatgggatgctggtgctgtctgaaggacagaggtgaaagtcagagggtcccctcggcttgaaacacggctcaggtctcagactacccctcacaccaacagccttcggtccctctgctgccatcgtacagccttgcaatcacttgtttacttttctgccaaggccaatgactgttgcaaaataatgaacggtaagagctgaggtcataactggggagcttccccgaccatcccctgcacacttcaaaccaaagcggcgtggtggcctgtggcttcagctgcctagagctgcagggcagaggggggctggcctgcaaagtttcagcagactggacggcccattgaggccagcaaggttcctataggaggcatctctgagaagacgcagtgtagtgtaatggttacacctgcaggctttgggatcacctgtgtgcaaaaatcccagctatctgacatagacacgttctcaactcctttgagcaacccagtttgcttacctgtaaaatgtggccaccaataaagctgagataatgcctgtcaaatgcctggcacacagcctaatggtacagcaggtgctcaataaacattggttttcattcattactactgtttcacaaaatctgacaatgaccaggcactatgaagtaacaaagcttctttcaaaatagcagctcatttgatacaggccctttgcttcctcaggggtgaaggctgcaaaacaccatactacattccctcagggagctgggaagcagcaaggaagcagaacgagaaccacgttgacctgggaccagaaccctagctttctttctcaatagctgtgtgaccctggacaaattactcaacctctctgaatctttttttgttttggtttgggtcttttattttttatttatttttttgagactgactctcgctctgtcacccaggctagagtgcagtggttcaatctcggctcattgcaacctccacctcaccagttcaaacgatcctcctgcctcaccctcccaagtaactgggattacaggtgaacacaaccaagcctagctaattttgtatttttaatagagacgaggtttcaccatgttggtcaggctggtctcaaactcctgacctcaggtgatccacccgcctcggcctcccaaagtgctgggattacaggcatgagacaccacacctggccttttttttggaagcagagtctaactctgtcgtccaggctggagtgcagtggtgcaatcatggctcacttgcagcctcagcctcccagcctcaagagattctcctgcttaagcctcccgagtagctggagctacttgtactcagcctccgaggacctgctctttccttaacaggcgggatgtgatatgggccattaggggaatgaacaaacacaagtgggttaggatttcacaagtaggtggaaatttcataacttctggaggctgagcacacgccaccacatttggctaaatgtacttttctggagagatggggtttcgccatgttgcccaggctggtcttgaactcctaggttcgcatgaactgccctcctcggcttcccaaagtgctaggattacaggtgtgagctactgtgcccagcctacctcagttttcttaactgcaagatggagagaataacaccctcctcacaagaggacagtaaggccctcaggaggcaatgcccattaacaccacatggacaaacagcggcaggtccagaactaggcggtgcaggcaagcccctcatccacctatccagtaccccaacatcccctgagcttctgccatgggtcaggctgagttcagagctcattcacagggagcagagctctgccagctgtggctaccatgggtgaccaaaacaaccactgcctgaggcccctcccagaggctccaaacatcccatagtccaccgactgacacttgggcctgagggtcccaggtgagaggacccagctgacttggcatccaacttcaggccacgcggctgtcagagagcagcagtcagaagcacaggatccaatcctggcatgcgtgggggcagcatgtgcacttcgttgttgggcagcaacctggcccaaggcaggaccagatcccagcagctgggaccacagacagtgctgtgggaggcactcagcaatggggcttacactgacttgtgtctttgagattcgcgtgcaatgcgcctttgaggccaagccccaggctctgggtagataagcagacagcctgagactcactctcaaggacactctggtcacccagggcccctgagaatagatacgggcatcacaactagacaggagaaaggtcaggaccacaactgtagcacgtgccacaacatcagggacctggccagtggctggcgcagtaagtgcccctggtgcatctgaatgaatatggctgttgcagctttgcccaatctgctgtctcatgaactccatgtccccaggcagggtttccaagcgcctcctaacccttctgcgggagggttctggccatctcccagtaaacacacaattctccaccgccgcctgcagatttggtccactccccagcttggcattcacagcgcctggtctggcctcaacttctcaacctcacctctctccacgctgcagccacaccctctgctcctagagccgctctcatacttctgtactcctcagggcctttgctgttctgagttcctccaccttgaacatcctcccttctaccctgatcctgtcaaaacccaacatccctcaggacctaatatcattccccatcccccgggtgaaaccctttccaggctctcccatgtataccttccgacagcactttcttttttttttggagatggagtcttgctctgtcgcccaggccggagtgcagtagtgcgatctcggctcactgcagcctctgcctcccgggttcaagaaattcttctgcctcagcctcctgagtagctgggactacaggcacacgctgccatgcccggctaattttttgtatttttagtacagagagggtttcaccgtgttgcccaggctggtctcgaacccctgagctcaggtaatccacccaaagtgctgggattacaggcgtgagccaccgtacccggcctagcactttctttttttttttttttttttgagacggagtcttgctctgtcacccaggccggagtgcagtagcgcgaccttcggctcactgcaagctcggcctcccgggttcaagccattctcctgcctcagcctcctgagtagctgggactacaggtgcctgccaccacacccggctaattttttgtatttttagtagagacggggtttcaccatgttagccaggatggtcttgatctcctgacctcgtgatccacccgcctgagacccccaaagtgctgggattacaggtgtgagccaccgtgcccggccagcactttcttttcctgttaatatactgtcatgctgggtgcggtggctcacgcctataatcccagcactttgggagtccgaggcaggaggactgcttgggcccagaagtttgagaccagcctggcaacatggcgaaactgcatctctacaaaaaatacaaaaaattagctgggcatagtggagcatgcctgttgtcccaactacccgggaggctgaggctactggggaggatgaaatgggaggatcacctaagccccaggaggttgaggctgcagtgagctgtgatcgtaccactgtactccagcctaggagacccatctggggcaacacagcaagaccccacctctacataaaatttaaaaattagccaggtgtgctggcactcacctgtaggcccaactacttgggggtctaaggtaggaggatggcttgagcctaggagttcaaggctgcagtgagctaggatcgctccactgcatcctagccggggcgacagacagacatcctatctcaaaaaacaaaccaaaaaaaccccatgagttttgggacagagctgggctcaaaagaggtctctgacaccatgggatgcatgactatggtggagtcaaaactgtctggggctcaggttccttatctgtaaaataaggacaatgacagcaggacttcataaacactaaatgagagactctacataaagccttagctcaggggctggcacttgtacgccgttagctgttacattatccttattactatgttagttaagaagtggctccccgaaccagctgcaacagagtcacttggggaacttacgtgtgcagaacctccagggatagagctcaagaacctgaactttttttttccccctctttttctttttgagagagttttgccctgtcgcccagactggagtgcagtggcacaatcttggttcactgcagcctctgcctcctgggttcaagcgatactggcgcctcaacttcccaagcagctgggattacaggtgtgtgccaccatgcctggctaacatatgtatatattatgtgtgtgtgtgtgtatatatatatataaaatacatgatatataaaaatatatataacataataatatgtagtatacataaatgtatacggtatatataatacatatatataattttttttttgagacgcagtctcaccctgtcgcccaggctagagtgcactggcggatctcggctcattgcaacctctgtctcgcgggttcaagcgtctgtcctgcctcagcctcccgggtagcttggactacaggcgcgcaccaccccacccggctaattttttaaattttttggtggagaccgggtttcatcatgttggccaggctggtctcgaactcctgacctcgtgatccgccgcctcggcctcccagagtgctgggattacaggcgtgagccaccgcgcccagccaaacctgcacttttaaagctaccctaggtgacctgacagtgtggcgcaggtctgttgactggctctacgtgccaacgatatcacacaaacgctccgtgctcggtgtctcggggcctagttcaagtcccaggtcagccacttccctggaaaggccagctttccactggggataacaacagggcagcaacatcgactctgcagcgctgtaaggttccagggcaggggaggcgctcaccagccagactcatgctccaccgctgcccacggctgctcgctcacacgcgggctaggcacagcgcgaccacgtttgcccggcctcttccaggcagacggttttccctggccctgaggccgccggtgccgccgctgccggcctcgattcccccgggtgcaacgcccccagaccatgcttcccgccgggcacgcagggggcgcacggcgcccgccgcccagcccggagctcgccgcccggcccccggcccccggcccgactcggcttcccctccccggtagcgcccgactcggggctcaccatggcagccgctctgcctccggggctcaaactccgacttcctggccccgcggccggggatcaagcgtggtcggcgggtcagaggtcaaggaaagccgcagagagcgcgtgcgcgatacggcgctgggcatgcgcattgcctcagtctaagggcgggccaccgggagcgtcttagcggctcggggcggggtcggaggcggggtttgactgagcctgcgtcgggctctggataactgggggcgggcttgggagggcaaggggcgttaccgggagtctcaattgcccgcgtgcttaccccagtgcgctggagcagctaagcacatcggtcagacgtggggcgatttctgcccttgattttgccaaaatatttgggaatgcaacattatatgaaatcaatgaacataatatggagtaggatgctaaattctcaaaaatactttagaaaatagaaaacttcaaaataggtttcatccacattcctcctgcctgagaagctcgttcccttcttcaaatctttgctcaaatgtcacctcaatgaggcccacctggaccccttaaaacgccgtgacttgccctccatgaatgaaaaaagtaacagctttattgagatataatccatacactgtagatttcatgattttcaagtgcacagtccaatgccttttattcacagagctgtgccactgtcaccactattagttccagaacgttttcatcacccattagtcactccccagccccctcccccagcccctgtcaaccactcatttttctctctatggattcacaggttccggacatttcatagaaatggaatcatacaagccaggcgtggtggctcatgcctgcaatctcaaaactttgggaggccgaggtggatcgcttgaggtcaggaactcaaggccaggctgggcaacatggtgaaaccccatctctacaaatacaaaaattagccgggtgtggtggcaggtgcctgtaatcccagctacttgggaggctgagtggtggatctcttgagcccgggaggtacaggctgcagtgagctgtgatcactgcactccagcctgggtgacagagtcaggccctgcctcaaaaaaaaaaaaaaaaaaaaaaaaggtaaaaatgaaaaatgaaaaaaaagaagaaattgaatcatacaatgtgcagccttttgtgactggcttatcctcccttcttgtctctatttttcttccaagactctgatcaccctctaccataccacataatttacttatttattttatttatcattttgagacagggtctcaccctgtcgcccaggctggagtccagtggcacaatcctgcctcactgcaacctccacctcccaggttcaggcgatgctcatgctttagcctcctgagtagctgggattacaggcatggaccaccatgccccattaatttttgaatttttagtagagacagggtttcaccatgttggccaggctggtcttgaactactggtctcaaatgatccacccgccacagcctcccaaagtgctgggattataggcatgtgacactgtgcccaaccggttttttatttttaaattatttttccttttttttttttttttgagatgaagtcttgctctgtcacccaggctggagagcagtggcccaatcttggctcactgcgatctccacctcctgggttcaagtgatcctcccacttcagcctccgaaagtgctgggattacaggtgtaagccaccgtgcccagccaaaaaaaaatttttttttttcaagatagggtctcactctgttgcccaggctgcagtacagtagcatgatcatggctcactgcagtcttgaccttccagccttgagtgatactttcacctcagctttctgagtagctgggaccacaggcatgtgccaacacatgtggttaatgtttgttttttgtctttttgagagcgtctccctgttgcccagcctggagtgcagtggcatgacctcggctcactgcaacctctgcttcctgggttcaagagattctcttgcctcagcctcctgagtagctgggactacaggcatgggccaccatgtccggctaattttttgtatttttagtaaagacggggtttcaccgtgttagccaggatggtctcgtgctcctgacctcgtgatccgcctgccttggcctcccgaagtgctcggattacaggcgtgagccaccgcgcccagctaatgtttgtattctttgtagagacaagggttcccctatgttgcccagtctgacctcaaactcctgggttcaagcaatcctcccaccttggcctccctttatttttatgtttattgttgagaatctgtttccttccactagaatgggagttccttttgggcaagcatttcctctctcttctctgctgttagatgtcaagcgcctggaagagcatctggcgcacagcattcggcaaatggtgggatgaaagttgggccacctggaatcctactctacaccgctgcccttcttcctcttcctcctggcctccacattcctctctctgtgcccacattgtacttccttgcctcggaagtggctctctccctggctggctcctcatcagccttcaagtcttggctcttagctgaaagtcaccttctcaggccctgaattccctgcctcgctgcatcccagttgcttcctgtcccacaggtttttttgtttgtttgtttgttttttgagactgagtcttgctctgtcacccaggctggagtgcaatggcaggatcttgactcactgcaacctctgactcctgggttcaagcaattctcctccctcagcttcccaagtagcttggattacaggcgcttaccactacacctggctactttttgtatttttagtagagacagcgttttaccatgtgggccaggctggtcttgaactcctggcctcaaacgatcctcccaccttggcctcccaaagtgctagtattataggcatgagccaccgtgcccagccagtttctcttctttactgctgtcttcacactctatatgctcgtgtgcagtctggttcccctgcataaggaggctgtaagaagctgaaggtccttgcaagaccttatctctcctgtcctttatagcatcccgccatccagagcactgccaggaacctgcatggtgagcgaatgactcccagcagtgcgcaggtgattgggccttgggaccagagtgaggctgagataaaggggagcccagggccagacccctgtcacccacattcctgtccccttccctttccagccagcccagagaccacagcagcacaagaggtggccagcttaaaaaagtttaattgctgaaaacatccaaggcaggtgcgggccagtccctgcggggctcacaccccccttattggaccatcagctctgtgatgcccccttctcctggctacaaacctgggaagtagggcagctggtcccagggccctgagactggtgctgctctagaaggcctggtggggggccagcccccaaggcccttgaccagaactggaacagcaggcaagatggggcagcgtggggtgaccaaagatcctggatgaggccaatccaggctgggaccagcccaggtcagcagtgagaccaggggagacagggtgcccagggcctgcccagggacatgctgctgaccccccgccaccctgcacccctggccacatgctagcgggcagctgatgagcagcagctgaccccagagacagcagaggtgaaaacagtccctgggaactgccagaggcccagaggatgtggaagtgcccacgggaaggcaggagtgcaggggtgacatgtgccggggccagagaggtatcttccagcttgaggatgagccgtgaggtgtgcactaggaagtggcagcacaggtgaggtggaggtgacgggggcgcaggctagtcctggggcgaaacaccaagaggtgggagggagtcaggagggcctgggaagggaggaggcatgcaccgtggcatgtgcgagggaccgcgctgcctgccgggaagtgaggccactcactactcacccactcgtcctcgtccacgccttcaaaggagtcctgggggagtgggtcctcccggttccccagttttgccaccatggcattcagcagctgggagagagggcagaagaagggtaggtaagggaataggactccctgttccctctcccactccaagaacaaccctgacaaggctgtgaaaagaactttttttttttttttagacggagtcttgctctgtcgcccaggctggatggagtgcagtggcgcgatctcggctcactgcaagctctgcctcccgggtttacaccactgtcctgcctcagcctcccaaggagctgggattacaggcgcccaccaccatgcccggctaattttttgtatttttagtagagacgggggtttcaccgtgttagccaggatggtctcgatctcctgacctcgtgatccgcccgcctcggcctcccacggtgctgggattacaggcgtgagccacagcgcccggcctttttgtttgtttgtttgttttagagagagacaaggtcttgctctgtcaccaaggctggagtgcagtggtgcaatcatggctcactgcagccttgactttctgggtgcaagcaattctcctgcctcagcctcccaagtagctgggactacaagtgtgtaacaccacacctggttaatttttattttatttatttatttttttgagacagagttttgttcttgttgcctaggctggagtgcaatggcacaatctcggctcaccacaacctctgcctcctgggttcaagcgattctcctgcctcagcctcccaagtagctgggattacaggtatgcgccaccatgcccggctaattttgtgtttttagtagagacgaggtttcatcatgttggtcaggctggtgtcgaactcccaacctcaggtgatccgccctcctcggcctcccaaagtgctgggattacaggcgtgagccaccatgcctggccacacctggttaatttaaaaaatttttttgtagagatggggtttcactggtctcaggctgggtctcaaactccatcacttatatcctcttgctttggtctcccaaagtgctgggattacaggtgtgaaccaccatgcctggccaaaagagccactatattttatttttatttttatttttatttatttatttatttattgagacggagtctcgctctgtcacccaggctggagtacagtggcacgatttcggctcactgcaatctccacctcctgggttcaagtgattctcctgcctcagtctcccgagtagctgggatcacaggcgcccgccaccatgcccggctaaatttttgtattttagtacagacggggtttcaccgtgttgcccagggtggtctcaaactcctgagctcaagcaatccgcctgccttgggctcccaaagtgttaggattacagacatgaaccaccgtgcccggcctcaaaagagccattttaattacagccctgacaaaatcgatgggtttctattgaaaaagacacaaagaagagacagggggagtaagagactgagaggctgcggcatgtggcaccagatacaagggctactatctctgcacatggcctcaagtgctcaaaatatactccaaggtcccaaaagcacttgggcccagaactgccggcttaggctgggtttggcctggccagggcagggctcccactgccctcccccacttcccgggccccatggtcagtggtagggctctggaaggtctccccaccaggctctggtgtgaaggggacgtgacatgtggctgctgtcccagtctgggttggggatggagaactaaggggccgtggccaggtgcagccaggactctgtcacctccgcacagctgctctctcccatgcctacctcctccttcttttgctggtcagacttttcttccaggtactgcgctgaggatggggcccgacgagcaggggcctctcggggggcttggctcactgggacagagcaaggacacgtgtcagagagtccccttcgttagggctctttggtgccaagccctcggggatttctttctttcttttctttctttctttttttttttttttttttgagatggagttttgctcttgttgcccaggctggagtgcaatgatgtgacctaggctgactgcaacctccgcctcctctgggttcaagcgattctcctgcttcagcctctggagtagttgggattgcaggcgcccaccacgccaggctaattttgtatttttagtagagatggggtttcaccatgttggccaggctggtctcaaacccccgacctcaggtgatccactcgcctcagcctcctaaagtgctgggattacaggcatgagccaccgcgcctggccgacctaggggatttctatggcgcagatctaagaggtggtattaacagtcaatggagcctcactgtataagccctgccctagacaccacagtgtgtgcgtgtgtgtgtgtgttaggggtggggacctgtgatgaaaacacagaccacgagccctgccctccactggctcagagactgattgacacagccactccaccctcccaaaggccagaggattctgcgtgccaacaggaatggaacttcaacctgggccttctgtccctttctccaacccccatcccgcttcctccccacacccagtccctcggtgcacctgggctcatgtcaggaggctgcaggctgagaagccagggctgcccattagcgccttgcagccaggcctcggcactgagcacaggctcccagatcacagccgtgtctgggaacacgtcatcctggaagaactctttctgcagagggagaaacgggctgtcctgagacattgaccaggtgcccagggcacacgggcatctgttggggagggacagggcaagacctgggaccctcccaccagcctggggcttccatgagtttcagcatctcagcagaagggggtaggtgtccccatgaacaatgggtagggaagtttggaagctgggtcagacgggacccaaactcccctctaggcaccgagaaggcggtgggcatgggagtcccaggtccccaccctcacccggactcggggcagccggaaggccacaggctccagggaggactgacgcagccgcaggcaccgcatcagctccacttcccgcacgtcgcactccgtcttaggcaggaggacgaggccctgggggagcaagggagtcggagctgccgctgggacctagagctcatggctgggcacgtagtctccccagggtgccggcacccctcacttaggaccaccatgcctagggcctgtccctggacagtaacgtgttgatcatgttgaacaacctgctctctggagggaaagccctgatttgtggtgttttcctatttccacagtttacaaactcccaccatgggcagcttctacgtgccacctccactccctgaatgtggtgttgggaagagatgtaaatagcacatcatcctgcatttcctccatgcactccaacacagaaacatgtgacctcagcacaaataatagtaaaattggataaattaattagaagtgataaactgagtgtttattactttggtttttaatattatttttaggttcatattgtaggttcatatagtttaaccttatctagtgcaattttttgtttgttttgtagagatggggtcttgctatgttgcccaggctggtcttgaactcctgggctcaagcaattctcctgcctcagccttccgaagtgttgggattccaggccaccgtacccggcctacagtatgatttttaataatggttgagtatgacaatggctctcaaaattcctaaataattccagcagcaactcttcttgccagtcactgggcacagccccaggcccagccccagcccaggactctgacccccgacccacaggctcctgtacttgcccacatggccaccagggggcagggcagccttgtggtcccatcggggacgaggcgccagggtggcctcaccttgtgggggtcaggcgacgtgaagctgttgcactccaggaagaaaggggactcggggagcagctcgtacaggaatacacgggtgtcgccctgcggggaagaaggcaggctgggaaccctccggcaacactggccttccccccaccacctctcacctgccatcccgccctccagcccagcccaccttgccggtcaggagcaccaggccagtgtctgggtcgtagctgggcagcagggttgagggagccacgtccaggcccaacactgccaagggtccgccggccagggcctcagcttcatataggagcagctggcgctcactttggctgcaagggggtttgggggctgaagcaggtgtttcagagctgaaggggcctggggcagggagaaggcgcccacgtagcccctgctctgttctgggttgtaggcgaggcctagtgtggcccggcaccgcagccacatcctaacctgcccctccacctctgggttccccattgactctttctcctccactaatcactcacccatccatctacccctgactgcctcaccgcccctgcttccatctcccccagagccccttgtgcacccctgcatctatctccccccaacccctcacccacccctctatccatctccccactacccccaaaacatccctccatctcccctacccccctcaccctcccctgcatccatctcccccttacccccaactcatccatcgatctctccctaccccctcattcatccatccagccatccgcccatctatccccacattcattcatccacccatccatccattcacccacctatccatccacccatctacccactcatccaatcatctacccacccacccaaccatccagtgaggggcaggaatggtttctgaaagcctgacaaatgtatgtgactgtggagaagggggacacaggtggcttctgaagcctggggatggggatgcctgagtcctcacctgtcaaagccagacaccagcagacagcgaccatcacatacccagacaatgcgagctccgcgtcctcccttgggccctgggccttcctgttgagatacatcgcgtgacacccagccagcacccctgaaccaggtctgaggccactccccagcccctgtgtgctcacctgcaggggctcagggccactccggggcctgtagacccgcacacgcccatccttgcagacagtggccagctgctgcccatcaggactccaggccaggctgaagatctgggggcaggaagggatatgagagacagccttgcttcactgctggccccacctctccccactgctcctgcccctcctcactgctggcgccgcccctcctcactgctgttcccgcctctcctcactgctggtcttgcctctcctcactgctggcccccctctcctcactgctggccccccttctcctcaatgctagcccggcccctcctcaccgctggccctgcccctcctcaccactggcccccctctcctcactgctggccccacccctcctcgctgctggtcctgcctctcctcactgctggccccgccactcctcactgctggccccacctctccacactgctggccccgcctctccacactgctggccccacctctgcagccgtcctacctggtcttggtggccctgcagcttcagccgatcagctccagcctgaaggtcccagatgcgaacagtgaggtcataggaggacgaggccagcacattggctgccagtgggtggaagcgcagggagcagatcttctccgtgtggcctggaggaaggcaggggtgatcaggagcccttgggagacactggccaccccagccccattcctgagcctgcctgacctgtgagcacagtctctggcgtggtgagcacctcttccaggccctctgcgggtacccgccacagtcggatcctggcgtcctcaccagctgcagaggacagacaggggctcatcattgctgagcccaagacctctgggctccccagcccctatccgggacccaggaccctccctcaagcccaggcacccagcctccttacccacagcgaggcgatgggggtcaaaggggtcccaggccagatcagtcacagctgccccattctgcagcgtgggcagtgccgtgtcgggcaggcggccaggcttccgtagctgtgggaggtgcccccaccccgaggcccatcagtaccaggcagaaaagccagtccccaggggctgcgggcaagcagcatgtctgggagcccaccctctgcagcagaggctcccaccgctgggtgacccaagctctctgccctgaccaccttgcgctctgagccccaagtgccaaccacaaggccccagagagtgagggggcagcagcgtgaactggcgggaaaagctccggcttagggctcaggtggccgggcttcggatcccagctccaccacttacacagctgtgtgacccgggcaggtcactaaacctctctgtgcctcttctccctcatctgtaaaatggggataaaagtggcaggccccatggcaggtggctgggaggatcacaggacaggcgggcaggagcctgacacaaggtttgtgctccctgtgttgtgtgggtagctaaggccctccgcgtctttgccacaggcagggaactgaggggcagccctggtggggtggggccctcacctcaagcacagccacctgtcccccgctgctgagcagcggcacggccacacgcagcttgttggcacagaagccgtcactctcaccaggtgtggtgaggttgagccccttgaggttggtgatgtggctgtctcggtgcaggacagtgccctgagcatggcggaacttggaactggggcctggcaggtggcagggacatggaaccacgtgtgaggatgccgtccccgcccgccctgcactctttgagtcccggctgcccactcccctcaccccaggtggatgtacagcatggacctaggcccaggcctttgctaatccagtggatgcaactcgcccaggaataatgtctggaatgatataccctgttccatggtggctcggggaatcttggtggagcccagggctttggctgctcagaagctggtggccccagccgccctcctattttgcaggtgagactcagccaccacaccccagcccccaggacaaatgaccctgccagtgagtctgggtgaggggggtgccctgcatgaggcctgtgctcagcagtagggtacacaggaggatgacggggagtggggcagacagggctcctgcggtaggggtgagctccccgtcctgcctccttacccagcaggctctgcagcgacctcaaactggggctggtcccgatgccactggtgctggagagtgagggccccaggctggagggcgtggagggcgaggtcagcgaactgggaggggaagagaaaccctcctggggaggggcatggggtcagccagcctgctcctaggtgtactggccaaaaggagggggtgccagcggactccagggtcaccactctgggccccctgcggactggaggagcccccactgtgggcatgcgacaggagcggcggggggcacgggcataaacgcagacacacagggaagcagccgagcttcagaccgcggggacagcaagtggcagctgctggctcccagccctgcaggagggtgtgcccagtgggttagatctgccagtattttaagagaagccagaaatctagatctgtatgaaaattcttgctttttaagtgtttgcccaatttagaaagcactgtgcaagttccttctttatgctccacgtgtttctctgtctctgttacacttgacaaagaaggttggggccaggcgtggtggctcaaggctgtaatcccagcagtttgggaggccgaggagggcagatcacgaggtcaggagttcaaggccagcatggccaacatggtgaagcctgactctactaaaaaaaatataaaaattggccaggcgcggtggctcacgcctgtaatcccagcactttgggaggcccaggcgggtggatcatgaggttaggagttcaagaccagcctggccaacatggtgaaaacccgtctctactaaagatactaaagataccaattagccaggcgtggtggtgcgcgcctgtaatcccagcactttgggaggcccaggcaggtggatcatgaggttaggagtttaagaccagcctggccaacatggtgaaaacccatctctactaaagatactaaagatacaaattagccaggcgtggtggcgcacgcctgtaatcccagctactcaggaggctcaggcaggagaattgcttgaaactgggaggcggaggttgcagtgagccgagatcgcaccattgcactccagcctagacgacagggcgagactcatctcaaaaacaaaaacaaaaacaaaaattaggccaggtgcagtggctcatgattgtaatcccagcactttgggaggccgaggcgggtggatcacctgaggtcaggagttcgagaccagcctgaccaacatggtgaaaccccatgtctactaaaaatacaaaaattagccaggcatggtggcgggtgcctgtaatctcacctactcgggaggctgaggcaggagaatcacttgaacccaagaggcggagattgcagtgagccgagatcacaccattgtactctagcctgggcaataagagcgaaactctgtctcaaaaaataaattaaaatatagtcggccatggtggcacatgcctgtaatcccagctactcgggaggctgaggcaggagaatcgcttgaacctaggaagaggaggttgcagtgagccgaggttgcgccactgcactctagcttgggtgacagagtgagacactgtctcaaaaaaaaaaaaaggccgttcagccggtgaacactcagggcagccactgcagtgtcgctgagggaggatgggggcggccctggtacttacgcttgcgtctgcatcacccacgggtgtctccatcaccgcaggctgggctgtgtcagggaggggctccgcagggggcaccagacaggaagtgaagctcgggtggggccggcaggcggggttgaggctgaccttctgcacctgcatggaggccggcagtggggagatgggggcatgggctgcccggtcaggagggcccccatgggagggtcaactgggtagggatggggggcacccagcaggccagactgagttggcacacagccacacggggctaccagggactcggggaggctgggagaggtgagccagccctggtcctacctgctggttgtccccagcccaccagctatgggggtcggtggcaggcacacagccggcagtgtccgggaacaggtcctcgtggaactccacagcctggccgcagacaagcaggcagctagtgaggcccaggccccccgactccccagcccccgcagtccctcgcccaagtccccctcaccttgcggggcacatggtagccgatgggcacgatggctgtgtcgctcagctgtaggacgcggagtacctcgcagctcatgacggccagcgcctgccggggcacaagggcagccccacgcagcacgctctccaggacacactgggtcactgttgaggacaccataggggaacaggcaggatgggcaggggaggggagggtaggggatgggggcgaggaagcaaggcttacctgggctcagcgccggctgctgcgggaccacctcgtaacagtacagctgcctctcgccctgaaatgagtctgaactgagccccgtttgctgactgaacccctggggagggcccaggactggcatcagctcccccacaggtccccaaggacctgagccacagaaccacagtggctggagatggggctccccaacatgctgggcgctgagctgagccctaggctgactacctcacttgctcagcctcgttgcacatggggtgagcaccgggggtgtacgtcagtatttatggagtgctgactgtgtgctgacactgctctattctcggccttgttctcaggaaggccagtgttctaggagagctacagtcaccttggctgcacaggggaagacacagaggccctgttcgagttcctcctctctcttggggaaggccaggggctggactccaggctgtggatgtgggtgggagccccagcttctcactcacctttcctgccaggaccaggagcccagagtcagggtccagcagaggcacgagacacctggggaagagagggcaagatggcgggtcagggcagtgggagggctgccagactcgtaaccccatgtaggagcccaggacaggcaccacagtgactgggagccgcttggccatccagccatgttcagcctggtccccaggaaccccctcctcttcctgagcttcccacatgcccaacacacgcccacaccccagctgctcctccccagggcctccacctgcacacctgcgtcactccaggactggagtgggcacaggggaactcgggcccgatctcagccacagctcttcctccaagaagaccccacatgcattctgtgcccctcccaccttcgacagcctagacatcaggccagcattgccagggaaggtggagaggtgaggccggaggcgaggagcctcccgtccccactcggcactgcctgtggacaggcagcatccgggagcagtgcaggcagccctgccgttccgaatctgcactaaggtttggggccctctactcagttaccccacgtttcctgtgcctcagtgatatcttggaagctcagagacccccccatgctgagttaaagttcctgtgtccaaatctgagccacgtgcccgggagaaggggctcctccggccgctgggcttccctgcacaccccaggcctgctgccccggccgagcctgccagcagcatgctcccaggccttctctggtctcgaggcaggagcagggcggggtggcagctgggaatagagtgggcgggccggaagcccccagagcccctgccactctatgtccagctcagccttggccaactgcctgtcactggccgggctttatgcctccctcccggggcccctcagagacccctgcacagcccctcagccctgtgagagctgccttcccactccagggccttttgaggggaatggggacctggaaggactctgacagatgcccagatgcccagttgccttcctgtgtttcttgctcctgatctttgcttttttttttttttttttttttaagagacacggtctccctctgtcacccaggctggagtgcagtggcacaatcattgctcactgcagcctcaacctcctgggctcaagcaatcttcccactcagcctccagagtagctgggactacaggtgtgcaccaccatggctggctatttttacttctatttttgtagaaacaaggtctcactatgcttccgaggccggtctcaaactcctggcctcaagtgatactcccaccttagcctcccaaagtgctaggattataggcatgagccactgcacttggtcttggtttcttgtttctgggacctgcaggcctggaccctcccaacccagacactgacacccttaaacaggaccccgtccccactgtgttgccagggtcagaggtcacccagctgtggcagctgcctctatccctcactgcggtgacaaagggcccagccgccctccactgtccacccatcccctcctgccagccgaccactaagcagtcctgcccacctcccctccccacacttccaggagccacagagtggctgggaagctgggtggggccctgggtgtctccatgacttcctggagtgccttgggctggtcacctgtgagtaacacaggcccctacttactgagggcccagcagggtgagccgggctcagcaatgccctttgcatcccggcctgaccactgcttgtagaggtggaggcggaggcggagggtaggggaccaaggtggtgcgtgacctggagtgccctccacactgacactggctccactggggctggaagcaagtcccttcagcagctttgacagggctttcactcattcattcgttcacaatcattcactcctttgatgagctggtctgtgcctggtcctcggctcgacctgcatgtaggtatgcccagagatgagtgcaacagaccctgcctctgtcctcaaggtgctcacagcctagcacaagaggcagacagacacaatcccatagacaaacatgtgaagggaaggttcaccgaggacacacagtgacagagcagggggactgggcctcagcagtgggggaaggggtgatccctgcgatcccaaggtcatgcagaaatcaaacacctcacaggaagagagtttcagagagaacacaacctgtgcaaaggtcctgtggcaggtgggttcatggcctgtttgaggaacaagatggacaatgtgcctgacagcctggacagtgtgggtgagggctgaggctcaggatgggcaggtggaggctagacgggaaggggcctggtgcatgtggggagggggagttctgcctccagtggacgagcaatgaaaaggtgacggtgcgtttcaagcaaaagaggctaggccaggcctagtgactcatgtctgtgatcccagccagcactttgggaggctgaggtgggagaatcacttgagcccagtaggtcaacactgtgaccagcctgggcaacatcatgagaccatggctcttcaaaaaattaaaaattaaaaaattagcgaggtatgctggctcacgcctgtaatcccagcactttgggaggccgaggtgggtggatcactggaggtcagcagtttgagaccagccaggccaacatgatgaaaccctgtctctactaaaaatacaaaaattggccaagtgtggtggtgtgcatctgtaatcccagctaattgggaggctgaggcaggagaaccacttgaacccggcaggtggagtttgcagtgagccgagatggcaccaatgcattccagcctgggtgacagagtgagactccatctcaaaaaataaaattaaaaattagcctgctgtggtagtgcacacctgtggtccagctactcggctggctgaggcaggagggtcacttgagcccaggagtttgaggctgcagtgagtcaagatcgcatcgccagctgggcatggtggctcacatctgtaatcccagcactttgggaggccgatcactttgggtcaggagtttgagaccagcctggccaacatggtgaaaactcgtctctactaaaaatgcaaaaatgagctgagcatggtggcgtgcacctggaatcccagctactcaggaggctgaggcaggagaatcacttgaacccgggaggcggaggttgcagtgggccaagattgcaccactgcattccagccttggcaacagagtgagactccatctcaaaaaaaaaaaaaaaaaaaatcacatcagcctgggtaacacagcaagaccctatctcaaaaaaataaaaatagaaagaggataggaccagactggcacagagtagggatcacactggctgctgggggcacaggctgggaggagtggaaacaggtgccaggacagaagctgagggcaagtaggataggcaggtctcctgtggcccctctgctgcccttatgagaggtgggaaacaggcctggggccacctcatggcatcagaggctcacctgtgcgctgagccaactgcctgaggaggcctggtgctcagcctccctcacccccgttccatcgtcccagccagccagccactgactcaggagctgaggccgagtgggcaggaagtcagggagggcagggctggctcctctgacaggtcaggccagtcttccttgcctcaggcagagccatctggacaactctgccaggcaggggcatcctgtctgccgtggcacgggccaagaaatggggtcatggcacccagccccaaaggttggccaagtgttggcatgggcctgaccccaggctgtgtgaagagagccaagctgggtctgggtctggaacatggtacatgagccccagccaggcagagggccagaggtggtaagaggtattgccggcacctctcctgctggaatctgggcctgccactgggaagggctctgaccctgacccaggtccaggggtctgtcccaggcataaagttatagaaggtctaaagcccagatctgcccccgcccctcagccaggtcccaggagctagaagacaacctcagtaccaactgggaggcacgagcagtttcagcctccggataagccccgccagctctcccaggactcctgtgattagcaccgaggggaagcaccaagggtgtgcttgctacaaggagcagctgcaaggctcctcctctgtcctcccctccagcccatccctcccgctcaggccccttcccaccaacccagacattctgccattgcgccagttcaaagcaggctgggtcccttggatctgtccctatcacccaggctggagagttagttaggatcctttgacccccctccacccccacagcccctagctcccccgctgtgtgcagactgctggtaaccaggttctaaaggcgggtggcaccttgaaaccatacaaggcaatgttggataaactgagaggggtctcctaaaagcttcccttgagcctctgggtaagtggggacctgtgtaaggccagggcacaggattggggcagggggtgaacaccaggcagatggggtctctccgtctacaagaacctgccacagaggtgagaagcttcaaggacatcaggaggtcctgttccttgaggaaagccaggctggaggctcttggagccctctttacccctgaccctgggcatctgtggatgcttctgagggcttcagaggacacagggccaagggaagaggcagggaaacagtccgacaagaggctgcacagcactgattggaaactcagatggttctggggccgggcaggaaactcaagtgagtggacagcttggcaggaggcagcagggagtggtggggactggggtgacccatgagcccacattttggcagagggagcaaccgccactcagccccagctgagagttcctgttcaatgcaagctgggaagccccattttaatatgaaaccacctgatttttcaatgttagcagtgccttcaaagttgtaaaaactcccataaagcctgcactaaatgcacccaaaggccagccccaacccaggaacagaggtccgcaagccatgccctaatccatgtagaccgagaaacgtatgggttgtggagccctgccagccctggaaaggggccctgtggggagagggccctgtggacgggaggtccagaaggtgactgtcccagccaggccctgcttagcccttgacggctagacacagaggccatcctgccttctggagataactgagtcctccagagactaggaaaccctccagctggtgtggcccagcctcccagggataagccttcaggccccccaaagactagagctagcccagccaagggccttggctacaggccgggctggagggggtgtgggtgtcccaaggctctccggaagtcaggagctgagctgggcccccaaaggctctgaggcatgactgaccacaaacgcggagggggaggagggcagagtgttttcctggaatcctccaaggcaggggatttttctggactagtccggcccctggcacccgcccctcctgcccaatcaagggccactgtcaactgcagcccaggccccacccaccgacggtgaccacccctatgcctccacagctcaggcttgaagctgccagtaactgtggggccgtgggcagaccaccactgccctccctgacacagccccttcatctcataatatggtggggaagagagtccagggctgctcacaactcttaaggctgtcgtggctaagaggaccctgagctcagatttggcattggagtttatacttaggaggctcttgaaagggctttgtgtgggctgccaggagttttttgaaattgggattagctaccaacaataacacattgagagatttcacctaaaaatctggatttccagtttctcttcaaaaatccaaagctctagctggcccgggctggtcatgaggactcagcccttaccagccccactcccgccatcctgcctctccagggccgcagaggccctggggtggacttctggcatttgtcacctgcctggtgcctcataggcatctgggctgtgacgcttaggattcctaaatagtctctcgctttttacacaaaaagcagaaacctgcccagtgtcatccggcaaacccacgacgggcaaggtctccccgcgcaggtcaggtggccgcagggtgagggccagggcaacccggcccacgagcccctcggtggggaaggggcgtgtctccacgcggctccgccccggccaatggggagaggccccgcccctgccgcggcgggcccgccccccgggactcttaaggcgcgacctgcctccagcgagccgactccggagcccgagcccggggcgggtggacgcggactcgaacgcagttgcttcgggacccaggaccccctcgggcccgacccgccaggaaagactgaggccgcggcctgccccgcccggctccctgcgccgccgccgcctcccggtgagtttctgtggggctggggggctgcgggcggggaagggggcgccacggccaggctgtgcacacgcgcggggaccgccgccgcgcgcacacacgcactctcgggcgggaccgcggccccagccccacacggtcacctgggccgcccggcgggcaggccctgtacgctccctcccccgccgtcctggggcgccgacagccccgcggccggccagggtgcgcgcctgagtgtgcggtgagcccgcgaggctgcaagcagacaaaataaacaccccgtcccatgcttcctcctcccacggctgggcctccggcatgaccagttttatgaatcaaacccctttgagggggatagccaagccacaggcttgggtcacttttccctcctggggtccggcagtaggtgctgctgtgcagaagggctgcccggggtcctctggacccttgtcactcaaagcacagctgggggctacagatatgcagccctagggaggggcggggagtggctggtgggcgtccgatgcccatccctccaggtgggggatggacctgtactggccagggcccttagagcttcgggtatcaggcagggtgccgggtctctgcctctgccagggaaggggctttgcttgggctgcaaacccagtggcctggagccagcctagtcctttgtgtccctgggctggcagtgctggggcctgaggactgctgaggtcccctgtggtcactggcaggccagccgattggtgccaaccattctgcctctcccccattcgttaacgattgccacaccagggtcactgaccgcctcccctgctgtggcccaggggtggagtgtgcagggtggaaggaagaggtcctgggggtctaggtgtccccatgcctgccttttgcaccaaggacaggtgaggctctggagagaggcagcgggacctagagcccccttccccaggctgagagcctccagggctggggattggataaaatctccaaggtcccttcacactagactgtactttgggtgttgagggcatagaggggtggccgggctgggaccttccaagcagggtccattagggccagtccagggggcagcaaagtccaggatgggcccagctattgacaaaaacccaacagagctggggcaggcgggtgggggatggggagcagtcccctgagtttactctcttctcccaggggagttggcctggagcttctgtaaacagagtgtcagaggcaggaagaggctctggtgatgagcagcccagctggatcccctccagaccattatctagcctcccctgggcctggggagggaggatgcgcacacacatgccagcctgggggccgggcactgcctgtccccaccccgcccctgtctcctgcacgttggaacagctgtcctgctacctgtgggtccggagggtcagatggggatggggctgggggctggggtcccagggcatttgtccagatggcacctctctctccatattctgggaatgggagaatgggattcagcataaggagcctctcagacactgcccagacctgtgcttacccgaggaaggcccctctggcacgcagcccaggggccagggagatggcaagggagatgccccgggcaggagatgggtccgcggctcctagctcccattactgtcacccccactgacagccccgggggagctgggacaagtcccaagtacagaaaattaagtccttgcctgggcttataagtgggtcccaacacaacactgggcagcctctgggaacaagaaagcagggccctgctgagcccaggagggagctcccacctcagcaggccagacagccagtcctgccagtgagcagaggtgtgtagaggggaggctgcccacagggatggctatccctgaccactggccagccctgagctcatgggagggcagcaaggccacctaactctgttagtgacctctcctggaccccccatcagctgcccttagagtcccctccctgggctggggagcccaaggctctgtgctgccaagaaaaccagctcccctcactgctgtggaatttgcgtgagttcttggagaagggggagggtgcacgtgtgtgtgtgtgtgtgtgtctgcaggagcactgcccagtgggcgtgtgtctggcgtgggcgtgtctgtgtgcgcgtgactggagcagggctgtgtatttgggggtgggtgggggtgtttgggggagcctgcttgcaccaggaggggcagggcctcagcctccttccttttatcggtttccacattccagagtcagccggatcgctttccctccgcgctgggccgccggcctcccccgcttttcctcattccagcctccctgggtgtgaggaggctggaggaggctccctcaggccacctcggttttgggcagggggtgggggcaggcgaggggccagttattcttcagggttcgggacggcccccaccagactcttcgtggggaatgcaataaggttctgacattcctcaggggctgcctgagagatttaattaaggagggaggagggagccggcctacaccgggaaggggctggggcggccgctggggcccctgctggccctgggccccgagcccggctgggcattgagagcagtgcgggggcagggttgtggttcagtggccaggtcctgttctgcctccctgaatccatcccgcctgcccattgatcagctcacagaccccaggggcgccatttctgccacgggttggccaagaaccctgggtgattgtggggggttcggcatggggagcttgagaagggcaagaccccttccagggccacttccttctcagacccccaggcccaggaagcttagggctggcggccttccttggtgactaaggtgttcttctggcaagttcagggttaattgcaggttagggccttactagatgggtgcttgcccctgggtggggacagggcagtgaggaggccccgtgtgagggcccagccctggtggcatcacacctgccgcgtgccgaaagtggcatctggactggcccatttctagttgggctgcagccactgcacagctcccagggccacaggtgtcctccctgacaggttgcacctcttgtgactacgatggcacgtcccaccgccccaggggctcacttgagctggggcctggccttagtcactggtctccctgccctgggctaacaggtctggcagctgccaagtcacccacggtgctactgaaggcacccacctggggccgggccagcctcctgggtggagggaggagggaagaccctgtgcctgcccctctcccagccctgccagctggtccacacctgctccaggatacagagcctcctccctgcacaggaagacgagctgacatcctgactgtcccctttgcaaccctctgtcctggtgttctgaaccctggctgtgcggaggactcgctcaaggagcttctccaaaatacagctctgcctgggtctcactcctagacattctttttgtttttgagatggagtattgctctgtcacccaggctggagtgcagtggcgcaatattggctcactgcaagctccgcctcccaggttcacaccattctcctgcctcagcctcccaagtagctgggactacaggcgcctgccaccaggcctggctaatttttttgtatttttagtagagacggggtttcaccatgttagccaggatggtctcgatctcctgacctcgtgatcgtcctacctcggcctcccaaagtactgggattacaggcgtgagccaccatgcccggcagaatttcttgtttaattggcctgggggtggggccccagcatggaggttttttttagaaagcttcctggatgattctgatgtgcagcccggcgggcaaagccctggcgtcacaggtgggagacggaagcccagagaggggagcttgcttggatgaggtcacaaagcgtgtgagtgcctgactgagctcctggctgtggcattatctgtggaatgaagagcgccagcttggggtggtggatggagtaagaaagaggctgacacccatggggacccccgctcaatcaccagccaggggtccccgcgcctatagggagggtctacctgccgcagtccctgaggaactcgaggcccagccctctctgccccttctgtgagggcccacgacccctgacctctctgccctgcccttgggactgctgtgtcccaaggaaggggagacggggcggacccagccgggccctgagcctcctcggacacgtcagcgaaactggagccagccgtcctggccgccggcacagtcccgcctgcctggaggggttggcagactcccggggctgggctgctgccaggcctgaccggccacacagagccttggcgggccagcatgaggagcgggggcccggagtctcagggtcagacctgcagcgcctgtcctgcacccacgctgaagcatacggcacaggaggggcgtactggcctcagactgtctatctgtctgtccaagcctgtcccctactcagcaggcacaccgcctgccccagaatcagtgagatgttctcgccaggggctgatgtggtcaccagatgcctgggtcccaccccagccatgctatcccctggcccgtccccgcctgaccctgggcgtgtgtggtgtaccccagaggtgggtgggcgtccccctgggagttgagatgacgagtgccttgtcctccttactcatagggcccctccctgaagtcctgtgctgaaggggccgccaagggacagctcacccaccacgtgcccccttccagaaccagagataccccacccccgctccccagcccccagggtgaagggcagccttggtgtggggatgtctgatctgtgtaaagctggcctgaaaccctctcccttagtagtacccacgcccagggggcaggcagagttctgcgtttatgagtgacgccctccgcagtgaatgtttaccgaccacttggcaagtgctccgagcacagaccaagtcaccccagacacaggcaccacgagcaccacgagcagcgcccactgcacaatgggggctgaggtaggggtcgtggccgggctgtggaccctgtcgccctatgccagttactgtgccagggagggagcaaggccggcagcagcactcagcaaggctgaggaacttgggtggaggacggaggccccagacccttgcgtcatcttcccaccccccgacgtccccgaatcccaggaatcccagggctgcctccggaacacctcctgcaccaggcagaggaaaaggtctcacctccctgcctgactagtgatcaaatatcaaagcccaggtcctgggatcaccgggtgggagggtgggtgggcggcggcaaccaccgtgtgacctgtagacagcccccagccccacgcacacaccaagcacacgcccagaccccaggcgggcgggacagctcccagaacttgttaaaagaacttccccatttgaaaacaaacagaacaacagaaaactacaactccagagggtgagggggcagggctgcttgcaccaactccagaggtgagaaactgaggcccacagttgagaaaggaactctggcctctgtcccctgccaccgtcccctccacagtcagccttccctcgctgggttcctctcggggctggctgatgggttctcagtgccaggagtccctggcggtgccctcagagctgccagcctgtagcttacaaactctggggttttccaaagctccagcgctgcctcctccctcctccctttgatgtgggggtagaattggggctcaggcaaaagagctcaccgcacattttacggggctgggaagcaggctggctgccgcctgctggatggtcagcccaggaccccagcccacagtcctgacctagacccctgtcctgctaacaggaacgcacattccacagctcactacctgtcagccggaaagccaccctgtggccagatggacccacagcatcccctctcccttcacaaccttgctgattaaagacccaacagattacggagcccagagctatggctggtccccctccccagtgcagggtgaagagcaccccccagcacgtgcccctaagagctggcctgcacacctggccttgcagggctgaggactccacatgcatcccccactgcagccctgaagtgtcccagatactcagatgaagaaaccgaggtgtgagagcaaagtcactgtctgcggcctcacagcttggacacctctgagcacagggccgcctgcctggagtgagcgctcttaactgtgaccttaaacgaggcccaaggggagctgcggccacagtggtggccaggctggccaggctggccacgtggaggatcccctcccactctggaacctggctgcatccttcctgaccctggtctggccctgctgggagggctaattcaggcagaggtggcctcaccccccatatggacatggggtgggtgggggtcactcacagcccacatctggaggccaggccgcacccgccgtcctctgagtcagtgagggtggagcgggtcccatgggggaagagaaggctaggggtgtggccccagggccttaggtcatcagacacgagcccccctggggtgggctggccgggccagggacgcgtgcctggggtttggggtgctaacttcttccagtgctcagtgccaggccctcctgggctgttcactcagcagacctgagctaagtgggcctggagacacctatggcaaaggcaggctgggtctcaccttagggaggtgagggggcacacgacagcaagggggacaccgctaggttggggaggcttagcctgctggcctctgaagggtgcttgttgtcgctaactggctaggggctcagggtcggtagctcctaggggagacgactctggcagtgcgatactacacgtgggcagggcctgcgtgggcccaaccccggggacaagggcttcttccttcacctcgagctacccgcagaccccagtggtcacctcaccagtgacttgtctaatctgtcctgggaccacctgctcctcctcacattccaggaacccacgtacctgggggagagggagccctatggacgggtccccccagcctggggcggagtgcaggctgggtcggggtcgtgttccctggactacctgcacagcctgtgtgggggaaggggaagcccggactccagcacaaagggctcttgtgtgagctgcaggcgccactgggcaggatgcttcctggggatgggctggcaccccgtatgaggctcagggacttctaggggtgccaaagtggggagggctcttcctggggacggccccagcggtctccccaggagtctaggtgatgggggccagccacagacctgcctgacttgggcagtgcagctaagatctggagcctggagcggctggtgggagcccccgcccccagggccatctggagggcacgcacccttcacaggtggctgctgcacacctgggctctagctcggacttgctggcaccgcaatggcagcgagtccctgcacctccatgagccctgctttcttctgtctgccctgacgtggctgctggggggctacctgaggtgacggtaaacacttagtgttccttcgtccttcccacttcgctggcacatgggaaggacttgcaccatcactgccaaggggatggctgctgctcatctttcttggtgcccagctcagggcagaccccaagaaacagtagacgaagccgggcacggtggctcatgcctgtaatcccagcacttttggaggctgaggcgggcagatcacctgaggtcaggagttccagaccaacctgaccaacatggtgaaaccctgtctctactaaaaaaaaaaaaaaaaaaaatacaaaaattagccatgcatggtggctggcacctgtagtcccagctacatgggaggctgaggcaggagaattgcttgaacctgggaggcagaggttgcagtgagccgagatctcgccactgcactccagcttgggtgacagagcaagactccgtctcaaaaaaaaaaaaaaaaaagtagatgaatgactctgcagagttttcccaggcctggcactgcccctggggctgccatgtagccagtgtccccacctgagccctgtggccccccagctccagctctgtcaccagcctcagctccccgcctccctccctcacaggggacacctgccaatgcctgtggcctctgcccctcctccaggaaccttcccgccggccacttcctggcggcccgcagcccccagcctaagcaggtctgactgcccaagtggaaaaacatggatcccatagtttccatgtgaagtcttcccgctgcattccctcctccaaggagggcgggacacggagcgtggcagcaggagccggcggccaaggcagccagcttctctgcttacacacccacccagctgcctgcctgccccctcttccagaccctgtagggaggagctgccgctccaagtcccaccattctctccttcctggtccatctctgaggcaggggatgggggaacctacctaggcagaggcaggagggcctggggttcaggaggaagcagtgcatggtcactgcacgttcagtggatgtcatgccccatgatgacctctgtgtgcattgacaaggtcacacagtgagggagtgacggggctgggacagaacctgggtcggggcactggcgacctgactcataaccattgggttctcttgcatttgggggcagaagcagtgaattccctctggctcttcctggcgtgtctgccttctaggcccctgactcacagtcttctgtctctgcctcctctctgctcccagggacagaagatgtgctccagggtccctctgctgctgccgctgctcctgctactggccctggggcctggggtgcagggctgcccatccggctgccagtgcagccagccacagacagtcttctgcactgcccgccaggggaccacggtgccccgagacgtgccacccgacacggtggggctgtacgtctttgagaacggcatcaccatgctcgacgcaggcagctttgccggcctgccgggcctgcagctcctggacctgtcacagaaccagatcgccagcctgcccagcggggtcttccagccactcgccaacctcagcaacctggacctgacagccaacaggctgcatgaaatcaccaatgagaccttccgtggcctgcggcgcctcgagcgcctctacctgggcaagaaccgcatccgccacatccagcctggtgccttcgacacgctcgaccgcctcctggagctcaagctgcaggacaacgagctgcgggcactgcccccgctgcgcctgccccgcctgctgctgctggacctcagccacaacagcctcctggccctggagcccggcatcctggacactgccaacgtggaggcgctgcggctggctggtctggggctgcagcagctggacgaggggctcttcagccgcttgcgcaacctccacgacctggatgtgtccgacaaccagctggagcgagtgccacctgtgatccgaggcctccggggcctgacgcgcctgcggctggccggcaacacccgcattgcccagctgcggcccgaggacctggccggcctggctgccctgcaggagctggatgtgagcaacctaagcctgcaggccctgcctggcgacctctcgggcctcttcccccgcctgcggctgctggcagctgcccgcaaccccttcaactgcgtgtgccccctgagctggtttggcccctgggtgcgcgagagccacgtcacactggccagccctgaggagacgcgctgccacttcccgcccaagaacgctggccggctgctcctggagcttgactacgccgactttggctgcccagccaccaccaccacagccacagtgcccaccacgaggcccgtggtgcgggagcccacagccttgtcttctagcttggctcctacctggcttagccccacagagccggccactgaggcccccagcccgccctccactgccccaccgactgtagggcctgtcccccagccccaggactgcccaccgtccacctgcctcaatgggggcacatgccacctggggacacggcaccacctggcgtgcttgtgccccgaaggcttcacgggcctgtactgtgagagccagatggggcaggggacacggcccagccctacaccagtcacgccgaggccaccacggtccctgaccctgggcatcgagccggtgagccccacctccctgcgcgtggggctgcagcgctacctccaggggagctccgtgcagctcaggagcctccgtctcacctatcgcaacctatcgggccctgataagcggctggtgacgctgcgactgcctgcctcgctcgctgagtacacggtcacccagctgcggcccaacgccacttactccgtctgtgtcatgcctttggggcccgggcgggtgccggagggcgaggaggcctgcggggaggcccatacacccccagccgtccactccaaccacgccccagtcacccaggcccgcgagggcaacctgccgctcctcattgcgcccgccctggccgcggtgctcctggccgcgctggctgcggtgggggcagcctactgtgtgcggcgggggcgggccatggcagcagcggctcaggacaaagggcaggtggggccaggggctgggcccctggaactggagggagtgaaggtccccttggagccaggcccgaaggcaacagagggcggtggagaggccctgcccagcgggtctgagtgtgaggtgccactcatgggcttcccagggcctggcctccagtcacccctccacgcaaagccctacatctaagccagagagagacagggcagctggggccgggctctcagccagtgagatggccagccccctcctgctgccacaccacgtaagttctcagtcccaacctcggggatgtgtgcagacagggctgtgtgaccacagctgggccctgttccctctggacctcggtctcctcatctgtgagatgctgtggcccagctgacgagccctaacgtccccagaaccgagtgcctatgaggacagtgtccgccctgccctccgcaacgtgcagtccctgggcacggcgggccctgccatgtgctggtaacgcatgcctgggccctgctgggctctcccactccaggcggaccctgggggccagtgaaggaagctcccggaaagagcagagggagagcgggtaggcggctgtgtgactctagtcttggccccaggaagcgaaggaacaaaagaaactggaaaggaagatgctttaggaacatgttttgcttttttaaaatatatatatatttataagagatcctttcccatttattctgggaagatgtttttcaaactcagagacaaggactttggtttttgtaagacaaacgatgatatgaaggccttttgtaagaaaaaataaaagatgaagtgtgtttcttgggctcagccccagggtagaagggctgggtggagggagatgaagaaggagtggccctcgctctggggagccagggcccctcagcagcccctgggcttgggcagccctcccaggtgtcctgacctgggtgccatccaccctaggcttgaatgaggtgaggctgggcccaggtgggagcagggctgcctctggcctcggacaagaacgggtcagggagcctcaccttccccaggccctgtcttctgccagcaggggctctggcccatgtgcggctgggagaggcttgtggcacatgtggggccaggtgagtcccttgtgggttggtctgatgggcagttcactgcctgctttcctccagggacagggccctgggctctctcattccaggcctcatggatggtcccgggagcaagtggcctccgggaccttctctacagcgtcccgggagagccaagcggtttgcatggccccagccccatgccactccactgcccaccatgggcgcagcaggaaatcctgctccctgcctcctgcccctggctacagcgagggctctggtgggaggggaagtgtgaatcatcaaaggcagggaccccatgggtggggagaaaggggccgagccccagtgagcaggacaagctgggggacaggaacaaagggcccaggttggcttgcagacggtgccaggattggtggccttgggatgccccctcagcccctgcattagggatgtgcccaggctttctggaaaccctagaagtgggagcattttccaggaaggctgcatgctgaggtgggggcagtgatgctgagtgcagctgtggcctggactgggtgcagggggcttggggacagtgatggacacacagcaccttttcctgttaccctcagtgggatggaggggaggggacccactgggctgccgctgcaggggcacccagaacatgctggagtgagcctcctgcagaccccatgccactgtcccacaggtcatggccccggcccccagcactcaggctcacccctggtgggacagagtcagcccagccagacccagggagcaggccccgtggcgcgggtgttgatgtcagtgccgagtcaggcccagccacgcgaggctctggattcaattagcggctgctgagggctctggcacgaggagggaggaggcgggccgtgggtcatggcgggcagtgggtggtggcagtgggcctgggtggggccccttcttcctgaggcagcggcggcagcccaggtggatttcctgtaggcctgggtcccattaggggagtggctgcggccaggcctgcctcccccggcccgtggctgcatcgtcaaaggggcctttgtgggcctgaggctgctgctgaacacggcggctgctgaagaaatgttttcactgcaaagcaaacctggccgagtgggatggtggcagggggcagtggcgggggggtggcagggcccaaaaaaaggaagccttccctggaacagtgtctggagtgtgccatcagatcagggcttcggggaaggggagaacccagccagggggcgaccaagctgagatgcagcctcgacccgggacaagccccccgactctaggccagggaccaggggcagacgtgggggtgtgcgagcccccatcaccaggtgctgactgcagcaggccctgggccatgtgggtgacacatgctcttgtttcatgcccggcgacctcgtctattgaaaaggagtggccacagggagggaagacaacatgctcacagtaagtggagacaggaccccagcacctgctccccagccacgggtggggctgccggccacgcgggagggcttagggccactgtgagctacagaagcaatacaccctacttctatgggggtagggggtgatacagttcacccagccccctcacaggcattcacacactcatccccgctcaattcacacccagaagcgtggcacccaagacaggtgtatctctgcatctccaagaccaaagcatgagctgttccttcagtgcaggctgccagtccctctcgttatccccccacctccaccctgcgccaagcatggtaccaagcacacaaagtgctgggcagccctccgtggaggctgcctgagcacagacaggaccttggtgttcgaggctggcctggctcccagcccctgctcctctcactgtggctggcttccccttagatactccacaaatgtcaggggaagggcataggtgggaccacagcggaggcccctgggtgaggatgaggaggggacggggtgtgtgcacgaaccctggcctcctctagctctcataagggcacacactgttctgcccaagccaagatggaaaatctgtaaaacagaagaactcgagggtggtggagtggatgcagttgccaacctccccattagccgtgcccacagatgacactccagactttccatgctcagcctagatttgctcagaggccccggcaccccagggagttagtggggggctccagcttccaggacgcctgggggtgcaggggacctgccacctctcagaacagctggggggctggcacacatccttggcatccaccagcttcatgggggctggcagagcaggggccagggctcgggggcagaggggagaggaccctagcctggccacccatctgggagtgatttgagaaattccagtcctcactggtccttcgaggctattcttaactgtggtaattacagggtcagccttggccagtggcaccgtgaggtctgggcatcattaactcctccagaggccacactggggccgggcaggagacgctttcaggggatggggaccctgtcactgggggcagagcctggaaggcaggaagtggtgggtggaagtgactggtgccaggtcccttcacacaaatgcctccactgggggccctgcagggaaggggctgtctgacctagaaaggtctagaagacaagatgccaggcagctccgggcctgggatgggggacatggggccagatcctagacgtggagtctgaaggcccgggagctccgactcctcaaggcggggcgggtcccactgactcctccctgaatctccaatgcccagagcaggcaggaggctgagggcagccctgactctgcctcttaccctccatatggcttcagggaaggtgccgaatcttgctcacctttgcctccctcatctgtaaaatgggccttgccagcttctcagcccctccctgggtgtgacagggtgggaaagggcgtcactgtcaccctgacccctacccctcctctgggcggctctcagcccggggaagcccttggcaggagctctcgctggtactcaggtgggagctcttctggggactccccggaagatcccgcagccttccttacccccagacacatacccttgctgctcccagagcctggacaggtcactgttgcctgtgactcagtttcctcagttatgcaatggaagaatgaataagcttgccaagtaccacccctttcctggctctgacattctcggatccccctgcctgtgaagattccagcaaggcccttataagtcacggttgaagtttcagaaggcggatggagtccctgtctctccaccccggccctgcctggctacgtctctgaacaccccccccagcctcagtctccccagctgtgttgtgggtggtctgaacagatgagtcactcataaatgcttgccctgggcctcctggtgtctggctcctgagccgcagtgggccaaggccatctcggcacacagctgactgtgcctggccaggaccccgccaggcactgccaaaagccctctccacacacttctgggggcagatggaaggatgaggtgcacctggagccccccaggctgcctgggcaccagccccacctggggacatacctcaggatagaacaggacagccatgtggctggtgtggagtaggccgcataaacctcagtgggccgcataagccaaggcccacctccacctccacctccacctccacccccacccccaccctgccaggctgtccaacaatgcccacgtccaccctcctatcatagcctggagcctccctgggcctcagccctgccagaacatccacagaaaaatgaagcgtattcttgcacttctggatcacaccctctccctgaatgccaagcatacctgtgtcaacccccagccatgaaacctctggtgaccaagggcccactctgctaccaggggccagaggggcacctgagcacctgctgctcgtgacatctggaagctccgggggtacagggccaggtgtctgttgcaaggccttgcagcccagatcaggtaccccagaacaccccggagatcagcccgcctcactgacaggccggatcaggtgccctcacctgcggcgccttgggtcatcagccccccagcccacctgcgtgccgcagctcctacccaagcgaggtgtccaaggtgagggaggccagggcgctggagaagaaccgcgtgtcccacagcttcacttcgcgctcacgcatctgcagggagggcgagagaggggctcagaggggcctgtccctcagccccacccggggggctcccagggaaaccagcgcctgagggtgcagcctgacacggggcacctgccccagagcagggcttggagtgggggtgggagtcaccccagggaaagagaatctgggttttcatgttctgcccctttaagaacccttaggtgacaaaggatgaggggcggttccctctgtgttctcgggtccctgtagggccactatggctcctggggtcaggctgagctattacaaatggaatctgccagttttcagcagccgtcagtcccctgaggctctgagacccggcagcacagccaggccgtatatggacaggcctggaactggccctcagtcccccgcctcccattggtttcgtccccgcccaaagggctggacatgtccccacctggccgtgccctgctcctccaggaggaaccccctacctggttgaatccagtagacacaaggtgctcccaggtgcccatccatgccagccggctatccctgctgttctcatgggcctgcgtgctctgcaggaggcaagaggtggacctgagcccccagggccctgctggtgggcggggccccctggaatgggcctgagctggggaacttctgctgcccacctgcctgaaagcctcacagagggtgggaagggctgggtccttctccacgtccccactgggaccaagggtggtctccgaagcaccccggggatcagccccgcctccgccccagttgagggcagctctgcacccagaggccaacctggctgctcctcccgagtgtccctcctaccaaggagagggctgcctcactccccagctccaggccccttccctgctgcgccaggggctaaaggcactggcactttcttgcccctaagagctgtgtgatcctggggatgtcacactctgtcaatgcctcatttctctcgcttgtgtaaggggctcacgatgcggtgccacccgcttcccagggctgtcaccatgtggaagggcagggcttgtggcaaagcaccgtgtaaactgggggatttcgaggatcactgtggctgccccaggcaagaggcagggcctgggacccacctctgggcaacgtccagagagcgccaagtagtgcctctcctggccctcccgaggtgctggagctgccagcaggaaggctcccggcccctgggaggagagggaagctcacatggtgggtggggccctgtcctcctgggccctggcagtggggagctgagggggccagaggaaatgcaaacagctcctcccagtcaccctggcccctggagcctgagacgaaggaccctgttaccaaaaatagctcaccccaaaccatggccagcttcctccgaacttcccacgatctccttgggaatgaatgagggagggaagcagcctgcgaggagctggcctggggccccctccccagcccgtggaggctgactccagcgtgggagaccatcggaaacggctccaggtcccgtccttcgaggggcttttctcactgttcccttcccaccaggctgtggccggcacaggaagttggggctggagcctgagaaccaaggccccactgccctctctccacgtaagaggggatatcgggtcaggacaagggtcgagccattggccagccctgccctcaacacccggagagggtcacagtgtcattcaggctcctgccctctcgttggtgtttgttgtgcaaatatctgcgtgtgtgcagcccaccaggtggctcttagcttgtccaaaagtcactcattcattcaagaaacacacaaggcctcccaggggccagaactgtgctaggagctggcagtggggccggatggttctcagatagagggcaggtgctggggggaagcagtgcccctcactcatctgttctctcgtcatatgggtatttgagccacacactattcgagatgacatggtgaataaaatggggaaagtccctgtgcccgtggaataaacacatcggggaggtagatgtaggccaaagagaaatcagtgtgtcattccctgtgactatgcatgccatgggggagccgcacggtgttaggggaggaagctctggaggtggacccaggagagccccagcctggccacctcccttggtgggtcagtcactagctctgtgcctcagtttccatgtctgtaaaaagcactgtaacagaatttactttttttttttaacctttcctatggtgctgaaggacctacttttgaagacggccacaaggagtaagagggaacacttgtagaaggctcaggattgtgtctgacacgtgtcaagtgtgcatgtctcacagctgatagcagggtaccgccagactgtaagtgagggaagacctagcgtcattcctgctaggctgggagggttgataggcgtgagccaggtatgggaactggcatctgcaaagagttggaaactggaagcagagagacccgctcagccagcaggtggggacgagggaggcggaggctgggccaagcctgcagggtcccccaggggctgccactgagcacttttcacctaggggcacaggctaaggctaggggtgggacgcccttggcctgtagctcccaccttcctaattcacatgtgggaagcctaaaggcacagagagacgaagccatggtgcaaagtggcttggccccagctgtctcctccacctgcacaagatggacgtgaggctcagagtggtgatgaggcttgcacaaagtcgcagctaggaggcagcagggaagggaggaggagccgcccaggaccacagctgccccagaaacgctctgcttccagcaaacatcctgggccagctcttgctccctggagcattcagcccagccttcagaggtccaggtaagagctttgtccgtgcccagccactccccaatgtgggtacacccagctcagtttgcccagagaccacaggaagcccccaggtgagggagggggtcagtggcccaccccttaccctgtaactcctcatcaatggagtgatcaccagtatcaaaaatgagaggtgggctgggcgcaatggtacctgccgtaatcccaacactttgggaggctgtggtgggaggacggcttgagcccaggagttccagagcagcctgggccacaaactgaaaacttctctcttaaaaaaacaaacactaggccggcacagtggctcacacctgtaatcttggcattttgggaggccgaggcgggtggatcacctgaggtcaggagttcaagaccagcctggccaacatggtgaaaccccatctctaccaaaaatacaaaaattagctgggcatggtggcaggcgcctgtaatcccagctactcgggaggctgaggcgggagaatcgcttgaacctgggaggtggagctcgcagtgagccgagactgtgcccctgtgctccagcctgggtgacagagcaagactctatctcaaaaaacaaacaaacaaacaacccaactagcttgacgtggtggtgcgtgcctgtagtcccagctaccagggaggctgacgcaggaggattgcttgagcccaggaggtcaaagctacagtgagccgtgttggcgccactgcactcccgcctgggcgacagagcgagacccgtttgccagcctcagcaagcctcagagaagagccgtctccccagctcctcattctcctgcatagggggcaagaacaggggctgcagctgggacccaggcatcctgctaccctgcagccccaagagggcccccaccacctagctctgagaataggaggggctgtggcagggcaggagcagtgtcagccccgcagggggtgcaggaggggaggcgcgtgcccgccccttcatcaccatggcgacacttcctgtgcagggcaggatggttccaggagcagccctggctccttgctggggtgaggggacctgcttcaatagtaagaccccccacttacccccttccctcctctgaggttcaccaccccccactggcctgtctgatgcactgagattcctagagggctcaatccggggccccctcccgcccagacaagggttctgaggcctcgacactcatttggggctgccactttcccagaacagcctgggctccagggcctcacccagccccagctgggccggttgtaaagggaaggggcggcagtgggggtcctgggggttctgcatccagaggggcgagcctgcctctgtcaccctgaggtgggaccatggagaagccacagaaccatccgactctcggggtctgcacctccgaggaagtggaatatgccaagtgcctggcgcataacaaagggtcatacatgcagtataagaaccaagcatgggtgtgaggaggagcctccccagggtcccctgctcaaagctcacgcctgaggcagggctccaacaagacagtggagggcggactccctggcccactctgggctccgggatagcaccagggctcaggtggggtgggacccacagaggacagaggttggatggagggcaggcggccccgctccctgacccccagccacaccccactaggcaggaaggaggattgccagagaaggagctcccagaaggcctctccctcgagccggcccctcggctcacaccggccctggctgccagcagcggttttcctaatagaagccaggtgtgggccagatgccctgggcggaagtggggggcagggccacacggagagcggcattccaggcctgctgcccccgcaccagggcccgagcacaggccccagccagcagctggaaggggtgggagccacccacgctcttcccaggtctcctcgccccaaagccccgcaggggggctccctccagaaccagatcctctccctctctcttcgaggagctgggagccccttggatagcagccactctatccccacctcggcatcagtcaccgccccagccctgctggaagaggaggggagaggaggaggaaggctggaaagagggggcggaggaggggagaataggaagaatcacgtgggcccagtgagctggctcagagccatgcccggtaggtcgggggcagaagcataggtgccccagcagtgccctgggctctggagaggagagtgcaacctgagaaagtgaagggggccgggggaagcctctgtggcaccttcaagctgagcctgggccccgctttctgggcaaaggcttggaggtcaaagaaagctacctagtgaggataccgtacacacccacactgccttgagatgcagacagccaccatctaccaggcccaggtcccacatgacgaagaggtcagccagcctcaccagcaagtacgaccagggtgtggccaaaaccaccctgcctggctagtttcactgcttaaatgggagtcctctcggtcttcagctggacaaaagtggaactgactgtaccgtttggactaaaaagctgcaatcttccatgtgactgggtttctctcctgagtcttgtgtgtgtagggggctctggggctccgggctaccactagtttggtttgggctggtggtttgcccttgaccccgggtggggaaaacgtcctagaaatggggagggggtatctatgatgggcctaggtctttgctggggagctcctctcctgagctaacagtaggaccctaaacttcaccttcctcagggaataagcctcctcagcttctagaaagttctttttagaaatgtaaatccatggccaggagcggtagctcacgtctgtaatcccagcactttggcaggccgaggagggtggatcacaaggtcaggagttcgagaccagcctgaccaacatggtgaaaccccgtctccactaaaaatacaaaaaaattagccgggcatggtggcgggcacctgtagttccagctacacaggaggctgaggcagtaaaatcacttgagcctaggaggcggagtttccagcgagccgagattgcgccactgccctccagcctgggtgaaagagcaagactccatctccccacccaaaaaaagaaatgtaaatctactcatcgcacttcctgcttaaaactccctaatggtggccggacacggtggctcaggcctgtaatcccagcactttaggaggccaaggcgggaggatcacgaggtcaggagatcgagaccatcctggctaacatggtgaaacccagtctctactaaaaatacaaaaacaaaaatagccgggcgtggtggcggtcgcctgtagtcccagctactcgggaggctgaggtgagagaatggtgtgaacccaggaggcggaacttgcagtgagccgagatcacaacgctacactccagcctgggcgacagagcgagactccgtctcaaaaaaaaaaaaaaaaaaactctctaatggcttcccacagcccaggtaaccatgggcccgtatcccccagcgcccctcgcgcagacccctcagacaagcccgtcctccttcaggccatctatgtctgcccccttggcattactcaggcctctgctcccgggccagttactcagggaagcactaaaccagcccagcaagagaagcccccagcaactacctgcctagcacaggcaatgtttacggagccagacacagggccctgtcccagggttgttgctcctgcctacaaggtctctgtagggcaaatgaacggtgtcccagtggctggatgcctgcagcatgagccaggtcccagcttccccgcttggaactgaaatggccacgcacactccatgcacagacacaaaccagaacacgctcagtccctggaccctgtacgttttgacaggtcccacccagggtcttcctgcagaggacaggggttgtttctttttggctcctctgcagctggtctctgctgaccgtgccagggtgaaggtctcaaaggaaggaagtgggaatcccagatcgctgcctgaagccacacgatggcctccgtggagagcctgggggaagcttagcttctgccacccggtgatcaaagccaggccctcccaggacccacaacacacttcacaggaagagctcccagcagtggtggtccacctcctggggacccctggtgctgcagaacatgtctgccaggaccccaggcctgcccctacctccacctgctagaaccactgggtcctcagcctcagtggaggcttcaacccaccccagcttgcccacacaactcacctgagaggcccgcggctttgttctggggtcaaagatccgcagctgcttgtcctggaaaagcagagaggaggaaacaacttgcgattagggctggagggtccctggaagccagcctgctcccctcacctcccaacccccagctctgagcagcccatccccagcacgcagggctgccatcacacaccagggcatccctcctcagccctgttcctcctcctcagcacagcagcaaccaccacccagtcccccaggtttctgtgaggagtgttcagctgcctgagacctactcagtgaggagtgttcagcttcctgagacctgctccacgtcaggcatcccagacactcgacccctcctactcttccaactaccctatgaagtggtactatcaccatgatccctcacagacagacaaacggaggtccagaaccaaactctaggctgtcagcgccccacacatgctcagccctgtactaggcccagcctggagaggctcatatgacgacctcatttctgcacttacagaatttagcactaaccaggaagacgagcttacacttccgaaccatccattcggcagttattgattcagattatccaaagggaggatggaaacagacaaaaagcagaaaaaaatgtactgaaataaagcactcatgctttgtatagaccttctttctgtggaacaatgtgtgtgtgcatgcacacgttgtgtgtgtgtgtgtacacaaacattcatgcataaagaaccagggcacaatctgtatccactactacaggctgggccataataattttttttttcttttttgagacagagttttgctctgtcacccatgctggagtgcaatggtgcaatcttggctcactgcaacctctgcctccctggttcaagcgattctcctgccttagcctcccgagtagctgggattacaggcgcccaccaccacatctggctaatttttgtatttttggtagagacggggtttcaccatgttggcaggccggtctcaaactcctgacctcaggtgatccgcccgcctcggcctcccaaaatgctgggattacaggcgtaagccaccatgtttggccataataaattaagtgcaaaaaggaagttgtagaataacatggcatagtgtgattctactgtggtaaaaatcaacaaaaatctccatttgtgtgaccacgatcctgtttgtttttattgatacccaactatcatacagcccatacattttacaagtttgctgagcaaggagaaaggtctggactaacacaggcctgtgtgctaatgctaggtatcaagggtggggaagatgggggctggttaacttttcctttttacgtcttagcacaggtctattttgtttcattcagcacagattcctgttttcatattttgaaaaacagtaaacaactggaatttgaaatgaaaaacaccaccagccaggcatggtggctcacgcctgtaatcccagcactttgcgaggctgaggtgggtggatcacctgaggtcaggagtttgagactagtctggtcaacatggtgaaaccccgtttctactgaaaataaaaaaattagccgggcatggtggcaggcacctgtaatcccagctactcagggggcggaggcaggagaatcgtttgaacctgggagacagtggttgcagtgagctgagattgcaccactgcactccagcctgggcaacagagtgagactcaatctcaaaaaaaaaaaaaaagaaagaaagaaagaaaaacaacatcatttgcaccagtacagataaaaaaaacttgaaatactcatgctcctcaacatacaatggagttacatcccaataaacccgtcttaaattgaaaatatagtaagtatggccaggagaggtggttcatgctggtaatcccagcactcagggaggctgaagcggcagatcacttgaggtcaggagttcgagaccagtctggccaataaggtgaaacctcgtctctaccaaaaatacaaaaattaaccgggcatggtggcacgcacctgtaatcccagctactcgggaggctgagtcaggagaatcacttgaacctgggagacggaggttgcaatgagcttgcagtgaaccgagatcgtgccactacactccagcctgggaaacagactgagactccgtctaaaaaaaaaacaaaaaagctgccgtaggccaggcacagtgggtcctgcctgtaatcccaacactttgggaggccaaagtggaagaatcacttgagccccggaatttgagaccagcctgagcaatacggcaaagtccatcaatggacatttctctctttttgtatttgtttttgtttttgagatggagtttcattcttgtcacccaggctggagtgcagtggcgcgatctcggctcactgcaacctctgcctcccgggttcaagcgattctcctgcctcagcctcccgagtagctgggattacaggtgcacgccaccacgccaggctaattttttgtatttttactagagtcggggttttgccatgttggacaggctggtgtcgaattcctgacctcaggtaatctgcctgccttggcctcccaaagtgctgggattacaggtgtgagtcactgtgcctagccttttttgtttgtttgtttttgagacagagtctcgctctgttgcccaggcccaagcgcagcagtgcaatcacagctcactgcaaatcaacctcctggactaaagcaatcctcccacctcagcttcccaagtatgtgggaccacaggcacaagccaccaggccctgctaatgttttaatatttctttcgtagagatgaggtctcactatcttgagcaggctggttttgaactcctggcctcgagtaatccttctgcctcagcctcccaaagtgctgggattacaggtgtgagccaccaggcctggtttgaatatacattttaaaaatatatatatagaaatggccaaaaagcgtatgaaaatatgttcaatatcactaaccattagagaaacacaaatccaaaccacagtaagatatcccctgacacccattaggatgcctattacatttttaaaaatagcaagtatcaggccgggcgcggtggctcacgcctgtaatcccagcactttgcgaagccaaggctggggggaatcacttgcggtaaggagctcgagacgagcctggccaacatggtgaaaccccgtctctactaaaaatacaaaaattagccgggcgtggtggcgtgcacctgtaataccagctactcgggaggctgaggaaggagaattgcttgaactcaggaggtggaggttgcagtgaaccgagatcatgccattgcactccagcctgggcaacagagcaagactccatctgaaaaaaaaaaaaaaaattgcaaggctgggcgtggtggctcacacctgtaatcccagcacttggggaggccaaggcgggcggatcacaaggtcaggagttcaagaccagtgtggccaacatagtgaaactccgtctctactaaaaatacaaaaattagctgggtttggtggtgtgagactgtgttcccagctactggggaggctgaggcaggagaatcgcatgaacccaggaggcgggggttgcagtgagctgagatggcaccattgcactccagcccaggtgacagtgcgagactccgtctcaaaaaaaaaaaaaaaacaaaaccaactgttggtgggtacgtgaagttagaacccttgcacactgttgatgggattgtaaaatggtgcaactgctatggaaaacagtatggcagttcctcaaaaaattaaaaatagacctagcatgtcttccagcaaccccacttctgggtacatatccaaaagaactgaaagcaggccatgaagagatatttgcacacccatgttcatagcagcactactcgcaatagccaagaagtggaaacaacccaagatctactgatggataaatggataaacaaaatgtggtctgcgcatactatgcagtcttcaaaggcaaggaaatcctactgcacgccacgagtaacccttgacgatgcagcatttcattatgctcagagaaataagtcagccccaaaagagcaaatagtatatgattccacttatgtggggcatctaaagtagtcaaattatagacacagaaaattatagacacagaaagtggaatgccaattcctaggggccgggaggtagggcaaaggggaactgctgtttaatgggtatagagtttcagttctgcaagatgagaaaattctcaaatctgtttcacaacagtgtaaatatacttaacactactgaactgtacacttaaaaatggttaagatggtgaattttggcactttgggaggtcaaggcgggaggatcatttgagcccaggagtttgagaccagcctaggcaacacagtgagatccctgtcgctacagaaaatttaaaaagtagctgggcgtggtggcacgtgctagtagtcccagctactcaggagtctgaggtgggaggactgcttgagccttagagtttgaggctgcagcaagctaaaaaaaaaagaagaaggtaaattttatgatatgtgttttcttaccacaatttaaaaaaatagctattagcccacaaaaatacattgctaagttaaagaagccaatctgaaaagctacatactacataccatataattccaactatatgacattctggaaaagtccaacatacagacaatgaaaagatcagtgcttggcagtgatctgggaggagggcggaagggatgaacaggtggaacccaggggatgttaagagcagtgaaactactccgtatagtggttacattatgtcatgcatttatcacaacccatagaacatacaacacagactgacccctcatgtaaactgtgagctttagttaataataatgtatcaggctgggtatggtggctcaggcctataatcccagcacttcgggaggctgaggtgggtggatcacttgaggtcagaagtttgagaccagcctggtcaacaaggtgaaaccccatctctaaaaatacaaaaaaattaggccaggcatggtggctcacacctgtaatcccagcactttgggaggccgaggtgggtggatcacctgatgtcaggagttcgagatcagcctgaccaacatggagaaaccccgtctctactaaaaatacaaaattagctgggtgtggtggcacatgcctgtaatcccagctactcgggacggggaggcaggagaatcacttgaatctgggaggcagaggttgcggtgagctgagatcgtgccattgcgctccagcctgggcaacaagagtgagactctgtctcaaaaacaaaaacaaaaacaaaaacaaaaaaacaaaaagtagccgggtgtggtggcacgtgcctgtagtcctaactacacaggaggctgaggcatgagaatcacttgaacccagaaggcggagattgcagtgagctgagatcgtgccaatgcactccagcagtgcaataataataataataataataataataataataatgtttaccattggttcctcaattgaaacaacgtaccacactcacgcaggatattcatcacagacactgggggaggaggtaaggaatatggaaaatccttatacaacttgctcactttttctgtaaacttaaaactgttctcgaaaatagtccatcaactaaaacaacccaaaaagaaatgcaggggaaaaccaagtgaattcccgctccatgtgcagcccctccctgagagatgagtagcctccctgctactaccaagttccaggctaagtgctggactctggggcctggaggttgtcacgggaaaccgcggggaagaacttagacctggtcatggaaggacaaacagagcttgtgctgggaaggcaaaggcattcgaggaaggtaaaatagcatgagcaaagaggtggagaaaggaacttgctggtgtgtggcgttgggggaggagaggccacgtgaggaggcagatggtgggaaccaagggggccgtgggcacacgcatggctggcagaggcgggggcctgtctggagagggcctcaaaagccaggtctccctggtctgcctcagcagggccctggttttatgccgctcctggcaaagccctgccagctgcagtttaccaagcacctgctgcgtgccaggcgggcaccaggtacagtccagggactggctcttaaaactccactactccacacctcggattcagagggatggcgagggacagagagaggaggatgagagacagaagacagagaccagagagagaacagcgagggacagcaagggatgagagaggacagagtgggacagaaacagagcacaatgacagagcgggccagagagagcaagtagagatcaaggacagatacaggggacagcaggagacaggcaggacacgagcgacagcaagcgacagaggctctcaggagatgaagggcaggacacgacatccagcagtcagggctgctcctgccccacagaggtgcagagaccgacagcccgagtccagatgccaacaccaccactgaccagctatgacgtgggcaagcccccgagccccctatggtttctttttttcctttttttttttttttgaggttttagtttgtttgtttgtttgttttgagacagagtcttgctctgtcgcccaggctggagtgcaatggtgtgatctcggctcaccgcaacctccacctcccaggttcaagttattctcttgccacagcctcccaagtagctgggattacaggtgcatgccaacatgcctggctaatttttgtatttttagtagaggaggggtttcactatgttggccaggctggtcttgagctccttacctcaggtgatccgcctgcttggcctcccaaagtgctgggattacaggcgtgagccactgcacccggccagttttgttgttgttgttgttgttgttgttttttaagagagagggtcttgctccatcgcccaggctggagtgaagtggctcaatccgagctcacttcagcctcgaactcctgggctcaagcaatcttcctgcctcagcctgggaccacaggcgcgtgccaccatgcctgtctaatgtttgcattttttttgtagacatggggtttcaccatgttgcccgggctgatcttgaactcctgggctcaagtgatcctcccacctcgtcctcccaaagtgctgggatgacaggcgtgagccagcgaccggccacccgcccagccctgtgaactgtgaggatgcggacagcgccacccctgggcagggctgggcgctggggctaagggcggaactcacagcacacactccatgagggcagctgggccaccctcatggaggagcttaacgcggggtccaaaccagggttcagagtgggcactgaggctgctctggctcagcggagaggaactgggctgcagaggccgcgtcctccccggctcatcaggctcaaccatgccgggagtcaggagcgcagcaggccggaatgggccatccgtgaggagagcgcgccccctagcggcctcctgccccttctctcccagctcgggaggccccttcacccagtgggagtagctgagagggagcaggagggggctttggtggtcctgggaggcagacctgctcacacagaggcaggacaggagtggaagccaggggcacggaggcttccccgccaggaaggagatggggcgggggtgggggcacactctggtggaaagtcccatgaccccccacccccatccccatcaggcagcccgtggcatgagcagctccagtgcataaacccagagccaggtgcggctgcaaagaggggctcacgctcgctcctggtgtggggtgggcccatccagcagctccagccacagctcaggacaagccctcgctctctgcacactcatgggcatcactggctgccctaccacagtcaggccgccccccactcccggctccatactgccagggtttccagtgtaggatgcccccaccaggaccccgatgtactccctttacagcaaaagaaggtggcagccgacccagggctgaggtacccattggccctagactgtgctgacaggtgcggcttggaggcaatgctgcgtccccgcaggcggaattcctaggtccaggaaccagggaaggagggggagtcgttccactaagcatcactcccacgacccacttaggaaatgtgtgcttctcgtccctgcaactttaagctctgggtttagcgggggaaaacacatccactggggaagcagcaggagctcctccgtctgtgactcctatgactcttcctgcaagacaccagtaagcaaggagaagagtggccaagccggtggcccatggggctgctcactgtccttccctacacaactgtgatagtaaatagggctcggacccccaggaggagggcctggaccaccacacctgtgacagaggggcagagacagtttctcaaagaaagatgtcacggtcccaaggcagccatccctgagtcctgctgagactacccaggccatcccctctgcctgggacgcccgtcccctccttctcagccagggctcatccctcaaggaccggcctcgagctcactctgcctgggaagccgtccccagcagggttaggtcaaagcacgcataccaggtctccccagaaggggctccctgggggccttattggcccccagagcttaggccagtctctcaggactctctgctcaacgcacaccacagaggaaaaactgatcaagactgggagatgcggcttccacaaaagcagagtacagaaaagaaagttagactagggtccctccaagtatgcagagccctggggcggaatgctcaggtctggtaggcctccctgccctgctagctcctgttcggctccattcccaggcctctcagccattcttcatgtgtcttcaggctcggcacacctccagaagggccctgatgggtgccctcattcccagcaaccccgacaggtcttcagagacccttggtggtacccacggccgcctccctggggaagccctttggccctggtttcaggctccagcctggtcctggctttcctcctcccacctcctcccctgcaggctcttctcatcccctcctgggggcagcactatgtggtcagcaaatcaaacaaacgggaccttttcacctgcagccggattctgctcagagcccctctgggcccagactccactgacacctccaggtaccgccggcagctcagcaaggctgcagccaccctggagcggctctgcctagaacattcacaccaggtgctcctctagcgccccctctctgccacagcacatccccgtcccagtgacaggcctctcctactgcctcaggaccgccacgcctcccacccaatccttctccaacacttggcttcctcctcccaaaggtctccgccactcccggcagagaacagctctcacctccccgcaggctgccacgcatccccctgtagacactgcccctcctgccacacactgtccatgtggttccaaatgcgaatccgctcccctcactgcaccacctgccctactctggcctttaacacttcattgccttcccattacccctacggcaacaggcacaacccttactcaccacccagcacccgcctgccccgcacctgcctgtcctggccccgatccctgcctgaggccacgcgtccctggcctgtccaaccagctcaaagcaccatgtccctcttgcagagcccaggtcacgggtcctcttgtctgtactgtcctcgacggaagtcacctccccagcaactggggcctggcccagcacctgcggccgaatgctgcttaacaagagtcttgcagaaaggctggcggttcagacagaccagacaggcggccagaggaggctgcctgagggtggcgacattagggcgcaaaccagggaccagcgtgggctctcatctgacaggggcctaggcaaggtaggggcttccagatgtaggtgagcgggggtgtgaggagcagctagggggcagggcacacagatgaccatcctgacctcagtgctccactgcctcctaaacaacaagcctggaaggcccagcccagggggtcccagcccaggaggcctgcacagagccccacagggcatccccacctgcctgctcaccttgcacgccgtgcccaccagggctccatctcggctccagacggcgctctgcaccaggtccccatgggctgccagctctgcagagaagcagtcacagtcaggtcccgggcagtgagggcaccagggaagtgggtgggggcgggccttgctggggggaactcccagagcaaaggcagcagctacgagggtccttttcagccaagggggcaagggcagcagcttctcccagacaggcttcccctgcaccacaggctgcttccttcaccccacctttgtgcagccgtacatcactcaactaccttccgaggcttcccgctcctggcctggctctctcatccctcccaggctcacttccaacatagctccccaccaacagggtcactcctgccctaagcctctattcctgccatctatactctccctcgctagtgtgaggtcttaaaatacttctctacattctctgcaactcctgttccaggttaaattgtgctcccctaaaaagatggtgaagtcctaacccccactacttttcggaggcttgctctgtcacccaggctggagtgcagtggtgcaatctcagctcactgcaatctccgcctcctgggttccagcaattctcctgcctcggcttcccaggtagctgggattataggcacctgccaccatgcccagctaatttttgtatttttagcagggacggaatttcaccatgttggccaggctggtctcgaactcctaacctcaagtgatccgcccacctcggcctcccaaagtgctgggatcacaggcatgagccaccgtgcccggcctattattattttttgagacagcatctcactctgttgcccaggctggaatgcagtggtgtgatcatagctaactgcagctttcacctcctgggttcaagtaatcctcccacctcagcctcttgagtacctgggacacagacaggcacacgccaccacgcctggctgattttttaattttttgtagagattgtgtctcactatgttgctcagactaattctcaaaatattgggctcaagcgatcctcccattttggcatcccaaagtgctgggattacaggtgtgcgccacgacgcccatccaagaaggtttttttttggtttttttgttttttgttttttgttttgagatggagtcttgctcttgtcccccagggtggagtgcaatggcacgatctctcttcgctctccatagccactgcaacctctgcctcctgggttcaggcaattctcctgcctcagcctcctgagtagctgggattacaggcacccgccaccacacccagctaagtttttgtatttttagtagagacgcggtttcactatgttggccaggctagtctcgaactcctgacctcgtgatccacccgccttggcctcccaaagtgctgggattacaggcgtgagccaccgcgcccggccaaagttattttttatttttatttttttgagacggcatctcactctgtcacccaggctggagcgcagtggtgcaatctcggctcactgcaacctctgcctcctgggttggagcaatactcttgccgcagccttctgagtagctgggattacaggtgtgtgccaccacgcccggctaatttttgtatatttagtagagacggggttttgccatgttggccaggctggtcttgaactcctgacctcaggtgatccacctacctcggcctcccagagtgttgggattacaggcatgagccaccgcgcccggccattatttttttaaatggagaaaaacaacagaaaaaaaaaaaaacaggtaagaggatgaaactgatggctacggagagcaaagagagatggggtgtttattacagcctcatagaatcttaagacttttatactatgtaagtgtaaaactttgatatctgtttttaaatttatgtgactaaacatgccaacaaagaaacggagtgctgtccagagtggggctgccctgggaagggcaggccagggtggcctgtacctgtcaggggctgctgcttggctgcgtcccagaccttcacagtggtgcctgctgcgctcaccagaatgccgtcagaggtggggtggaactgcagtacctccactgggaggtcctcggggcccagcaccaccccgggtgctgagggcagggcctggccaggccctggcagtcgccagagttttacctgcaagaaagaccaagtccgtgagcacagggctgagggcctcactgccttgagtcagctgccgtgaccccagtgaggtcccgtgttggaactaggctgctccaggagaccacacaccttggccttgggaggagcgcccacccgcctcagcttgcttgggccaggggctgcataccccacatccgagaaaggagggagggaatctcagctcctagaccacacggtgtggtcccagagttggggaagtggctctactgtttctggcagcatccccacctgctgtcctcgggctccaggtcaggtcagagccacggctccaagcaagcccttgggagccagtgtgggaccaggaattcagaccagccccgcagccctggggagtggggtggggctggactgggaggcagcagagccctgtggggatggcgctggggctcagaaggccctggactacgggctgggacatagagcagctcttccaactggctccactcaccgtcctgtcagccgagcctgtggccaggaggaagtcatcaaagggcgagaagtccaagtcggtgactaggtctgtgggagaggaatggctgaacccaccggaatgtcctgtttccaacccagtatgaagcaaagcccagggcttccgaggtgacacttttgtgtgcacacagaaacaggctacaagtctacaagggccctctggacaccatgggggcaaatgccacaggcccctcctgcgacatacgtccccgagggccctgctgacccagggtggccaagggctctggcatcaggaggttggcaggaaatgggcaggaagccgcttgagtcaccaggcacctgcaggaacgcagctgcccagcccgacccctcctagggcagcacagcccactgctccttcagtcgtggaaggtccccaggactcaactaagaaattgctttttggttaagcaagccggagttggctttagttctttgcaaccaaagaacctgaatggtggccgggcatggtggctcatgcctgtaataccaatactttgggaagccaaggtgggcagatcacttgggctcaagagttcaagaccagcctgggcaacacggtgaaaccccgtctctacaaaaaatataaaaattagttgggtgtggtggcgggcgcctatagtcccagctactcaggaggctgaggcaggagaattgcttgaactcaggaggcagaagttggagtgagcagagatcacaccactgcattccagcctgggcagcagagccagaccttgtctcaaaaattaaatactaagaacttgaacggctcagctccagaggtggggaggggtaggtggggtgcacagagtgagccagaccccagagggaaatgcggtgggtggttggggaggtagagactaggcatggagggtggcggggtttcggggtgtgaacaggacgagaggtatcaccagagctgggagcacagcgaccacctgctgctgtctgcctcccaacagggctgagcaggactgtcttcctcccggcctcaggagacagggaaaagataggacggacgtgcacaggcacatcttgggatagccctggcctggaatcccagctggcaggaccacaacattcctgggcctaaagccacagaacccctgctgccctcactctggggtgtgcttgctgggccctgcagggcaaagcaggtccctgggcaggtgtagcagctggcacaggcgggctggcatctcaggcgtgaatgagatgtgatgacataagcaatctgagtgctcagcatgtgctggcaccacagatgcccaggggttgacacgcagggacctcactgaatcctcataaggatgcagcaggtggcactgcagcagcatcccctactggaggatgaggacgccaaaacccagagagggtgagtaactgccccaagtcacgcggctaagagacagggccagcttcagaacctgtgctgctcagcatgacatgctgctgccttttcccactggagcgggccccagctgccgccccacagcctggacatcagaaacgcacccagaagttgctcaccctctgctcccctggctgctgggcggaagggcaagagtggccctgagctgagaggctgaaggggcctctgaaggcagggcaacagccagagccccacctggccatttctcccgacaccggcacctctgaggcagaagggcacctggtgcctctagggcaggttccaggggtgctggagctcaccttcccatgagcagtttcccggcagggctgctcatgcaggcaaggctctgaacagttgcagccacagtgaggctatggacttgcctacaggaccctggtccagcttctacttgaagagccctagtagcagagggctcaccaccttgcaagcatcaccaacttgggctagctccctcatagataaaaagcatcaaaaagtcaaacatgaagccaggtacattggctcatgcctataatctcagcactttgggaggccaaggtgggaagatcacttgaggctaggagttcaggaccagcctgggcaacacagcaaaaccccatctccacaaaacataaaaaaatcagctgggcatggtggtgtgtgcctatagtcccagctactagggaggctgaggatagacgatcccttgagcccaggagttcaagactgcagtgaactatgattgcaccaccacactccagcctggatgacagagacagagaccctgtctctaaaaagacaaacccaaacacaggctcctatagacctgggttctgattctggccctgccataacaatgggtaagttcctaaccttgcaggagtctcagttttcatagctataaaatgggttgttttaaaacctacttcaaagagatctgagattagatgagaacagacttgttatacaagctgccacacacatgtatctctaaaacaacatgctacgtgaaagatgccagattccaaagaccgtgtattgtgcgattccatttgcgtgagatgcgcaaaagaggcccctctatagaggagaggccagtaaacgtctcctgcgaagggcaaggcggtaaatattctaggatttcagggctcaacagtctcggtcacaactcaactctgcagttgttgcaagaaagcaaccacagactatacatcaatgaatgggcgtggcagcgttccaataaaactatttacaaaaacaggcagccagctggatctggccgtgacagtagtttgcagacctctgccacagaggcaggaagcagatcagctgttgcctgaggctgtggtattggaggtggaaatggattaactgcaaaggggcatgcgggatcttttggggatgatggaaacgttccaaaactggatggcagtgcacatgactcggtcactttaataagaatcatcaggctctttacttaaaacaggtaatctgacggggccccaaaactttgggaggccaaggcgggaggatagctcgaggccaggagttcaagaccaggctgggcaacataacaagaccccattttacaaaaaatttttaaaaattagctggaggggtggtggcataaacctgtggtcctgacaacttgggaggctgaggtggaagaattgcttgagcccaggaggtcaaggctacagtgagccatgattatgccactgcactccagcctgagtgacagagcaagaccctgtcacaaaaacaaacaaaaaacaggtaacgttggctgggcctggtggatcacacctgtaatgccagtactttgggaggttgacttgggaggattgcttgagcccagaagtttgagaccagcccgggcaatatagcaagacctcgtctctatatactttttaaaaattttttaaaaaagtttagatgagaaaactcagctaacgtacttagtacagagagcaatctccataaatctttactattgttattaaccaccatcattatcatatcagaacccctccacgaccctgcacacccagcctgaggaccaggcatcaactgccttccctcacccgaaggcctccaaacaagcagccagaaatgcaggccagagagactgggcccgcggccgctgcagctggacagtgagaggcgaggccagctgggctgctctgcctccatctgaggcgagcaaactgttccctcgaggcggacagcctgccaggcaggctgctggacgcccccagaagcagctgcggcacacaaaaggtctctttgtgagggcccatctccacccctgcagcccaacacagcgacctccttggagggccccgagcggctgggctggggaggatgcctggtggagaggggactccagcagaagacggagggctcagagccatccaacgtggagtcctcggcagggacagggagccagcatcagcctggagcctggggcggccactgcacaccccgctccatccagctcacaaccggagcacacagcttccctcctcactgcccaggccggaattctacaccaggaggaagccttctgagccccactgtctctcagagagtgcacagacagggcgacaggagggacctggcaagccatgcggcagtgggaccaggtgaggatgaatttctggccctggagagggaggtgcaagtttcaggcttcacccactagtcagacacccactcacctgaatggcagcccaggtgggccacgcgtcgcttgtcctctccttggccttgcagaggcacaatgcccagtacacctgttaaacaaacacggggactctgacttcaggccccacagggccacccacctccttgcccagggatcccagagatgaaatccagcagctcagcctcggaccttcccagagcctctaccaatcacaagatcatatcctctgcacgtagcaatggcctgtgggtaggttctggccccatgcatgagccatccatgcctcagatggatacagaagacattaggcgagaggtcctctctttttaacacgggtcatacgaaaggggcgtggggctttcgtatggggcttgcagctaccgtcagccacttttcgcacttttacttgagaaagaagccaacacccaaggtggcagagctgagagacccagagaggtcagggccgacagtacatgtgagcctttgggcaccgatctgcctgaagcccctgatctcttagttaggctgaaacattatccattttttgcttaagccagcttgagggtctgagttaccactagcaatcaagagagtgccaaccaacacacgggcttttcaagcctttctgttcctactgtccccagccatccagggcccaaagatgaggagcagggagcacagagggacagctggaaatacaagcgtcagtcccctcccagccctcctggccatgctcttgcctgtggtttgtacacacatatgtcctaatcaaaagcaatcagattactgcgcctggaccagtttgtgggggtctaaggtctggcatggggctcacctctgagccccccaaagcagttccgttccaagtctccaaatacaccaagcctgcccctgctccccaccccatctatggtgacgatgaccgaatatgtgagcaaatatccacactcatggccattccctaccaggacggtcggagttgaaggcgatcaagctgcagcttgatttgatgtggttcctgcatgaaggggcggttcctgctcgaatgtcactgatccaggactgaaaatcaagagtaaagaagtatgtggtgagagccagggttccacctccatgcatgcctaaagcaagaggtggggcataatctggggaactctagctcacagctgcaccattcgagatgcattcttttatttactttttttttctttttgagacagggtctcactctgtcacccaggctagagtgcagtggcgcgatcttggatcactgcaatctctgcctcttgggttcaagtgatcctcctgcctcagcctcctgagtagctgggattacaggcgcccaacaccaagcccagctaatttttgtattgttagtagagatggggtttcaccatgttggccaggctggtctcgaactcctggcctcaagtgatctgcctgccttggtctcccaaagtgctgggattacaggcatgagcctccgcccccagccgtgttgtgttacttcaaatcaaactctgtccccactcacgaagtcccttaggaaatgtaaaatgtgggccaggtgcggtggttcatgcctgtaatcccagcactttgggaggctgaggcagacagatcatcctgaggtcagaagttcgaaaccagcctggccaacatggtgaaaccttatctctactaaaaatacaaaaattatccaggcatggtggcgggcacctacatacaattccagctactcaggaggctgagggaggagaatcacttgaacctgggaggcggaagttgcagtgagccgagatcatgccactgcactcctgcctgggcaacagagcgagactccatctcaaaaaaaaaaaaaaaaagaaaatgcaaaatgtggccaggcctcctccaagtacccggagaaaaacacccaagctcagagaggggaaccaccaaggcctggcctcatcaggacacacctttccacaaagtctcataagtcagtaaaagaaacacccccacccaaggggaggcagaggagcacgtttctgaaactaagatctgcaaggtccacacattttctctgttgtcaaagcaccgctcagcactccttcctgccctcgatgacaggacacccatgtttcccactccacccacccatagcaccccggaaaccacctccaccacctgaagtttctatatcagtgttcacctgccatggttacagcatcagtcccaccctattatttctccctcctgattcatgtttactgtataaacacagtgactgcaaatatctctgaaaagaacagatcacctgttctcccgcctccctaacataaactgttttaagctctccctacagtctgtagttccatgcctatctgtttatgttgctggactaaggcccacccaggagcaagaattagggcccctcaagtattctccagacccctccaagcagtacttaactgcactcagagccaccggctgtcttgatgcaaacctaggtacctcctcctaacttttcttgtttgtttttttctttttttgagacagtgtctcactctattgcccaggctggtgtgtagtggcacaatctcggctcactgcaacctccacttcctcggctcaagagatcctccaacctcagcctcccaagtagctgggaccacgggagtgagtcaccacacctggctaatttttttttctttaacttgttgttcagaggggtttcgcaatgttgcccaggctggtctcgaactcctgagctcaaagcagtccacccaaagtactgggattaccgtgagtcatggtatccagcccctccccctaacttttcaatggctctgcactgcaatcagaataaaacccaacttcttccggtggcccttgggttctgcaggaccactctggactcatctgtcaccatactgctccggccatcccctccatccactcatgctcactttccatttctccaccaggctctttctcaattctcacccttctggcctcagctaaaatgccatctactccaggcagcctttcctgaccacgctactgagactggccccctccattctccatcccagtccctcatgtgtgttcttcaatgtcgttatgaaaacctccaatgctcttgtttgtctgcttgctgtctccctcatgaggctacaagtgccacaggggaaggaaaatgccgttgtgttcaccgggatgtctccagcagcttagcacagcataaagtggaagcagaggaaatatagtccacactacaaaaacggaacctctacccagactgccctgacttgctctgggaccctgatggggtcacttgaggtcaactcctaggcccagttatcggaggacactcccaggccttacaaataacacggaaagcggaagagcagagctgacatcgtttccaaggcgcacccctcatcagtcctcctgccgtttcgggggtccgaagggtctcccggcacctggctcagcaattctttggggctccacctgctcaggcttccccaggccccacccagccgtggcagcatcaccgagataaagaaagagcttgcgccagcggcgagaggaggaagcaccggcggaaacccgagggaggggcgcgtgcggccgaggggctccctccccaccactgacacacttgggctcgccggggccagaggagagaggggcgtctccccacagcccagccaggggcaggggcgacccggggcggcagggaggaggagccaggcgccggcagcgccccgagccccggctcccggcgaggccgaccggaagctgggaaggcaggcggcctcgcaggcctgggccccggctaggagggctgcgccgcctcgggggtcccggggcgaggtgggcgaggcgggcagaccgccagggtcaccgagcgccagagcgagtcacgggagtgccggactctgccctccggcggcgacgaaacggcccggacgccggggccctggcctgaaggggggttccccggggatggaggtctcggggttccagacggccctggagggcacccctgtggggtccgggcagggggaggggcagccggacggggcccgaggcgacagcgcccggtcctcgggccggactcacctcgcggcggggcggccgagcctcggtgtgccggaacttggacaccctgaagcggttcatggcgacgggcacggcggcggacgcgtcttcgaggaccccgggcgtcgggtctcaggtgcacgctgagcaaccgcgactcccgctgcctcggccccacccgggacccaatgccgcggtcacgcccccggcgcgccccactgccaatcgcagccgtctccggccccctgggccacgcccccaagcccctctcctttcgcgcgcgcaccaccggtcccgcctcccggccaatccaggtacggccgccccgcgaggccacgccctgataccgaggggacggactggcgcgggtgggaggtcacgtggggcgcagctgtcagcccacgtctcctgcggtgcttgcttgcgtggggtctcggctgcagcattcgcgattttgtgtgcaggatttgctgtggagtctttgcggtgtacctagcacgccttccagcactatctacctcttcctgtagagaggggagaaattagctccatttcagagacaggaaacccccggctaaaggagagtgtaaactgtcggtccccaggtcacaccagtggtaagaggcagagggggaacaggggcccaggtctaaagcaaatccctgtccaccgggcctactcaaaagcctctgcatccggccaggcgctctgcatccggccaggcgcggtggctcaggtctgtaatcccgaactttgggagactgaggcaggagtatcccttgagcccaagaggtcgaggctgcagttatctgtgaccgtgccactgcactccagcctgggagacagaaagagaccctgcctctaaaaataataataataatagcttttaatttttctttagtatttattcatttatttgacacggagtccctgtcacccaggctggagtgcagtggcgcgatctcagctcactgcaccctctgcctcgcgggttcaagcaattctcttgcctcagcctcccgaatagctgggattacaggcgcctgccaccgcgcccaactaattttttatttttagtaagagacggggtttcaccatgatggtcaggctggtctcgaacgagactcaagcagtcctcccaacttggcctgccaaagtgtggggattataggaatgagccaacgcacccagctgattcttgcatttctaaggtttgaaaagcaatgcttacattttatcttagttcgggcagaagtgtatttactgtgaaccaaagtcacttgtggtttattgaaaaggctttttgtttgtttgttttgagacagagtctcactctgttgcccaggctggagtgcagtggtgtcatctcagctcactgcaacctccacctcctgagttcaagcgattctcctgcttcagcctcccaagcagctgggattacaggtgtgcgccactactcctaatttttgtatttttagtagagatgggattttgccatgttggccaggctggtctcaaactcctgacctcaagtgatccacctgcctcagcctcccaaagtgctgggattagaggcataagccactgcgcccagtccaaaaaggtttttagaaaatcatcaggttggccgggcgcggtagctcacgcctgtaatcccagcactttgggaggccaaggtgggtggatcaccaggtcaggagttcaagaccagcctggccaagatggtgaaaccctgtctgtcctaaaaatataaaaattagctgggcgtggtggtgggtgcttgtaatcccagctacttgggaggctgaggcagagaactgcttgaacccgggaggcggaggttgcagtgagtcgagatcgtgccattgaactccagcttgggtgacagggcgagactctgtctcaaaaaaaaaaaaaaaaagaaaaaaaaagaaaatcatcaagtggctgggcatggtggctcacgcctataatcccagcactttgggaggccgaggtgggtggatcacctgaggtcaggagttcaagaccagcctggccaccatggtgaaaccccgtctctactaaaaatacaaggcgtggtggcaggtgcctgtaatcccagctactcgggaggctgtggcaggagaatcacttgaacccgggaggtggaggttgcaatgagccgagatcatgccattgcactccagtatgggagacaaaagcgagattttgtctcaaaaaaaaaaagaaagaaagaaaatcatcaggacagtggtcccactggatcctaggcgaccgaggcacagctcatcatcccctttcatagggaactgcacctgctacagacatcacagaccagaacatctggaccacacattcctcacccacttggaattgtcctatactctgtgtgaagtaaagaaaatgctatacttaagacaaatcatgcccctgaagagctgggctcaggctcttctgccctctgtaaaagatctctgagctcacatgggagagttgcagccattggcagccatgaacttggccagtcccattatacttcaaatgatcagtggtttcagcaagaaatcacagagaccgtcttgtctcccattgccttcagcccagcactgtcggggagcaccattaaaccccttcgcagctctcacagatatccacagctcaggagatggggaaagtgctctgtggaattgctggtctagtgaaatgaaagtgtggagggggaaacgcttacgactttgtgttccctttgcaagtaacatttgtttctccttttttttttttttttttttgagataaagtctctgttgccaaggcagtgcaatggtgtgatctcagctcaccataacctgtctcctggattaaagtgattttcctacctcagcctcccgagtagctgggattacaggtgcataccaccatgcctggctaatttttgaatttttagtagatatgggatttcgccatgttgcccaggctggtctcaaactcctgagctcaggctgtctgcccacctcggcctcccaaagtgctaggattacaagcgtgagccactgtgcccggcctgtttctccttaaagctcacatttttgagcttctgcctggagaacacgggatcatattctgactggcactgaggataggtgtagcttgtggcttctgcagtctttggcaacaagcctgggatggatccatttgtgtccagttgcagcagaagtccttgaaaggcagggcagcagtttgtacccatggtagtaataaatgcttgccctgcctctcttttgttgtgaaaagcaaatgaaaataagcatgagaaagtacttcagaaactcccaagagccatatgcttgggagatactgatcgcaatgacgattgataggcacgtggtttaaaggaaaaacacacagttttgttgtgagaagacctgggcttgggtcttcattcactcacttactagctgtgtggccttggacaagtcttttcatctttcagagcttattttattgttgttttttttctttgtgggcggggtggtgtccgtttgtaaaaatgggaatagtcctcccgctacctacctcatagggttgggctcatatcaaaatagaaaacaaagccagggaacagtggctcatgcctgtaatctcagcagtttgggagactgaggcgggcagatcacttaaggtcaggagttcgagaccagcctggccaacatggcgaaaccccgtctgtaccaaaaatacaaaattagctgggtgcagtggtgcatgcctgtaatcccagctactcaggaggctgaggcaggagaatcgcttgaacccaggaggtggaggttgcagtgagtcaagatcgtgccattgcactccagcctggacaacaagagcaaaacactgtctcaaaaataaataataataaagtctaaccaaaaagagaccaggcataggcccaggctgctctcagctgggagtctttcccatgtttttctttcttctgtgtggcagatcccaaggactttgtcctctcttttggtaattaccatcatccactccactccttaagagttctctgcttcataatagaaaatactggctccccaacaatcagccttcctgctatccctgaaaacaagaacacacacaccatttcaacgtggaggatttttactgttcatcactatggggaactagatgggggataaacgaaaatacaaagaaaaaaagggggggaagttacaacggtgacagttttcatattactgagctctcctctagttcctaactcactctgaggtagtaaatggaagtccttttggctcttgttttcagcttctatacttgaaagttgttcttctcaaccagcagcatccccccaacccccatttctcctaagttttgggctccccgtgagtaagtaactctgtctgagttcttagtatcctcagtgcttagtacagcctggcacatggggccaacacagattgagcaatggctacgcatcaagtactataggaagcctttacatgattatgtcactcagatgaccctttgaggacattactattttttgttttgctttattttgagacagagtcttgctgtgttgtgcaggctggaatgcagtggcgtgatctcggctcactgcaacctccgcctcccaggttcaagtgattctcctgcctcagtctccccagtaactgggactacaggtgcgcgccaccacgcctggtgaaattttttttttttttttttttgaggaagagtctcactgttgcccaggctggagtgcagtggtgcaatctcagctcactgcagcctccaccccctgggttcaagtgattcccatgcctcagcctccaaagtagctgggattataggcacgtgccgctgtgcccggctcatttttgtatttttgtagtgacagggtttcaccaagtggcccaggctggtcttgaactcctgacctcaggtgatccacctgcctcggcctcccaaagtgctaggattacaggcgtgagccaccacacccggcaatttttgtactctttagtacagatggggtttcaccatgttggccaggctgctcttgaacctcaggtgatccccccacctcggcctcccaaagtgctgagattacaggcgtgagccaccacgcctggccgacgtcgttactattaagtcctcatttatttatttgacatatggtctccatttgtcacccaggctggagtgcggtggcacaatcatggcccattgcagcctcagcctcccagactcaagcaatcctcccacctcagcctctcaaaatgctgggattacaggtgtgagccaccgtgcctggcctatgtccccattctagagaaaaggaaacagaagaacagagtgaagtaagttgcccaaggacacacagctggtaagtggcacagctagaattcaatcccaggctgtctgactccagagctatactctttttttttttttttttttttttttttttgagaaagtgtcttgctctgttgctcaggctgcaatgcagtggcactatcatagctcactgtagacttgaactcctggactgaagtggtcctcccaccttggcctcccaaataactgggaccacaagcatgcgccaccatgcccggccaattaaaaaatttttttttgtaaagatgaggtcttgctatgttgccaaggctggtcttgaacttctgggcccaagtgattctcctgccttggcctcccaaggtgcagggattgacaggcatgagccaccatgcctagcacagaacccatactctttttctctttatttttgagacagagcctcactctgtcgcccaggctggagtgcagtgccgcaatcttggctcactgcaacctccatctccttgattcaagcaattctcctgcctcagcctcccgagtagctgggattataggcgcctaccatcacgcccggctaacttttgtattttcagtagagacgaggtttctccatgttggccaggctagtctccaacacctgacctcaggtgatccgcccgcctcagcctcccaaaatgctaggattacaggtgtgagccaccgcgcctggccacagaacccatactctttttttgtttgagacggagttttgatcttgttgcccaggctggagtgcagtggcgcgatcttggttcactgcaacctctgccttctgggttcaagcgattttcctgcctcagcctccccagtagctggaaatacaggcatgtgccaccatacctggctaatttttgtatttttagtagagacggggtttaactatgttggccagactggtcttgaactcctgacgctgtgatctgccctcctcggcctcccagagcgctgggattacaggcatgagccaccgcgcccagtcagaacccgtatcttttttttttgagacaaagtctcactctgtcacccaggctggagtacagtggcactatctcagctcactgcaacctccgcctcccgggttcaagcaattctcctgcctcagcctcccgagtagctgggattacaggcgcctgccaccattcccggctaatttttgtatttttagtagagacagggtttcatcgtgttggccaggctggtcttgaactcctgacctcaggtgatccgcccgcctcagcctcccagagtgctgggattacaggcgtgagccattgtgcctggcccagaacccatactcttcatcactatgctggtcatttaagtatttgctgaatgtattaaaggaactcttgctcacctcccaacacccttgttcatctcagtcctccccattccgtagcccaaactctctccaactattacttgcaatttacaatagcttggtcactgttcttcaaaggactggtggttttatttatttatttattattattatttttttttgagagggagtttcactcttgttgcccaggctggagtgcaatggcgcgatctcggctcaccgcaacctccgcctcctgggttcaagcaattctcctgcctcagcttcccgagtagctgggattacaggcatgcgccaccacatccagctaattttgtatttttagtagagacagggtttctccatgttggtcaggctagtctcgaactgctgaccttaggtgatccgcctgcctcagcctcccagagtgctgggattacaggcgtgagccaccgtgcctggcaggaccggtggtttttaatcttcgagtctcaatgcctgtggagaatttgacgaaagctatgggtatctacccaaattaacatccacgtacacaaaaatttggtgtacaatgctgggagtagcggggagggggagtagcacagattcccaggctttggggatgggggtgaagatttatgagcacagtttgttttaaatccaaacaagaatcctcaggttttttccccattgcttgaggtggttatgatggtgggagtgtgaaaattgaaagtcctttgcaagactaaccaggtcaggtctcccttcctagcctcatctcatcacatactttttttttttgagacagagtttcgctctttttgcccaggctggagtgcaatggcgtgatctcggctcactgcaacctccaccttccgggttcaagccattctcctgcctcagcctccggagtagctgggattacaggcatgcgccaccacgcccggctaattttgtatttttagtagagacggggtttctccatgttggtcaggctggtctcgaactccggacctcaggtgatccgcccgcctcggcctcccaaagtgctgggattacaggcgtgagccactgcgcccggccaccacttcttttctttttttttttttttttgagatggagtttctcttgcccaggctggagtgcagtggcgcgatcttggctcactgcaacctccgcctcctgggttcaagcgagtctcctgcctcagcctcccgaggagctgggattacaggtgcgtgctaccatgactggctaatttttgtatttttcgtagagacggggtttcaccatgttggccaggctggtctggcactcctgacctcgtgatccgccggcacctcggcctcccaaaatgctggaattacaggcgtgagtcaccgcgaccggcctcatcacatactcttaaatttagggtttaagcaaagaaggcaaacactttcatatcttagacatttgtttcttaagttcaggctacttggaatactccatccctacctgacacacttttcatcgatgttcagtttgaatcttacctcttagaagccctgacatcccaaacttcctctctcccattttagaaatggaatgactccttcaccttgtatgactgtaacagtgcttattcctgtgatagcatttaacattgttagttgctaaggagcctctctcgagtcattgtttgctcctcccgaacagggatggtgtatcaggcatcactgtatccccgatattctagaacatgcatgacacacagtaggcgctcacaagttttactaatttagtttttgggcagcacggctcccattcggaaccagcaagttcactgcaggtttggagaaggctaacacgcttaaggagagagctgaggtcggcgcggtggctctcgcctgtaatcccagcactctgggaggccgagacgggtggatcacgaggtcaggagttcaagacccagcctggccaagatggtgaaaccccgtctctactaaaaatacaaaaaaattagccgggcgcggtggcgcgcgcctgtaatccctgctactcgggagactgaggcagagaattgcttgaacccgggaggaggaggttgcagtgagttgagatcgcgccactgcactccagcctggcgacagagcgagactctctgtcaaaaaaaaaaaaaagaaaaaaaggagaactgagtcttgttagaggaggcgggtggggaatcagcctaagagacagtgagactgcggccaggattctgagggtggcgacgaagatttactagaagcgcgcggagacggcatgagtaaaactcacgcaattcgtcgtaagtctcagggtcagcaggaggaaaccacgcactacatgctgggagcggcgcgacggaggaccgcgttgtatgctgggacttgtagtctcgcccttagccagacccctcggaccacttaagttcggctacattcaaccacgtccttacaccgataacgtacacccattggttgtctagcacagaatagcgaggttctgcacggcgagtctacctaacaacactcttcagagcaaaccccgtttcggcgatggctacccggaaggcgcgttggctgcggctacgcgtacggtgcgcctgcgcgtgcgcgacgcatgcgcctctacgcgcgcccgccgttcccgcgaggcccacctagagccgggcggcgcaggcgcagagtccccgggccaagatggctgcgcggtgctccacacgctggttgctggtggttgtggggaccccgcggctgccggctatatcgggtagaggggcccggccgcccagggagggcgtggtgggggcatggctgagccgcaagctgagcgtccccgcctttgcgtcttccctgacctcttgcggcccccgagcgctgctgacattgagacctggtgtcagccttacaggtgagggcaggttccaacttccgagtggcggtttcagggcctagaaaagagtgagtctcctcgctgtgactacggctgcaggggtagtggggtggagggtgtcttccgacgcggatgcacaattgccggagacacagacaggcaggaggcggggaggccccagtggctgctcagccgtcaaggaagggagagaagcgtggagcccccggcggcggtgatgaaacgccccgtagatcgtgaaccttcacctctctgtcaacatttctggaggccgctgctccctcgtcctcttcctttcccatctctccaccttctagcccgtagcggaagggaagagctaactgccattcggagaggcctaggtactttgttacaacaaccctgcaagatgcctgccgtcatcaccattttaaagaatgagaaactgagattcaacggaggaatcgaccagcccaaggtcatggagttagactagaagagttgtctcaaacccaaagcagtcatgtcatagtttacgctctttctaccacgtggtgctaattgaagggcacagttaacaatctttttagaagtctttagttggtgattgtaataataacacagtcagacatttattgagcacttactgttggccaggcatggttttccccttacatcacatttccacatgataggcactgttattccattttataaagatactgaggcttagatgttaaaccacttataaatgtcacaaggaggtggaggcttgatatcattgcctgagatgacactgaattatacattaagccttgaagtgcttagtcatgttttcttttcttttcttttctttttttttttgaaactgaatcttgctctgttgcccaggccggagtgcagtggctcaatctcgactcactgcaacctccgactcctgggttcaagagattatcctgcctcagcctccccagtagctggaactagaggcatgcgccaccacgcctggccaatttttgtatctttaatagagacgggatttcgccatgttggccaggctggtctcaaactccagacctcaggtgatccgcctccccttggcttcccaaagtgctgggattacaggcgtgaaccaccgtgccctgcttagccttcttttcttatgccgtgtgttttgtgctgtgtgttgtacgtacctgaattgtgctagttttgtgtcctctagaatttgtgcaaatggtatttaagctatctataaatttataaagattaattaaagggccctgacaagataatttataccaactaacttcctgttgcaatccagtttgtaatagttacatagtagacaatcattaaagtatcagtaattgtggttacttcatgcaatgtaaagaaaagagcctgggcttcaggggtgaacttccccagcgtctgtgagcggggtgtattatttaaccccttcgagcacctgtctgaaaattcattcattcacaggtgttaattgaggccaattgtatgccagccactgttctgggcactgaggagatggcagagaacaaagagattggatgtgtgtttggttaagagaatgattatttatgtatttaattattttttaagacagggcctcctgttgcccagactggtgcagaggcacaattacaactcagtgcaaccttgacctcccaggttcaatcgatcctccatcctcagcctcctgagtagctgggactacaggcatgcaccaccacacccagctagttttctgtagatggggtttcaccatgttacccaggctgggctaaagtgattcccttgcttcagcttcccaaagtgctggggttacaggcatcagccactgcacctggccaacagaatgaattttttttttttttgagacggagtctcgctgtgttgcccaggctggagtgcagtggcgctatctcagctcactgcaagctccgcctcccgggttcacgccattctcctgcctcagccttctgagtagctgggactacaggcgcccgccaccacgcccagctaattttttgtatttttagtagagacagggtttcaccgtgttagccaagatggtctcgatctcctgaacttgtgatccacccgcctcagcctcccaaagtgctggaattacaggcttgagccaccgcgaccggccttatttttattttgagatggactcttgctctgttgcccaggccaaattgcagtgatgtgatcctggctcacttcagcctcccaagatgctgggcttataggtgtgtgccaccatgccaggctagatttttcaacatgagcaaaagtggccatttttagagcttgctaacattttctaatgtcaaggttgttttaaatagaatctggctgcatcttttcattcaaatattaatccttaggtgacttgttttattaagccaaatttgttcatgttccagctgtacaaatttgggagcactcgttattattgtgtatgtgaaagagagaaacaggcactaaacactaagctttgtgtgaagctgtgactaaggaactgcggttagctgtcttgttccccaagtgagctcataacctgccatgggcaagttttatatcaggtagtgtacacaggtgagaggtggcatccttcagggtacgtgctgttttcacagatagagtcatcaactggttgggcggggtggctcacgactgtaattccagcgctatgctggcgctgaggcaggaggatcacatgagcctagcagtttgggaccagcctgggcaacataggcagatcccatctctacaaaaagattttttttttttttttttttttttgagacggagtctcactctgtcgcccaggctggagtgcagtggcacgatctcggctcactgcaaactccgcctcccgggttcaggccattctcctgcctcagcctcccgagtagctgggactacaggcacctgcaaccgcgcccagctaattttttgtatttttagtagagatggagtttcactgtgttagccaggacgtctcgatctcctgacctcgtgatccacccgcctccgcctcccaaagtgctgggattacaggtgtgagccaccgcgcccggccaagattttttttgtttgtttgtttgagacggagtcttgctctgtagccaggctggagtgcagtggtgcgatctcggctcaccatgatcttgactcaccgtgatctcggctcaccgcatcctccgcttcctgggttcaagtgatcctcttgcctcagtctcctgagtagctgggactacaggcacgtgccaccactcccagttaatttttgtatttttagcagatactggatttcaccatattggccaggatggtctcgatctctttacccatgatctgtccacctcagcctcctaaagtgctgggattacaggtgtgagtcaccgcgcccggcctacaaaaagatttttaaaaattagctgactgtggccggacatggtggctcacgcctgtaatcccagcactttgggaggcctatgcgggcggatcacctgaagtcaggagtttgagaccagcctgatcaacatggagaaaccccgtctctacaaaaaatacaaaattagccaggcctggtggcgcatgcctgtaaacccgggtactcgggaggctggggcaggagaattgcttgaacgtgaaagtcggaggttgccgtgagccgagttagcgccattgcactccagcctgatcaacaagagcgaaactgtgtctcaaaaaaaaaaaaattagccaactatggtggcaactgcctgtactcccagctgcttgggaggctgaggtgggagtttcacttgagcccagaaggttgaggctgcagtgagccatgatgatgccactgcactccagcctgggcaacagagtatgactctttctctaccaaaaaattaataaagtcatcaactgagaagccatgtggtggcgagcctctatagtcctagctactcaggaggttgaggtgggaggattgctggagtccaggaatttgaatttggcctaggcaacataatgagacccctgtctcttaaaaaaaaaaattttgaaaaggtcattaactcagcgtccaaacactagtctgtgatcttgtctcaaatctagtagtaagatgacataacaacattttagatgtgacttttcttccaagcagaaagaaagcagttgttggtggccaggtatggtggctcatgcctgcaatcccattactttgggaggtgggttgatcgcctgaggtcaggagtttgagaccagcctggccaagatggccaaagcttgtctctactaaaaatagaaaaagttggtcaggcgtggtggcgggttcctgtaatcccagctactcgggaggctgagacaggagaatcgcttgaacccaggaggcagaggttgcagtgagccgagatcgcgccactgccctccagcctgggcaacaagagccaaactccctgtcaaaaaaaaaaaaaaagaaagcagttgttggacagtgggttggccattcttagaacgacttggaggcttattttattctgggttgttctaaaaaggacaggacatttactggtcatatgtgataaaataaatagtctattaaatgaaatctaattattgttaatcattgatgccctatggataatgtcaaaagtcatcagactggggatggtggctcatgcctgtaaccccagcactttggtaggatgaggccggcggatcacttgaggtcaggagttcgagaccagcctggccaacatggtgaaacttcttacctactaaaaatacaaaaattagccaggtgtggtggtgtgcgcctatagtcctggctacttgagaggctaaagcagaagaatcgctcgaacctgggagatggaggttgcagtgaaccgagatcacaccactgcactccagcctgggtgacagagtgagactctgtctcaaaaaaagaaaaaacaaagccatcagtcttgtaattaaacgtgatttgtctttatccacatgcagttttgtgcgttactatctctgtactaactcctgtccgtgttctctgcccgtaatgttgaagccacagctgccacaggtcactaccagcctccgccttgtggcattggaatgagtggtgagagagaggctggactgggccgggcaaccccttactccgaaataaaaagagggttgagtacaagttcaataataagtcaggtctagtgttttctcaagtctgactgaagaaacacaaagtggtctcctgacccctactacttccagtgtgctttttgtatcccgaggatattgggtgtgccaaacacacggatttatttcctatttctaattttaagtatcctgaccattcctatccattctcctgtctgatcatcctttacctggcctcctacttggatgtgctcaaccaacctctggttgtgttttgtgctgattaacttcgagtagtctcccaggcttcctagagttgtttctcttttttttttttcaggtggagtcttgctctgtcgcccaggctggagtgcaatggcgcgatcttggctcactgcaacctcagcctcccaggttcaaacaattctcatgcctcagcctcccaagtagctgggattacaggcgtgcaccaccatgaccggctaatttttgtatttttagtagagacaagatttcaccatgttggccagcttggtctcgaactcctgacctcaagtgatccacccgcctcggcctcccaaagtgctgggattacaataggcgtgagccaccttgcctggcctagagttgtttctcatgcaaacctaatgggttctttgtttaacatttgcagtggctccctattgctcttaggataaaatccagactccttagcatagctctaaggcccttcctattcctaggccccattaatcgttatcatctctaaccaccactaccaccactgccatctagtttagttataggtataaatctgtatggattcaaagtcctctttagcctatttctgtctctctctcttttttttccatgtcataagtttatttacaaacatctagtatgtcatataagttcaagtctttgatccatttatttatttatttttaatagagacagggtctctgtgttgcccaggctggtttcgaactcctgggctcaagcgatcctcacgcctcaggttcccaaagtgctgggattacaggcgagagccactgtgcccaggcttatttttctttctttttttttttcttttttttttctgtgatggagtttcactcctgttgcccaggctggagtgcaatggcgcgatcttggctcactgcaacctctgccccccaggttcaagcgattctcttgcttcagcctccttactagctgggattacaggcatgtaccaccacatccggctaattttgtatttttagtagagatggggtttctccatgttggtcaggctggtctctaactcctgacctcaggtgatccgcccgccttggcctcccaaagtgctgggattacaggcaggagccaccatacccggcccggcttattcactttttaaacagatttcatctattaaaacacctccagtctgggcgtggtggcacacgcctgtagtcccagttacttgggaggctgaggcaggagagtcgcttgaacccagcaggcggaggttgcagtgagccaaaatcgcaccactgcacgccagtctgggcaagaagagcgaaactccgtctcaaaaaacaaagaaacaaaaagcctgccgggcacggtggctcacgccggtaatcccagcactttgggaggtcgaggcaggcggatcatgaggtcaggagatcgagaccatcctggctaacacggcgaaaccccgtctctactaaaaatatgaaaaaattagccgagtgtggtggcaggcgcccgtagtcccagctacttgggaggctgaggcaggagaatggcgtgaacccgggaagtggagcttgcagtgagccaggatggcgccactgcactccagcctgggcgacagagcgagactccatctcaaaaaacaaaaaacctgctcttcctatctgttaagtggatgaactaaaacatccttgtttcttaagcagttggtgtcttgctattaaaaaaggtgctgtgaatccagatccaaagtacaaagtcatcctagttagtaaccgccatttgttttccactgaaagtggcaaatgctttcctgggcagcttagccagtttctgcagcttaacagctgatgcctagaagttcttccccgaccttcttagattgatttgtcattggttctcagcaggggacacttttacttcccaggggacatttggcaatgcctggagacggggagttctctactggcatctagtgggtggagacctcctgagtttctggtgaatgtctggagtagggcttgaacatctgtgttttcatcagtctaatgatgctgttggtccagggagcgcagtcttgagaactgctccttaagtagatacccaaggctgcaagatagagggaaaagaatgtggggagttgttaagcattaaatgtgacagaaaaatatgaaaatatgaaaatacctagcaaatggtaagtgctcatgtggcataagaggggggagctgaatccctttttaatcatctcccagtcaggagtattattcctttagtggtttactgagaccactccagtagtataagcgaggagaatcagcctcatccaatactctgacatagtttaatattaattgaatactgtggcttccttagccattattgaagtgcattagggaacagccctaaagctgtagcctgtgtattagtctgttctcatgcagctaataaagacatacctaagactgggtaaattttaaaggaaagaggtttatttaactcacagttcagcacggctggggaggcctcagcgatcgtggcggaaggggaagcaaacacatccttcttaacatggcagcaggaagaatgagcaaaagggtgagcccctcataaaactatcagatctcatgagaacttactatcgcgagaccagcatggaggtaaccgctcctgtgattcagttacctcccatcaggtccctcccatgacacgtggggattatgggaactaaaattctagttgagatctgggtggggacacagccaaaccttatcagtttgtttgttccttcacagatatagcctggtgggtcatgtactcacagttttcttttgttgagaacattcccagagtgattttctttgttttttcctttttaggaacaaaacataaccctttcatttgtactgcctccttccacacgagtgcccctttggccaaagaagattattatcagatattaggagtgcctcgaaatgccagccagaaagagatcaagaaagcctattatcaggtctgtatggaagtcaggttttggtgaccaaattgtagtaggaatgttgttgatcccatgtgatcctgatcagtacagcgtatgtgcccatatgaataggtctcatgagctgatagtatagaagggtgtgataaagctggactttgctagactgtttttcgatgcacaatgctgtagaggttggtgcttcagaaaaaagaggtgagtccaaaccagagattttaagaagtttttttttctagagctgttttcataattaaatttaatctgtattttctgaatcagtagatatgctagtctaagttttaggtagttattttttgcatccagataaaagtttagaggtttagaattacttcctttcctttcttttttttttttttttttttttttttttgagatggagtctcactccattgctgaggctggagtgcagtggcgcaatcttggctcactgcaacctctgcctcctgggttcaagcagttctcctgtgtccgcctcccaagtagctgggactataggcacctgccaccacacccggctaattttttttgtatttttagtagagacgcggtttcactttgttggtcaggctggtcttaaactcctgacctcaggtgatccacctgcctcagcctcccaaagtgctgggattacaggcgtgagccaccgcgcctggccctttcttaacctggaaaatgtgaaattcccattgtatcccagggtctattagggtagttagggtagctgagtaaagttgtatacgagatgtctacaccactggttcctagacccttggtttgctctgaccaacaaaataaaatcaatattggaggcaccattgtaggattgacagctttttataagtgcacagttcactggagttgtgcacctgtcaccacagtcaactttaggacattttcattacctcgaaaagaaactctgtattcattagcactccccttccattgtcctctctccccggtccctagcagctgctaatctgcgtcctgcctctttggatttgcctattctcaatattcatatacagggaatcatacaatatgtatccttttgtgtgtcttggcttctttcattcacataatgttttcagggttcatctgtgttatagtttgtgtcaatacttcatccctttttatggtcaaataatctgttgcatggattaatcacattttgtttattcatcgtttgatggacatttggatattttccactttttgctatcatgaacagtgctgctatatagacattcatatgtaagtttttgtgtagacatgttttcagttctcttggatatttaggagtatagttgctgagtcatatggtaactggatgtttaaccttttgagaagctgccagcctttttcaaagcagctgcaccattttacattcccaccagcagcatatgagggccatgatttctccacatcccagtgaacacttaactattatcgtctgtctttttaattacgaccctagtgaataagaaatgctatctcgttagagtttcgatttgctttttccctgatgactaatgatggtgagcatctttcttgtgcatgttggctattagtatgtctttggagaaacgtgtgtttggatccattgcccacttttaactgggttgtcttttttttttaattgggttgtaatggaatgaacagaggcatggggacaggaagcagagatcctggcctgtgaagagcgaatggcctgtctcttcctgagctcaagagtcaggtgcctgatccaagagtgggaaaagattgaaaagatggaggctgggttggactcacatgacagttgatttgaggcccttagtaagtcccagagacataatttaagagaaagacttaatttagagaaccattcagatttttaggcacggaagtaaaaagatcaggtaaagctgtagcaattactgtattttatttacctacaaaaataattgaaacagcagagacgtctatttattcagtcattttcttccctttttaaaaattttttcttttttcagacagagtctcgccgtgtggctcaggctggagtgcagtggtgcagtcttggctcactgcaacctctgtctcctgggctcaagcaattctcctgcctcagcctcccgagtacctgtgtttataggcgcgtgtgaccatacctggctaatttttgtatttttagtagagatggggtttcgccatgttggccaggctgttctcaaactcctgacctctggtgatccacccagctcagcatctcaaagtgctgggataacaggcatgagccactgcgcccggccccctttttaaaaatttgtttttcttttttgttcatttacctattctaagccatgctgggtgctaagggcaaagatacatcagaatcagttcctgccctcaagttaagagatggatacattaaaacagatcattattattattattttgtggggcggacagaatctcactccgtcacctaggctggagtgcagtgcctcgatctctgctcactgcaacctccacctcccaggttcaagtgattctcgtgcttcagcctcctgagtagctgggaccacaggcatgtgccaccacgcctgactaattttttctatttttggtggagaggggtttcgctgtgttgcccaggctggtgttgaactcctgagcttaagtgatctgcctgccttcacttcccaaagtgttgggattacaggcgtgagccactgcacccagccgagagacaacttttataaagggaacataattatgactggtatttggggttctgttgtatcgggggttttgttgtttctggtatttggggttcacattgtatctggagtaatttatcatgtttttcccttagcttgccaagaagtatcaccctgacacaaataaggatgatcccaaagccaaggagaagttctcccagctggcagaagcctatgaggtaatatgacttcggtgcatgcggtcactgctgttcagctatgtgtatgaatcaaaggttgcattgctacctgggacagcctggtgtgtcatacagtccagtgtgaaggccatgtccctgcgccaagtaatcttgttaagaaaaataaaaaaaaagagattccaggccaagcatggtggctcactcctgtagtcctagcactttgggaagctgaggcaggaggatcacttgacctcaggagttggcttgaccctaggagtttgagaccagcttgggcaatgtagtaagaccacgtctctacaaaaaaaaaaaaaaaaatcaccaggcgtggtggtggcgcacctgtaaacccagctacttgggaggctgagtcaggttcatcacttgaggggctcaaagctgcagtgacccatgatgccatgattgtgccatagaactatggtctgggcaacagaaaaagaccttctctcaaaaaataaaaaattaaaaaaaaaacaaaacaacaacattctaagactaacttggaatctcaatgaagaacaggatccaggccaggcgtggtggctcatgcctgtaatcccaacactttgggaggccgaggcaggtggatcaccaggtcaggagatcgagaccatcccggctaacacggtgaaaccccgtctctactaaaaataaaaaaaaattagccgggcatggcggcatgcgcctgtagtcccaggtgctggggaggctgaggcaggagaatggcgtgaacccgggaggcggagcttgcagtgagctgagattgcgccactgcactccagcctgggcgacagagcaagaccccgtctcaaaaaaaaaaaaaagaacaggatccaataatctgtactaataaagttccccaggtaatttacacttgtagctggatttgggaattcacagttggattaattaattcagcccttattcaatgacatccccttcctccacctcagggcatcactgctttttggggatagaggttattgtaaaagtagaagcccattattgtcctataagaatgtcaatgtaatcagaggacaaagcatacatctctgaaaacagctattgaccccacttccatagttttctgaaagtagacctttttcccagattttttgacaatcttttctttttttttttttttttttgcttaagagacagggtccctctatgttgcccaggctggtcttgaactcctgagctgaagagatcctcctgcctcagcctctcaaattgctaggattataggtgcaaggcaccagacctgcccgactttggccatcctaaaggggttcagtatatataggagctcatatatctataagagtagacagccacgtagaagaacaggctcaactcagtaaatcttttttgagtaaatatctgtcaactagatctaatgaaaagtttatttactagtgtaattttaaaataatatgttcttattaggtaactcaaactaattgataacataactaaacagtcttggaacctgcttctatggaagataagattaatttttttttttttttcaagagttgaggtctcagccaggtgcagtggcttacgtctataatccctataatcccagcactttgggaggccaagacaggcagatcaggaggtcaggagtttgagaccagcctggccaagagaccagcctgagcaatatggtgaaaccccatctctactaaaaatacaaaaattagccaggtgtggtggtgggtgcctgtaatcccagctattcaggaggctgaggcaggagaattgcttgaacccgggaggcatcagtgagccgaagattgcgccattgtactccagcctgggcaacagagcgagactcccaatcaaaaaaaaaaaaaaaagagttgaggtctcactctgttacctaggctggagtgtagtggcgagatcacagctcactgcagtctcaaactcttgggctcaagcagttttcctgcctcaacctcaacttcctgagtagctgggactacaggttccccactgcacccagaagattcaatttttaatggggcgggggggtgttattcttgtgaatgtgtttttccacatggttagttgatctgatgtttctgccaggggcatgagttttggagagtcctaatccaccgtgttgctgacttctgtcttcaagggggatgttattaaacggaccgagcctcagaacctaagagcagcaattccttgggaagggctggaaccaggagataaaacccaccaggaagtcatgaactcccacctgactcctcctctgccagccttcctcctttgcatcttaactgggtgccctaaaagttaccctaggcaccaagctgtcctccacctgctttcttagtccccctccattctaggtggaagtgtcttttcctttggaggaagcgtactcttttctgtttggccttaaggatagtgcctatttttttgagatagtgtctcactttgttgcccaggctggagtgcaatggtgcaatcacggttcactgcagcctcaacctcaacctccgtgctcaagcaatcctcccacctcagcctcccaagtagctggaactataggcgtgcaccaccattcttggttaatttttttgtatttttcttgtgatggggtttcaccatgttgcccaggctggtcttgaactcatgaactcaagcagtccacctgccttggcctcccaaagtcctgggattacaggtgtgagccaccatactcagcctagggcagtgtctttttaattaaagaaaaaaaaagtaagacaaacacataaaaaaaagatacaaagtgagggccaggcacggtggctcacgcttgtaatcccagcactttgggaggctgaggcagacggatcacgaggtcaagagatcgagaccatcctggcaaacgtggtgaaaccctgtctctactaaaaatacaaaaaaattagctgggcgtggtggtgcatgtctttagtcccaactactcgggaggctgaggcaggagaatcacttgaacccgagaggcagaggttgcagtgagccgagatcgcgccactgcactccagcctggcgacagagcaagactcccgtctcaaaaaaaaaaaaaaagatacaaagtgaatactacatttttccttgtccctccctaatccccctttttgaggtagttagtccttattaacagttttgtgggccaggcccagtggctcatgcctgtaatcccagtattttgggaggtcgaagtgggaggatcgcttgaggccaggagtttgaaagcagcctgggcaacatagcaagaccctgtctctacaaaaacttaaaacaatttgccaggactggtggtgtgcacctgtagacccagctactgtggaggctgaggcaggaggattgcttcaacctgggaggttgaggctgcagtgagctaggattgcaccactgctattgtcgttgctgttacttctgttactccggttgttctggcttgcagaaaacctttcgatgaaggtaagggtaggaagcataaattctctacgaggtaatgtcccctgaggagagaggtgaagtgtgaatctgtgaagaatccagggtgcctgtgaggtcaagcgaggatcaacacaaacattttcccagcatgcgcgacggcgggagagttcgtgagacttttggaagcacttcacgccctacacttagcattcagtttggtcatctcatccctcttctaggtgctagtcacaggcccaccccaacctcataggatgtgtttgcacacagggccacttaataaatgttatggctgccttatttgctgtgaactcttgtctgtattcctgggccttggtagacctgggatgcccagtggctctgcctttcactgtaggttttgagtgatgaggtgaagaggaagcagtacgatgcctacggctctgcaggcttcgatcctggggccagcggctcccagcatagctactggaagggaggccccactgtggaccccgaggagctgttcaggaagatctttggcgagttctcatcctcttcatttggagatttccagaccgtgtttgatcagcctcaggaagtaagttcctcacttggaagaattattcaaattttagactaagtatgggtcaaacaaatttttttatcagtttctgtttctcagaaaggcaaggcagcttaaatggagtgatctggaggcagccattttagtagaaaataatttcagtatttgaaaaatcgcataggtagtaatgagtatgtccattctgatggtattcttaacagttgcataatgaggtagcacctaaggctttcagagcccatgagggtgtgagtgttgtctctcatctgctacagtattccaggagagttctgtccggtgggaaggcactgctgatcctctctcatttatgtccttataagacactgtcagagtggaagagagaggggatatatttatgatctaaattatgattgtggatcattcaggctgtttttaagtgccatgtacgagtatttatctgtgaacattttcagtctgttgaaagtacgttttcatttaagtcatacattatctcttaaaaatcccaaagagtagggcagaattcgttcagtgagtcctacctatgcttacttggcagagtgcaagtaagtacagtggtgaaagagtgactgaaaatgtgggccagtaccctcctttccctttagagccgagcgtcagttttggtcgttgcaaacaaaagttgacaggctgtcccttggtttctttagtacttcatggagttgacattcaatcaagctgcaaagggggtcaacaaggagttcaccgtgaacatcatggacacgtgtgagcgctgcaacggcaaggggaacgagcccggcaccaaggtgcagcattgccactactgtggcggctccggcatggtaaggctctgcccgagactccacctcccacggcttgcaccactgactgagaagagctggttgtggcactgctcccagagaacgtatgctgggaattgggggagttggtgaactcagcctggctgtctttcccccgtgaccctgaggagacgagcctgtgctcctctttccctgataccacaggctcagcaaccagagcacagcagctccgggggcggggcgggggattgcatccagttgtcactttcttctttatttttctaacaattgctttggtaattcaaggggaaataatcttttttaaatgtactgttcagctcccaggagtcttcaggtacttctgtagacaggcggtatcatatttttcagtgtcgtgtggtcaagttgatgatctggagtgcagaagtttgtgtgttctagaaaatcagatgaacagattgaggccctgcacctgggttcctaggcagtgtgtttgagtgcacatgcacataaaaaacaagccttaaagagacatttttcttacgcacattgtggtcccagaaccacccatcagtttacctgcgtacttaggttaccatttttcttgtttttatcaggaaaccatcaacacaggcccttttgtgatgcgttccacgtgtaggagatgtggtggccgcggctccatcatcatatcgccctgtgtggtctgcaggggagcaggacaagccaagcagaaaaagcgagtgatgatccctgtgcctgcaggtgggtgcttgggcccgccatgtccaggagcttggagagggcagacagggttgaggctaccacaccgtgtggagagggtggacagggccgaggccactgcactgagtgtgagtgggctcttggtagaagttatggttgaggccctggagccccaggctggaggaggaactggagtctccttgaatctttctgtttctgccagttatccttaaaatttacactttgcatgtcacaatggggagaagagacctgacgtgcctactctgcttcttcctggtgagggagcagcttccaacccccgggctcctctcctctctcccctgtcttagtcaccgaagccatcattgtccctgctgccaccctatctacatcagccccacggatcccacccctcactccatgtctactgttcccttgcccaaaactcactttctgctttcttttttcggttaactttattcatcttggagatcccagcttgagtatcccttccctagctagcctcacaccctcctccctgttcttttttttttcttttttgagacggagtctcgctctgtcacccaggctggagcgcagtggcccgatctcggcccactgcaagctctgcctcccaggctcatgccattctcctgcctcagcctcccaaggagctgggactacaggcacctgccaccacacccagctaattttttgtatttttagtagagacggggtttcatcgtgttagccaggatggtctcgatctcctgacctcgtgatccacccgcctcggcttcccaaagtgctgagattatagtcatgagccaccgcgcgtggcctgctttactgttgtttagatgtctgtttctctagagttgtgagcatttccattgaagagcatgtctctgtttgtagttatgcattagtgctatcgtttggttaacacccatcaccccagtgagaccatgaactccctgaggtactgcctagaccaagcctgaggcaggtgctcagtcatcaggtgtctgtgttgcatctctggaaggttacccatgtgcctcttagataatgacattgttcctcgttaataagaaacaggagtggggaagaagctgtgggttacaagtggatcttgggtggaaagtgctgtgggaggtctcacaataactgctccctttcttttttttctttttcttttctttttttttttttttttaagacggagtctcgctctgttgccaggctggcgtgtagtggagtgatctcggctcactgcaacctccgcctcctgggttcaagcgattctctttcctcagcctcctgagtagctgggactacaggcgtgtgccaccacgcccagttaatttttagtagagaccaggtttcaccatgttggccaggatggtctcgatctcttgacgtcatgatctgcccgcctcggcctcccaaagtgctgggattacaggcgtgagccaccgcgtcctgcctaacttctccctttctaatgtcccttgtaggagtcgaggatggccagaccgtgaggatgcctgtgggaaaaagggaaattttcattacgttcagggtaggtgccctgccccgcacagcttctgttgggcctttcctctcttcgggtgggtgtggctgaggctgctcccatgtaatcaaagcttcacaggaacatgtctcgccattcatgtttctgaggggcacagtggccacctagatgtggtttttagctgtttgttaccttcaagattctgtgccttgtgtggagagaagacaacttcttcaacatgctaacaagttagaaatacaggtcacataaaaatacaggaaacatcttgtgtttttatgataagattgttgatgaggcagtgagtgtgaaagttacaattttacatactgtatacaggggcaaaccttggttttctgagatggtggaaacattaatgaagacaatgccttctactggcaattgccctcctatgtgtacacctgagaaaaacccacacaagcctagcaggcgataggtacaaaggggtgcacaagagtcctgtccatggtagcaagacactgccttcctccaacaagagaatggctcagtgagccgtggtggtcagaggctgctgcagggcagtcggaaggaaagaatgagagctgaactcaagggatgctccaggcgttgcaggtacagacagcagggatggaaggcagcttgccagtggctgtagggcctcagagaccatctgtgtaaagttttaaaacctgtgagatggcattatgtattatttagggacacggaaatacatagtaagtagaagcttgtaggaatgataaatgttaaagtcagggttgtggttagctgaggagggcaagactcaccggtgtttatgatgttttattttattttactttattttttgaggtggggtattgctttgttgcctaggatgaaatgcagtggggcagtcttggctcactgtagcctcagactccctgggctcaggtgatcctcccacctcagcctcctgagtagctgggactacaggcacacgccaccaggcccggctgacttttgtatctttagtaaagatgaggtttcaccatgttgcccagggtggtctcaaaccccagggctcaaatgatccacccaccttggcctcccaaagtgctgggattacaggtatgagccactgcgcccggcctgtgatattttgttacctccactgggttgtgggtatgacatgcttgttatattatttactcttcccttttttttcttttttttttctggaaagagagtcttgctctgttgcccagtctggagtgcagtggcatgatctcagctcactgcaacctccacctcccaggttcaagcgattctcttgcctcagcctcctgagtagctgggactacaggcatgcgccactacacccaggtaatttttgtatttttagtagagatggggtttcaccatgttggcaggctggtctcgaattcctgacctcaggtgatccacccaccttagccttccaaagtgctgggattacaagcgtgagccaccacggctggcctatactttctaataaagtaagatttttttttttttttttttgaggtggagtctcgctctgttgctcaggctggagtgcagtggtgtgatctctgttcagtgcaaacttcatctcccaggttcaagtggatcttctgcctcagcctcctgagtagctgggattacaggggcccgccaccacacctggttaatttttgtatttttagtagagacaaggtttcaccatgttggtcagtctggtctcaaactcctgacctcaggtgatccactcaccttggcctcccaaagtgctgggattacaggtgtgtgccactgtgcctggctaaagtaagattaaaaaaaaaaaatcaaaagccagttttacatttttgtttcccttcacgattgaatggcttgatctgagactgaggaaatccaggcacgcttccatttcggcatttcaagtgtgtagaacattgcagtgttgaaatatgtagaacatgtcattcctgggcctgggatggtgtctccttgttggaaggacagttctttccctcaacactgcactttatgtatggaaggggtgtgtagtttgtcaggtctgagcttgggcctggccaggcatgcagctggtgtttagtctgcagtggacttatcttcacatgcatctgtcatgtttggccttaggtgcagaaaagccctgtgttccggagggacggcgcagacatccactccgacctctttatttctatagctcaggctcttcttgggggtacagccagagcccagggcctgtacgagacgatcaacgtgacggtaagagggtgtgagaacacctttgtcacccctgtactttattgctctttttctgaaatggaaaagaactgaccagtggcctggaacccatgagtgaccagcatgtgggggggcactcacaggggaggacatgaggaattttaggctgctccttgagtgtggaccacaagccacaggccttgagtctataatcgcatgggaagcagttcctggctggcatcactcccacactggttagcggggcctgggaactgggcgcattcaggacacagaagggttcaccctgggttgtgctctctgcacttgcttctgtccagtgtctggctccaagagcagaagactcgggcggtgcatatcccttttgccacagtgatggctgcctgtgtgctgccagcacctgtcccccacctctctcttgacctgcccctccagctcttcccacctccaggccacatcattctctgtattcgcctcagaaccttctccagcttctttgtggggaaccttggggtaacctccatgaaggaggtgggcattttgggccaaggctttctcctccatctgggggctattccctggcttctccagggtcctgtggttccaagggccagggagcgacctcagccacgcaccctgtattggcttttcctgctttgctccctcactcctgcttcctgggctcacttgcccaaactcttgccccctcatcctagtcacaggctctgctctgggcagacccaacttagctcatttccatgtgcttgtgggcgggcttggcccagaaacccaagtggtggttctttttttttttttgagatggagtctcgctttgtcgtcaggtgcacgccaccacacctggctaattttttgtattttagtagagacagggtttcaccgtatttcccaggctggtcttcaactcctgatctcaggcagttcacccgcctcggcctcccaaagtgctgggattaaaaggcgtgagccactgcgcccagcccagtggcagttcttttttttttttttttttttttttgagacagagtcttgctctgtcgccaggctggagtgcagtagcgcgatcttggctcgtggcaatctccgcctcccaggttcaagcgattcccacctcagcctcctgagtacctgggcctacaagcacgcgccaccatgcctggctaattttttgtattttagtagcgatggggtttcaccatgttggccaggaaggtctcaatcacctgacctcgtgatctgcctgcctcagccccccaaagtgctgggattacaggcatgagccactgcgcccggcctttttttttacccaccccctccaccaccgctctgccgagacagagtcttgctctgtcagccagagctggagtgcaatggcacaatcttggctcactgcaacctccgcctcccgggttcaagcaattctcctacctcagcctcctgagtagctgagattacaggtgcacgttaccatgccctgctgatttttgtatttttagtagagacggggtttcatcatgttggccaggcaggtcttgaactcctgacctcgtgatcagcctgcctcgacctcccaaagtgatgggagcgtgagccagtggtagttcttttcaaggaattcctatcaagattgtcttcatgtagtgaaaactttttatttgagcaactggggaccaggggaaaccacagattttctttctttatagatcccccctgggactcagacagaccagaagattcggatgggtgggaaaggcatcccccggattaacagctacggctacggagaccactacatccacatcaagatacgagttccaaagtaagtgccccctaggctgtggccaagcccgcctggtcctgcggtggcactgcccttggagctctgtggcttgggcaggttactgctccctgtaagtcaggtggttcctgcccgagttatctgtctgtaaagtggacatagtagaatggtcaacttctttttttttgagatggagtctcgctgtgtcccccaggctggagtgcagtggcgccatctcggctcactgcaacctccgcttcccaggttcaagcgattctcctgcctcagcctcccgagtagctgggattacaggtgcctgccaccatgcccggctaattttttgtatttttagtagagatggggtttcaccgtgttagccagagtggcctcaatctcctgacctagtgatccacccaccttggcctcccaaagtgttgggattacaggcgtgagccaccatgcccggccagaatggtcgacttcttggagttgttgggagaattaaatgaacaacacataggaattgctttgctgctgctgctattgttgattttcttcttttttttttgagaaggaatctgtcactgtgttgcccaggctggaatgtggtggtgccatttcagctcactgcaacctcctcctccccagttcaaatgattctcctgcctcagcctcccgagtagctgggactacaggcgcttaccaccacgcccagctaatttttgtatttttagtagagacggagtttcactggccaggctaatctcgaactcctgacctcaggtgatctgcccaccttgacttcccaaagtggtgggattacaggtgtgagccagcacgcctggcccgttgcttttcttgttgatgttactagcactgttaggagctggagaggtggcctgggcagagtgctgtgggtacctagggcgggacatgcctgactcccctcgggagcactcatgctttttgttaattagataatttctttttttttttttgagatggtgtctagctctgtctctaggtggagttcagtggtgcaatctccacctcccagatttaagcaattctcctgcctcagcctcccaagtagctgggactataggcatgtgccgccacgcccagctaatttttgtattttcagtagagacggggtttcaccttgttggccaggatggtctctatctcctgaccttgtgatccgcccaccttggcctcccaaaatgctgggattacaggcatgagccactgcgcctggcctaattagataatttcttacttgcttcacatacacactggtaaaatctgtttcccctcctgtaaactgtatttagcatagccacagtgacacttgtttaaatgacttagtgtagggtgttttaggagcttttctgtacagaagctttgagggcatggtccttaggttctcaccgctgcactggctcagggtgtccgcccctgccaaggttgggtccctctcttcccatgtgctgcgagggtgctggctgcctgtgagttctttccaaagcttcccggcggaagccttggctgctgactctgctcggtccacaggaggctaacgagccggcagcagagcctgatcctgagctacgccgaggacgagacagatgtggaggggacggtgaacggcgtcaccctcaccagctctggtaaggagtctgaagactacatggtgacacgtgggggcctcagagccccccagggtatggacaattcagggcagcatgttggggtttccacttcgggttcttcatgaagcctttaaaatgtgcagttgaaagaggggggctgtgggcggggacagcgggcagggagccgcagcccccagtccaagcttcgcctcctctctctgtgtgtgtttctgtgctgaggtgagagcaccagggcacttcctgcaggcagctctgcgtgtctcagacccagtgttctgagttctattcttggttctgccacttgccctgtgacctcggacaaatccttccctgagagctcctggcaaaagcgtaaggagagagcatggattggaaggatttgtgcacttcccacctgggacactccgccaggatttcagagtgtcttaaaacaacagcagccacagcagtggagccgcagtcagcagactccgtccgccgctttagagcaggactccctccaagttatctagccgtgaacagatgcaccatttaccctgagctcagacatcgtgctagcgagtggctgtgttagggatctgtcaccagaacacctgctgtgggcgctgagacaatggcaccccagctgcagcccctcttcccatggggtctggggcctctttcctgggactcctggctcagggcagggcaggctgtgcccaggggtccttggttcaggcggcatgtatttcctcctcattgcatcattttgtttttgtttggatcctgggtggagttctcagaacttgagcagccttagattagtgcatggtaattcgtagcaggtgtttggagctgggggccgattttccaataaagtggaggatttggagctccaggggcaggggcaggggctgggatggaagtccctggaatttcactgagctcctgttgctcccaggggactggaattcctctgttaaaaagcagctgccggccgggcgcagtggctcttgcctgtaatcccagcactttgggaggcaggggcaggtggatcacttgaagtcaggagtttgagaccagcctggacagcatggcgaaaccccatccctactaaaaatacaaaaattagctgggtatggtggtgcatgcctgtaatctcagctactcaggacgctgaggcaggagaatcgcttgaacccaggaggcagaggatgcagtgagccaagaccacaccactgcactccagcttgggtgacagtgagactctctgaaaaaaaaaaaaaaaaaaaaaaaaagggcctggcgcggtggctcacgcctgtaatcctagcactttgggacgccgaggagggtggatcacgaggtcaggagtttgagaccagcctgaccaacatggtgaaaccctgtctctactaaaaaaaaaaaaaaaatacaaaaactagcggggcatggtggtgggcatccataatcccagctactctggaggctgaggcaggataattgcttgaatccaggaggcagagggtgcagtgagccaagattgcaccactgcactacagcctgggtgacatagcgagactctgtctcaaaaaaacaacaacaaaaaagcagctgccacaaaactctgtagcccaaccaggttccaaatgtcacttattttaatggtttggtacatatactgtgtatatgtatactatcttttgttcttgttgtatctcttgaactaaaatagaagtggtaatagagtagctattccccggaactctaatcagtgcacctgtggcttctccttcctcaaaccctacaatcacataacatgcgagattggttccatagacagctgtccttccctcctcccgcccatcagggtagcttgaggtgtgctacggccgggccctgggtgggttcgtgggtgttgcttactctgttggaggttgggtattactggtcaccagttgatgttttgaccctctctctgatactgtaagttgaaagttgattccgccacccactgagatcctttgtcacttccatggttacttgtcctgatcactcagcctcactcagctgttccctcactcagccaggatgtcttctcctgtgtgcaagacactgtcagctcttccttttaaagatcttggtgaggccggatgcagcggctcacacctataatcccagcactttgggcggctaatgcaggaagatcacttgaacccaggagttcgagaccagcctgggcaatatagcgagactctgtctctacaaaaaatttcaaaactagccaggtgcaaagtagtatgcacctctatcaccagctacttgggaagctgagatgagaagatcacttgagccttagtactcaaggctgcggtgagtcatgacagcgacactgtactccagcctgggtgccagggcaagactctgtccctaagcatacaccgtcacatgtcagtctgctgcctgtgggtggttaagtctctcattatactgtgaagacagttagttttgcatccacatatgacagtattacaggacatataattctcatgtcctaagaacttaagcaacagtgggatttatttatttatttgaggcagagtcttgctctgtggcccagcctggagtgcagtggtgcagtcatagctcacggcagcctcaaactcctggactcaagtgatcctcccaccttggcctcccagagtgttggaattacagacatgagccactgtgcctgaccagcatagtttttgatgcgtttagtatcttaatgtagctgctgaaaaccttaagagctgaccccggtctcccagaaagaccatggtgtgcttagagactcagcacttgcagggataaacaggtccatcttctggcgaacagagagggaactgggggggcttgcaattactatgtgactttttgagtgagagacacagtatggctccttgttgttctttttttttttttctttttttggagacggagtctcactctgtcacccgggccggagtgcagtggcgtgatctcggctcactgcaacgcactctgcctcttgggttcaaccaattctgcctcagcctcccgagtagctgggactacaggtgcatgccgcccctggctaattttttgtattttagtagagatgggtttcaccatgttcgaggccggtctcgaactcctgagctcaggcaatccgcctgccttggcctcccaaagtgcggggattacaggcgtgagccactgtgcccggccttttcttttttgagactgggtctcactctgttttatgtagcctccctcaccccttcccggggacctgtggccccaaactttggacctttcactagcgaaggcaccttcttacttagactgaggcctttactcttttatgcactgtgcgtggcctaggtctctgagcacattaaaaatgagctctacaattaacatgccaagttcaggtctatattctaactcacaacaaaagtgtgcactccttgtctagtagttggcaaatctgtaacacgtttgtgtgagaaagtacctctagatggtgtcagcctgggccctaaagaaattgcagcacagcttccctaggttgagagcatttaggttaggtgccccaaatggggacaacttgctcagggagatagactgctgatgtgagggatgagatggagtgcctgtgacaaaggattgtgcgtggccgtgactcccacatgggctgttctgcagggtctttgcgcacacagcagcatggaatctggccagttggtctagagtagggtttttcttggcagtcattatttaccttcttatagccaacagcatggtggttgagtctcagctttggagtcagactgcatgggctcgcactcagtcctccctcccgcttgttggctctgtggccttgggtaaaccctgtaacctctctgtgcctcctttttttgttttttcatctgtgaaatttgcctgtaaggaagtgtatggcctggcctgggaggtgcctggcacttgactgtgtttttgtcactgttgctcagatagagacagctgtcatagtccgtctctatttcttgtttccctgctgtgggtccttgattgaaagagcagttgggagaccctcaggctctgagtggcctgttcacctcagtcgtctgcaaggtgaggcatcctgtgccatcttaggagtggcccccactcttcttgaggtggcacttggccgcttcttgaacgtgggcccctgggtggccaggcgggggtaggtgggccctgggatgtgactgtggaagtgcaggcccatgacgccagttctttctgctgtttgtgcccaggtggcagcaccatggatagctccgcaggaagcaaggctaggcgtgaggctggggaggacgaggagggattcctttccaaacttaagaaaatgtttacctcatgatatcccagccgaggtaggaaaaccctggaggttttttttccctttgttttcctctgtgaactaatcctggttttctcccactttaaccaatattgtgcccccacccccaggagttggaacaggtgccagtccaaggtgtggtaaacctagctccactaggagctggcctctcagcctagggaatagatgacgtggcaatcagcctgtagtgcaggactggctgggctgccgcggccagcctctggctgtgtcttcttcctggggaggtggcgatgctggggctgttgtacagcccccctgcagtggtgggtccggcttgcccatggtcacagagggcgagtcaggcagagccaggcctagaactcagatctcctcacgtcctgcctgcttggaagctgccctcctgcgtggacagcgcagggctgtgcaagcctgggggctgctccaggggtagcgcttgctcgccgtgtcatcttgggacccactttggtttattatgctcatctcagcaagtggggttctcgcccctctcttggcacagctgctttccagggattaacagacgctccccacaggggtgtgttcccttgaaatgttgagtataaggtaacagcctatctctttggctcaggaaaaagatccactggaaactaggccgggaagcagcagcccctccaagggccagggcacctgggagacgggaggattccagaacagcagcactgagctcccacccgcagagcctctggacggccttggcaacagcaaaatcatgggacaacacctctctccacggaaaggtcacagtggacagcccgggcagtaggatgcagccccagaggctggtggcagtttcctgtccattggtaggtgacggcccctggctcaggcagagggagatggttagactcttgcagggctaaaactctaatttggaattgaatattgtggatatcttagttaaaggccatgcttacagcttagaaatgaagccttaagctgcatcaagttacgaagtgattaatttccttctcagcaaacctccgggaggttccagaatgagttcttcctgacaggttgtcttcactgggagcgtggggcccccaggccccaccagcaccgtcctcccctaatgaggggccctgccgaggcatcagctgctctgctcagttagtttttattcccggggtaccaagcagctgcacagtcggtgcctgggaggcacgtagaggcccagagagtccctgggggttctgctctgaccgtgtgggtggtgatccttgtcaggatgtacagtccttgctcccaccccatccgggatggccgcctgtccctgactattgagtcctgttgttgtaagccaggcatggagggctcctgcccttctgctgagccacagcccattgcagcactgtgctggccagacttcagctgccttgggaactgaagccctgccactgttgctagtcaggggcttggttctcccacttacactgttgacatctattttctgaagtgtgtttaaattattcagtgctaatcattgttttttcctttgtaaatgttgattcagaaaaggaaagcacaggctaagcagttgaaggttccccaccattcagtgagagcagaacccccattccccagcctctgctggtagcatgtcgcagtttccatgtgtttcaggatcttcgggctgtcgttagacaggttaatgaagaacacttctcaacagtttcctttttgttttcctttataattcactaaaataaagcatctattagtgtctgatttaggaatgtaaaatgattctgtattaatgtaaataagattatctattgcaaaaagatatttcaaacctaaattgtggtcatttcttctttgaaagaattcagacagcctctgcaggtggcttatgggggttacaggagacttggctggcctcatcctgtgctcacagccacccagagcacatagaggcagatgggtctggggtgccgacagtgctgaccctcacttggattccagagcagggtgcttgccatgacacaacagtcccctgtgagtgaatgttctagaatctggatgtgacttttttcttgggagcccatgctgtgagagctggccaatgtccctgggtccctgcatttcagtctccctcactggattgtttcccttcattctttccagtctttgcatcttttacattcaattttattttattttttttttaaatggagtctcgctgtgtcgcccatactggagtgaagtgataccatctctgctcactgcaacctctgcctcctgggttcaagcgattctcctgtctcaggcttctgagtagctgggactacaggtgcatgccaccacgcttggctaatttttgtatttttagtagagatggggggtttcaccatgttggccaggctggtcttgaacttctgacctcaggtgatccgcccacctcggcctcccaaagtgctgggattacaggtgtgagccaccatgcctgaccaaaatttttatgtattatagtttggctactctgggttcccagccacgctctatgcctggcgtggctagaggggccctgatacacagctcagtccactctggcactctgggctgagcagggtgagatgagagtctgtttgctgggtcaggtggagaagagactcgggaaagagctgacggacaggagaggctcagcagtgacattctgctcatctcagatacttcccagtattttcatcaatgaaatactgattgcctgcctactgtggacactcagtatggaccaggccctattctagttcctggggatacagcagtggggagctagaccgtgtctcttgtgaaagcttgggcttattcctggaacagtcaccctgagtctcattcatgtcctattgcttcaaagcagaagtctagagaaagactttggaagagaaaggtggattttcttgctaaacagaaaccattgttgtgttgaagcatccttccctcaagggattagaggtggctgtgcatgaccaggcgaggtggctcacacctataatcccagcactttgggaggctgaggcgggtggatcacctgaggttaggagttcaagaccagcctggccaacatggtgaaaccccgtctctataaaaatacaaaaaaattagccaggcgtggtggcacatgcatgttatccaagcttctcaggaggctgagacaggagaatcacttgaactcaggaggtggaggttgcagtgattggagatcatgccattgcactccggcctgggcgacagtgcgagacttcatctcaaaaaaaaaaaggtggccgtgcaacagctgtagaattcagtgctctttctgggcctgggtttggtttatttccacttgtgctcctgatgtatttgttaccagacttctttatagcttctgagtagtagtatgtatttaaaaatataagaaaagggccaggcatggtggctcacgcctgtaatctgaacactttaggaggccaaggagggaggaatgtgtgagcccaggagcgagagagtgagacccccatctctacaaaaaaattctaaaaaattagctgggagtggtggcttggcacctgtagtcccagctacttagaaatcttgaggtggcaggattgcttgagctgaggagttcaaggctccagtgagctgtgatcatgcaactccactccagtctaggtgacagagccagaccatgtctcaagaaaataaagtatttctaggcctgtgagcctgtgggaggtacatgtttggcacttgcttaaacattaggagggtgggccgggcgtggtggctcacacctgtaatcccagcactttgggaggccaaggtgggcggatcatgaggtcacgagttcaagaccagcctagccaacatggtgaaaccctgtctctactaaaaatacaaaaattagccagacttggtggtgggcgcctgtaatccgagctactcggcaggctgaggcaggagatccgcttgaaccctggaggtggaggttgcagtgagccaggattgcgccactggattccagcctgggtgacagggtgagactccatctcaaaaaaaacattaggagggtggacaaggccagctctcaggcattggtcctcagccccattcccacctcaggcctgggactgggttgtttccaacctgagccccctcctcactcatagtcctttgggttctggtggcctggcctttgtttccttccctgtcaaccaaacagtgtgcaagaattctctccaggcccacaggcctccagctgcccctgcccctctgtgtttgtagcactgcagagccggctctgatgtggaggacggcagctgcacggctcctggaagaggcttgtttcacactcttgcttgttaataaatactgtgcaggtcttatcttttaactagaagttctgcttatttctcatgactcttcaagggtcacaaatgggccaggggggaacataaaaggcgaagtgggtccatagttatatggccaagggcatgatccacagaccttagcttactggtcacctcccccgatgctgctcctgtccccatttatttatccttcctgttttgttttttgcagcccttatgtcaatttgttttttgggttttgttttgtttttgagacaggctttcactctgttgccctggctggcttgtggtggtgcaatcacagctcaccacagccttgacctcctgggctcaagtgatcctcctaccacagcttcctgagtagctgggagtacaggcacatgccaccacgcctgccaccatttcttctgtttttttgtttttgaggcagagtctccctctgtcgcccaggctggagtgcagtggtacaatctcggctcaccacaacctccacctcctgggttcagctgattctcctgcctcagcctcctgagtagctgccggcacacgccaccacgcccagctaatttttgtattttttggtagagacagggttttgccatgttgaccaagttggtttcgaactcccaacctcaactgatccacctgccttggcctcccaaagtgctgggattacaggcatgagccaccacgcctggccctagtttcttttgtatttcttttttttaggtagagatggggtcttgctatgttgcccaggctggtctcgaactcctgaactcaagccatcctccacctcagcgtcccaaagtgccggaattacaggcgtagatacataactatttattgtgtgtttctatcaggctctcccactaaatataagctcctcaaggcaggcagcataactttttttgctacattgtatttagggcccagcatactggtaaattgtcaaagaaatgcttcagtcaatggatagaatgaatttttgtgcctgggggtgccagagccagggtggggaagtaaaaaaataaaaactgtgatggtagtcacacaaacctaaatgtgttgaattgaaattcacagaactgctgggctcagtggctcatacctgtacgataatcccagctactcaggaggttgaggtggaaggatcacttaagcctgggaggtgaaggctgcagtgagctatgactgtgccactgcactccagcctgggcaacagagcgagaccttgactctttaaaaaaaaaaaaaaaaaaaaaaaaaattggccaggcgcggtggcttatgcctgtaatcccaacactttggaaggccgaggcgggcggatcacgaggtcaagagatcgagaccatcctggacaatatggtgaaaccccgtctctactaaaaatacaaaaattagctggacgtgatggtgcatgcttgtaatcccagctactcgggaggctgaggcaggagaatcacttgaacccaggaggtggaggctgcagtgagctgggatcgtgccactgcaccccagcctgggtgacagagggagactccgtctcaaaaaaaaaaaaaaaaaaaaaaatcggagctgccatggaccacaaactctcaggcaaataactggtctctcggcctctgaccctcttctctgtgacccaccccagcaagcaaggtgggttgtttctccttcagttttgcttcccagcagtgtccaattactgtgcgttgtggaccacagctctgccacatccgattttcctttttccaacctgtttgaagttcacctgtgtccaggatggtaccccaaggccggctccttccaggacaaggatgaggagagaaagggagaagcccatatctcccccgcctccctgcagagcctgtctccagttcacatgtgcagatggcctcactagctctggagatgaaaggggtgtgtcagaagctcggctcctggggctcctctgtgtcctgtgctatgtccccgtctgtgaatgaatttcaaatgtgggaacagaggctgctggtcagagctgttctgctagctgaggtcagaacaggccacttcacacctgtctgactaaacacgtttaggtcactcgtcccagtcaccaagtgatcccttcagccttggaccctcccttactgctgtgttggtacagccctggagccaccccttactgctgtgttggtacaaccccgggtcccctcacttactgctgtgttggtacagccctggaccccccccccccgctccaacttactgctgtgttggtacagccccggaccctccccaaccacttactgttgtgttggtacacaactaccaccccaacccaagtcctggaagcagagtcctcttctcctggaagccatctgggagaacaatggctttattcagatgttggtgcctctgcccctctggtgcccccgatccccacaaggggccgcgaggcgggcaggtcacagcaggttgaagtcccctttgtgctgttccagccactggtccagcgtcagggccttggggttgagtctcagggtcagctcgatgtcacggtcgggtctcagggcatagaaacggaacatgttggccaggtcccgggcaccgggaaagccaagcttttcgtagtcctcaggagtcatctggaagcagaggagcctgtcgtggccggcgtcctccagtgccccgggaggtggcggggcagggaggccggatgggctggggtctcccgacctgctacacccagagccactattgtctcggtccctgacccaggtcctccgtacaaggtcatttgaaaacttctaagagccgaaagttcagaaactgctgctctcctgagctgcctgacattgtagatcagtttaaagattgttcttggccagatgctgtggctcatgcccgtaatccctgcactttgggaggctgaggcaggcaaatctcttgaggccaggagttcgagaccagcgtggccaacacgataaaaccccgtctctttcaaaaatacaaaaattagccagcctggtggtaggtgcgtgtaatcccagctacttaggaggctgagacaggagaatcgcttgaaaccaggaggtggaggttgcagtgagctgagatcaccccactgtactccagcctgggcaacaagagtgagaccctgtctcaaaaatgaataaataaaaagactattattttcagatcatgagacgaaaatatctcagtcccttccaaatcagagacctgcctgcatcactttctttctcaaaaaccaaagcttgaccagacacagtggctcacacctgtcatcccagcactttgggaggtggaggtgggaggatcgcttgagcccaggagttaggcccaccacgccgggctaattttttgtatttttagtagagacggggtttcaccgtgttagtcaggatggtctcgatttcctgaccttgtaattgcccgcctcagcctcccaaagtgctaggattacaggtgtgagctaccgcgcctgacccaactttcgtcttttaaggactccagtgtttcccagattcttttttttttttggagttggagtctcgctctgtcgcccagtctggagtgcagtggcatctcggctcgctgcaaactctgcctcctgagttcaagcgattctcttgcctcagcctcccaagtagctgggattacaggcgcctgccaccacacccggctaatttgtttatttttagtagagatggggtttcaccctgttggccaggctggtctcaaactcctgacctcaggtgatccacctgcctcggcctcccaaagtgctgggattacaggcgtgagctactgcacccagcctcccagattctttaatgagtatgtcttactttcctaatggtaatgacaaacattagaaaccaggtacccaagagtctgtccagtaggcctcctgcccacccagccaggccaatgggggcaggggtcggccctatctttctagcctctttccctttaaatcccctcccacaggggaggggtcgggtctatctttccagactcttttctcttcaaattccctcccacagaggagcccggcagggcctgcattttcacccctccttgccttggctcctatggccctctcctcctggaagcttttctctctatttggtcaaaacatctaagccagaaatttcactctgtggccagttagctcctggaacagcagaaaataaacgttgacgatgaacgaatgaatttagatgtactgcccagaggtgtgggcagccctggacacaccctccctacgggagctagaaagccctgacaaggatgcctgagtcacctggggcgggaggcccaccttggcatcgtgcacgaccttgcgggtgtgcttggtgagcagggcagcgtactcctcggccgtgtgcctgcaagtgctcagcccgatgttctggccgacgtatttttctggcatcttcaaaaggctgagcaccacaggacccaggtcagacacggacatgccatccatgggaacgtcacctgtgggcaagcctgtggggcagagacgtgagctggtatatgtcccgagggcagacaggggcagggacagagcccctctccaaagggtccaagctggttcttcccagcagtcagctgcacactccagcactcgggcatagctaagacaagtcttgctatttgtggtagcacagaggcagcagtggaattgagtcaggaaacgggatggaatccgggtactgccacctagggcaggctgttgaggctctctgagcctgggttgctgcattcctagaatggggctaagaacctgggcctgcccagctctctcagcgctaggatgacagagaagggacaaaggaaaaggactctgaaagctgctacagagagtgtggctggagcccagggtctccgctaatctggaggcaccagcctgaagtactctgtcatatcctagattcctggaagctggaacgtccacctctgagtagatactccaaataccaactcacttaccaggaatcctgattaaccagacaccaacggctggcctagagcagcacgtccatgataaatgcttcataaatcctgaatgaatgaatgactcgcaaacttccaggctgaggttttgtagatggggaggctggcaactgtctgggtgtggcctgtggaatgcttgggtcctatcctccttacctagagacaggggccagtgcagcttcctgttcagatcacctgggagctcgagggcacagagcgcacagaccggagcaggagatatccctgactgcaggtttttttttttttttttttttgagatggagtctcgctctgtcgcccaggctggagtgcagtggcgcaatcttggctcaccacaagctccacctcccgggttcacaccattctcctgcctcagcctcccgagtagctgggactacaggcgcctgccgccacacccggctaagtttttgtatttttagtagagacaggggtttcaccaagttagccatgatggtctcgatctcctgaacctcgtgatccgccctcctcggcctcccaaagtgctgggattacaggcgtaagccaccgtgcccggccttttttttttgagacggggtcttgctctgtcacccaggctggagtgcagtgccacgatctcggctcactgcaacctctgcctcctgggttcaagcgattcttctgcctcagcctcccgagtagctgggattacaggcgtgcaccaccacgccaggctggctaatttttgtatttttagtagagatggggtttcacaccatgctggccaggctggtctcaaactcctgaactggtggtctgcccacctcggcttcccaaagtgctgggattacaggcgtaagccactgcgcctggccagctttgcaaactataataaatggtggtaccaaagggctactgttaccaccagacttggcccgccaggtgagcaggactcccatgggctgggcccttatgcgagggtgacctggcattcaaccagagggtaaggagtggccagccagaggcaccaacccctcctgccctgatcactgagtgaccagcaggacacaggttgggtgagccttgttcccagccagggccagtgcacctaacctgtttatagccccaatgggcactgagaagaaagagctttcctagtttgtgaaatctgcaactgaacttcattttccaaatcctctcctcgtctttggtttttttgttttgttttgttttgttttgtttgttttgagacggagtgttgctcttgtcgcctaggctagagtgcagtggcacaatctcagctcactgcaacctccacctcctgggttcaagcgattcccctgcctcagcctccctagtagctgccagtacaggtgggtggcaccacgcccagctaatttttgtatttttagtagagatggggtttcaccatgttggccaggctggtctccccgcctcagcctcccaaagtgctgggactacaggcataagccacagcgcccggccctcctcatctttgaaggagaactgacaatcactaggtcctctctgtaaagccttccaatggaccaagcgaatatcgtgtcaccaccatctcagcagatcttgccacccctgcaaacattggtatagagcccatctcacagaacaggaagctgaggccccgcaagctgacaggatgtgctcagtcctgggcctaacgtgagggagccacggcttgaacctggcaccacgtgacagcggcccgcggtctgttacaccaacggctttacagggtgagagctctgcctcaccgtgtgcgagaaagggcacttactcagcaagtagctctttccgtctggggctttctggggcaagaagtgggagaggaggttctcaaaatagcagggcagccgcacactggtcatgggaacgccaatgtcccggaaatattcctccacctcccctttgccgtcaaagtgcgcggcggccaatctccctgccgtcagcttcttgatgttctccaggccgctgtagaccacatagtggaggcccaggcgcctggccagatcagcgagcagcttcccctggagggcagggaaggagagatcacaaggctcagaagaaggatgtctgtccctggtcacagccccagcattctaatcccggagcggccaccatctgcgaggttaacatctagaccccacttacccttgaggaggccccctctcctggaatgatgttcacacatgacaccacgcccgtaaacacagccccggaagccttctaccagccactgactctggcccaccatgtgcaacataggacgggggggcaggtcggctgcagggggacggcctgcatggaggtctaaaggagaatgcacacgtcccatctctgctggtgtgagaacaccctgcccatggagctcagccatcttccttggagagccctgggaggctatacagaggcaccacagctgcctaggttcaaatcaggctctgccatgtacgagcagtgtgaccccagagaagtgatggcaccatcctgacctcgctggtaaaatgcagatgacaacactacctactgcatgaggtgacgcagagattcggacggtggcctccaaaaagatatgccgcatcctcattcctgaaaactgtgaatgtgaccttattcggaaaaagggtcttggcagatgtaattacgtgaaggatcttgagatgggaacatcctgcactaactagataggcgctaaatccagtaaccagggtacttataagagacgggagaagagacaacacctggagaaggccatgcgaagagggaagcggagattggagctttgtggccacaagcccaggaacacctggagccatgagaagccagaaacagtgaagaaggatttccctcaaaccccttgttttgttttgttttttaagatggactctcactctgtcacccaggcaggagtgcagtggcgtgatctctgctcactgcagcctccgcttcctggattcaagcaattctcctgcctcaccctcctgagtcgctgggactacaggtgcccgccaccatgcctggctaatttttgtattttttgtagagacagggttttgctgtgttggccaggctggtcttgaactcctgaccttaagtgatctgcccacctcagcctcccaaagtgctgggattacaagcataaactaccacgcctggcctccaagactctggagagagggtgacattgctgacaccttgattttgaacttctagcttctagaatatcagagaatcgatttctgtggtttttgtttttgtttttgagacagagtctagctctgtcgctcaggccggagtgcagtggcacaatcttggctcactgcaacctccgcctcttgggttcaagcaattctcctgcctcagcctcctgagtagctgggattacaggcgcccaccaccatgcccagctaatttttgtatttttagtagagacagggtttcactgtgttggccaggatggtctcaaactcctgacttcaagtgatctgcccgcctcggcctcccaaagtgtggggattacaagcatgagccactgtgcccagctgatttctatggttttaagccacgtggattgtggtcctttttcgtgacagtaccaggaagcccacagggaatcatcaggattagaaataagatctgctgggctgggcgcagtggctcatgcccgcagtcccagcactttgggaggccgaggcaggcggatcgcctgaggccgggagttagagaccagcttgaccaacatggagaaaccccgtctgtactaaaaatacaaaaaaattaccagggcatggtgacgcatgcatgtaatctcagctattcgggaggctggggcaggagaataacttgaacccaggaggcggaggttgcggtgagccaagattgcgccattgcatgccagcctgggcaacaaaagcgaaactcggcctcaaaaaataaagaaagaaataagatcagctcagggccgggcatgtggcttacgcctgtaatcccagcactttgggaggccgaggtgggcggatcacctgaggtcaggagttcaagaccagcctggccaacatggtgaaaccccgcctctactaaaaatacaaaaattagttgggtgtgctggtacacacctataatcccagctactcgggaggctgaggcagaagaattgcttgaatctgggaggcagaggttgcagtgagccgagatcaccccactgcactccggcctgggcgacagagcaagactcagtctcaaaaaaaaaaaaaaaaaaaagatctgcgttaatcagagaagttgtctttgtctgctctatataatgggcttctaggtaagaccataattgaagaaagggtcaaggctaataacaagtttggatgggtacacgtggacatgaaggcaacaacagacactgggaaccacgggagggagggaggcaagggttgaaaacctacctactgggtactgtgcccactacctgggtgacaggtccagtcacaccccagacctcagcatcactcaatataccaatgtaacaaacctgtgcatgtacccctgaatctaaaataaaagtggaaattactttttaaaaaaaacttctaacatttttgattaaaaaaaaaaaaaacaaacgaacaggccaggcgtggttgctcacggagactgagacggcctcaaacaaacaaaaaaaaagtaattggatgagaaagcaacagcgtccacctgcttcacagcctagagcaggcagaggcatgaagaagagggaaaggcctgcagtgctccaacctccctgcagagtcggagctcctcccaggcgctctgctcctagcctggccgggcctccctgcagctcctgcctgccctcacctgcttgacctcctgctcctggctgcagctctcccagtaattggtcacgatgaaggtggcgtaagccccattcagggccagctccatgatgacctggtcatcttggtctccctgcactacttctgcaccttgcagcctcagctcctttgctgccttcttcctagggtttcgggtcaccactcgaaccttgaatgtcccatcttccaggagtgtgcgggccacggagccaccctgggcacctacaaagaatcaaaaagacctctcaggtcagacctacctgaaagtcccactgaagggcgaaaccccgaagggagtgctccaccacagcaaggagcatccaggaaaccttctcaacgacgattctcattcaggtatttttattttctttattttatttttttgagatggagtctcactctatcacccaggctgaagtgcagtggcacgatcttggcttggtgaaaccccgcctctatcaaaaaatacaaaaattagctgggtgtgaaggcacatgcctgtactcccagctactcaggaggctgaggcacgagaattgctggaacccaggaggcggaggttgcagtgagctgagattgcgccactgcaccacagcctgggtgacacagcgagaatctgtattaaaaaaaaaaaaaaaaggccaggcatggtggctcacgcctgtaatcacagcactttgggaggccaggccgagtggatcaccaggtaaggagaccgagaccatcctggctaacacagtgaaaccctgtctctgctaaaaatacaaacttagccgggcgtggtggcacccgcctgtagtcacagctactcaggaggctaaggcaggagaatcgcttgaacacaggaggcggaggttgcagtgagcccagatcacgccactgcactccagcctgggtgacaaagtgagattccctctcaaaaaaaaaaaaaaaaaaaaaaaaagggcctggtgcagtggctcacacctgtaatcctagcactttgagaggccgaggggggtagatcacctgaagttgggagtttgagaacagcccgaccaacatggagaaaccactgtctctactaaaaatacaaaattagctaggcgtggtggcacatgcctgtaatcccagctactcgagaggctgaggcaggagaatcgcttgaacccaggaggcagaggttgcggtgagccgagatcgcgccattgcactccagcctgggcaacaagagcgaaacttggtctcaaaaaaataaaggtaaaaatatttgtgatgtaataaagtaaaaaaagtagaatacaaaaccatattcaggctgggtgcagtggctgtaatcctagcactttgggaggctgagacaggtggatcacgaggtcaggagctcaagaccagcctagccaagatggtgaaaccccgtctctactaaaaataaaaaaatgaggccgggtgcagtagctcacaactgtaatcccagcactttgggaggccgaggcgggcggatcatgaggtcaggagatcgagaccatcctggctaacacggtgaaaccctgtctctactaaaaatacaaaaacttagccgggcgtggtggcgggcgcctgtagtcccagctactcgggagactgaggcaggagaatggcatgaacccaggaggtggagcttgcagtgagccgagatcgcgccactgcactccagcctggacgacagagcaagactccgtctcaaaaaaaaaaaaaaattagctgggcatggtggagcctgtaatcccagctacttgggaggctgaggcaggagaatcgcttgaaccagggtggcagaggttgcagtgagccgagattgggccactgcactccagcctgggtgacacagtgagactctgtctcaaaacaaaagaaaaaaccatattcagatcttgatgggatttgaattcttcctgaagtagaatataaagccatattcagatacacaaccatattcagatctgctcaaaaacgagacaaagaaaaatagttaacagaaaggaatacaaaaacttattcagatctcgatggagcttgagtcacacaggcatgcgcatcggtcagatgtacccttaagattttgcgcgttgcagctgggcccaggggctcatgcctgtaatccagacactttgggaggctgaggcacgcagatctcttgagctcaggagtttgagaccagcctgggcaacatggtgaaaccatatctctacaaaaaaaaaccaaaaattagctgggcgtggtggcatgtgcctgtagtcccagctaccagggaggctgaggctggaggaaagcctgaacccaggaggttgaggctgcagtgagccgtgatcacaccactgcacgccagcctgggtaacagagtaaggccctgtctccaaaaaaaaaaaaaaaaaaaaattctttattatatgtatattttacctcataattaaaaataatctataaacaaatactgaattctagctaatgttatgcatgctttagtatggaagggcggtgtacacatatctgcaatttacacagaaatgcatcaaaaataaggactgaggccgggcacagtagctcatagctgtaatctaagcactttgggagggtaagggggatgggttttgcttgaggccaggagtttgagaccagcctaggcagcagggtgagacccagtctctacaaaaaattaaaaaatcagctgggcctgttagcgctcatctgaagtcccagctactcaggcgaatgagtcaggaggattgcttgaggcttggaagtcaaagctgtagtgagtgatgattgagccactgcactccagcctgggcaacagagcaagaccctgactcagaaaaaagtgtacaccaatgttccatggcagcattattcataatagccaaaaagtggaaataaatcaagtatccatccactgacgaatggacaaacagaatatagtctatccatacggtggaatattactcagccataaaaataagtaaagctgtcaggagttcgagaccagcctgaccaacatggtgaaaccccgtctctactaaaaaatacaaaattagctgggtgtggtggtgcacacctgtaatcccagctacttgggaggctgaggcaggagaattgcttgaacccgggaggcagaggttgcagcgagcagagatcacaccattgcactccagcctgggcaacaagagagaaactctgtcttaaaaataaaaaagtaaagttggccgggcgcggtggctcaagcctctaatcccagcactttaggaagctgaagtgggcagatcacctgaggtcaggagtttgagaccagcctggccacatggcaaaaccccatctctattaaaaatacaaaaattagccaggcatggtggctcacgcctgtagtccctgctactcaggagggtgagacaggagaatcgcttgaacccgagtggcagaagttgcagtgagcagagatcacgccactgcactgctgcctgggcaacagagcgggactctgtctcaaaaaaaaaaaaaaaaagagtaaagcccggacacacactacaacatgaacaaaccttgaaaacatgctaactgaagaagccagagagaaaaggctacatattatgattttattcatatgaaatgtcccgaatagacaaatccatagaaaccaaaagtagattggagctttctaggggttggctgggaggagtaagaatggggagtaactgttcacgggttcatggagttcttttttttttttttttttttgagatcaggtctcactctgttgcccaggctggagtgcagtggcacaatcaggtcactgcagccttgacctgctggactcaggtgatcctcccacctcaacctcctaggtagctataggtgcatgacaccacgccccactaatttttgtatttttttgtagagacgagattttgccctgttgttcaggctggtctcaaacacctcagctcaagcgatctgcccatttggtccaactaaagtgctgggattacagggttgagccactgcacctgggccagagtttctttttggagtgatggaaattttctaaaattgattgtggtgatggttgtacaattctatgaatacactagaaaccagtgagttgcacactttaaacaggtagattgtatagtacgtgaattatatctcaataaagctgttagagatattaaatatgtataaataagaaaaaataggaatgaaataatatgctatcatttgaaaaaatgataacatgttatctactctggcaggatattcaagaaacttggtaacagcaatagatgaggtggaagaggaggctaggaagaagatttaattttggtatcatgttcaagtactcctattcaaataagttaagtaactcatttttttttaatttggaaagcaggtctggcgtggtggttcatgcctgtaatacctgcactttgggaggccgaggcgggtcatcacctgaggtcaggagtttgagaccagcctgaccaatatgatgaaaccccgtctctactaaaaatacaaaaattagccgggcgtggtggcatgcccttgtaatcccagctactcgggaggctgagacaggagaatcgcttcaacccgggaggcaaaggttgcaatgagccgagatcgtgccatcgcactgcagcctgggtgacagagcaaaactccgtccaaaaaaaaaaaaattggaaagcaatttgggcctcgttcctgcgaccacagccccaacctgggtcgggggtcccagtgaccttacccctccctgcagaccccaggacgggcggtcttcagggctaggcgccctggctctgcaagggccccagtctggggtttggctcacctgtgcctccgaaaaccaccaccagtttcttgtccaccatgaggacgagaatgggacgaatccggtccagagatctgggggtaatgggaggcgtggagttgggggtggggccggggttcccgccaggagcgacaaaggacacccccattgtctatgcatcgagtatgtgtcgaagggggcggctgggcccggagcggcaagacgcctgtcccgagatatcggggtcccgcgacccacctcgtgtcccttgggcccgatcccctcctccttcccgcctcccccggttccagtcacccgccccccggcccgggtcccaccggctggagtgacctcctcgccgcggcctgggcgggacaagttccaggagcccgggaccccgattctgcggccgagtccactgcagaggcggggatggagctgcgcgctaggcgccaactccctccccgcagctccggccccacctggcagagcgccgctcacggaagcccagcgtcggaggacccctggctgcagccgccaatcccgacgtgtcggccgaaacccctcctccggcgcagttggctcctcctggatcccgcgggactcggcgtcgtttccgggtttgcccgccccaggcacgtgcacagtgagtttgtgtaaatccagttagaccaaaatgagcgaggtggagagcctcttaaccggatgctacgggtgatgactgggaggaggagaaaaattacctctttatcttgcatgaacatcttaattttcaggtattgggcgtcaggcaaagataattaaagctatgtccatgagtcttatcccttgaggccttgtccgcttgatattttctttgcctaactcacttttaaaattttattatttttatttttttgagacagtgtcttggtccgtcgcccaggctggtgtgcagtggcgcgatctcggcttactgcaacctccgccccccgggttcaagagattctcctgcctcagcctcccgagtagctgggattacaagcatgtgccaccaagcccggctaatttttgtattttttagtagagacggggtttcaccaggttgaccaggcaggtctcgaactcctgacttaaagtgatccacccacctcagcctcccaaagtgctgggagtacaggtgggagccaccgtgcccagccctaactcacttctgaagttgctgctacttgcactgatttcagtttttttttgtttttgttttttgttttcaaggtggagtcttgctctgtggcccaggctggagtgcagtggtggtgcgatcttggctcactgcaacttccgcctcttgggttcaagtgattctcctgcctcagtttcctgagtagctgggattacaggcaggagccaccatgcccggctaaaatttttttgtatttttggtagagacggggtttcaacatgctggccaggctggtctcgaactgctgacctcaagtgatcttcccgcctcaggctcccaaagtgctgggattacagacatgagccaccacacccggcccacgatttcagtaatttctttgtgttcagtaaaactaaaaaatgactctgggctgggtgcggtggcctgtaattgcagtgatttgggaggccgaggcgggtggatcacctgagctcaggagttcgagaccagcctggccaacatggtgaaacccccgtctctactaaaaatacaaaaattagccgggcgtggtggcaggcgcttgtaatcccagctattcgggaggttaaggcaggagaatcgcttgaacccgggagaagggggttgcagtgagccgagatcacgtcattgcactccagcctgggcgacgagcaaaactcggtctcaaaaaaagaaaaatcattctgtcattctggccgctgtttgaagaatgcgaataatgcaacagggagatcagatacaagactggtaaccgaggtgtcagagttgagactcagtttcgcagattgcattggcaagtgaccaagtgggtggtgccacggttgacaaccctatttcttacatcactgagtggatgtacaaggattaaaccacactggggaagaaaagtgctcaaccctgaggcaccctcacacacctcggctcttgtgaacactagtgttcctgccgaagcacgcctacttaccccgctgagcagagcctgagcctgcaacctccagagacctggggaaagccacatactccgcttcccgcccccggcaagggcgtgtcagctacaaggggcgtgtcatctctaggccccgccccgcgctgcgtgcccacgttgcgccggcctcgcgccagtccgctgggctgcagggactgcggcgcctgagggagtcgctgacgggcacgctgactggaggctggcggacaggcgacagcgacctgcggcaggtgagctgtccgcgccctcccggggccttccttccgcccggcttctcggaccgcgctgcgtccttcgcgggccctgcctcggtccaggccttcggacctgggcttggccgggccacagccctttgggtcccctgcgccggtctgaggggagacccggccgggggcggccggaagctgggtgaggccgggcagaaggacgaagaagggcgtggaggggctgtcaggggagggcgaaaccgcggacgccgctctccagaagtcgtctccccgggggcgcggggaggcctgaatggctctctttggcgtccccgttgggcccaccctctcccagcgtcacggctatgctgggcgaggtgacccccggggtcgtagctgggggcgtcggcggtgcagacaggggatgccggcagagattggagcccggcttggctgtttcccgggctgttggcattgaccggggctctgcccttcctctaatgcccttatctctataggaagtgccccttgagtgggtgtcgtgacttcacgagtgaaccctggtacgccctggagcagagtcggactgggagggatcaagtgtgggggcagccggttagtccggacgcgggtttacctattactttctgagcgcagtgctctgggtggattaattgccctgcaaaagctgccgggacctccttgcagtctttgcacgaggcctgcctgtgtcatgccatttaaatcgcgtctgggccgggtcggtggctcacgcctgtaattccagcactttgggaggccagggcgggcggattgcttgaggtcaggagtccgagaccagcctggccaacatagtgaaaccccgtctctactaaaaatacaaaaatcagccgggcatggtaacgtgagcctgtagctccagctacttaggaggctgaggcaggagaatcgcttgaacccgggaggcagaggttgcagtgagccgagatcacgccattgcactccagcctgggcgacagagcaagactccatctaaaaaaaaaaaaaaaaaaaaaaaaaatcgcttctgatgagccggttgtcgtggcctgtggctgtccatccttacgtactgtgttttgttgatggcgctacaaaccagacaaggtggagtgtgattgaagaaagaaacgctggccggtgcagtggctcactcctgtaatcccagcactttgggaggccgaggcaggcggatcacctgaggtcaggagttcgagatcagcctggccaacatggtgaaaccccgtctctactaaaaatacaaaaaagttaaacgggcggggtggcgcgtgtctgtaatcccagctactggggagtttgaggttggaggatcacttgagcccacgaagtggagattgcagtgagctgagatcgcatcactgcactccagcctgggtgacagagtgagaccctgtctcaaaaaagaaaaaaataaattatcacaagacaaaatttgtgcttatcaggagttcacagttaagacatatataagcttacttggtgaaattagaaaaagttatcagataaaacattcaggtttaaacactggtgagggtgtgggaatttgtggagccttggaaacacactcattgaatgacctcatctacctggggatgtgaagagggaaatcctgtgattcctccattgtctgacttgatttccttttttccttggctgtggcaacatgttgaagtgctgtgagtcaccaaaagggggaacgtgagcaactctagaaatgccagtgccagtgagttacagacaataaagcattgaccgcctttagctcacccctcatcaagtctgttgaaaacttgtaaaattggacagctagagctaccttgattttttggtttccttttaacagctgactctcttcacaggacagttgggctctacatcaggattgcacccaaaactggaatatcactcctccaggaggaagatatatttgaaaattagaattgtgggcccggtgcagtggctcatgcttgtgatcccagcactttgggaggccgagatgggcggatcacctgaggtcgggagatagagaccagcctgaccaacatggaaaaaccccatctctactaagaaaaaaataataataatacaaaaattagctgggcatggtggtgtgtgcctgtaatccgagctacttgggaggccgaggcaggagaatcacttgaacctgggaggcagaggttgcgatgagccaagattgtgccactgcattccagcctgggcaacaggagcaaaactgcatctcaaaaaaaaaaaaaagaaagaaagaaaattagaattgtgtatttcactgtaaaatttgaaattcagctttaactccttggaaaggaaagagatgaaaaacttgacctagactgggtgcggtggctcacgcctgtaatcccagcactttgggagaccaaggcgggtggatcacctgaggtcaggagttcgagaccagcctggctaacattgtgaaaccccgtctctactaaaaatacaaaaattagccttgcaaaaagtagcctgtaatcccagctactcgggaggctgagcaaggagaattgcttgaacctgggaggcagaggtttcagtgagccaagatcatgccattgcactccagcctgggcgacaagagcaaaacttcatctcaaagaaaaaaaaattctatcagagtgaacaataagtaggatgctagcacatacctgtaatctcagctacttgggaggctgaggcaggaagttaatacttgatgagcctaagtttttggtgtctttggatgctgcttgtcgatctaaggggtttccaaacgcttcttttttggtaaaattgggattatgactaggaatctgttttttggagtttcccaggtgatccttgtttggggtccttgtctaaggcacaggctggaaagaggagggagtggactggcagggaagatagagcagtaagcgaatagaatacctggggaaagggacgccagaagagtgattgttgtctggtgaactgtgctgtcagtgtgtatgtcagaagccaacaaagtggatattctcttcactcagcttagggaaaaaattaatttttgtttcacagatagattcgtttccttcccaggagtattataggcctaattactgtcatagttctcagtaactttaaaaaggctgtggggaagaatggcataacagactagtatcttgtacccagcctgcctttttcttattctattttttttttttttttttttttttttttttttgagacagtcttgctctgtcacccaggctggagtgtggtggcacaatctcagctcactgcaacctccgcctcctgggttcaagcgattctccagcctcagtctcctgagtagctgggattacaggcgtatgccaccatgcctggctaatttttgtatttttagtagagatgaggtttcactatgttggccgggctggtctcctactcctgacctcaggtgatccgtccaccttggcctcccaaagtgctggggttataggcatgagtcgctgcgcccggcttttttattttttattttttatttttttgaaacagagtctggctctttcacccaggctggagtacagtgatctgatctgagctcactgcaatctctgcctctggggttcaagcagttctcctgcctcagccttccaagtaactgggactacaggcatgcaccaccatgcctggctaatttttgtacttttggtagagatggggtttcgccatgttggccacgctggtctccagctcctgacctcaagcgaaccaccctccttggcctcccaaagtgctagtattacaggcgtgagccacagcacccggccttttttttttttttttccttagagtcttgctctgtcaccagggctggagtgcagtggcgccgtctcggctcactgcaacctctgcctcctgggttcaagtgattctccttcctcagcctccctagtagctgggattacaggtgtgtgccaccacacccagttaatttttgtatttttagtagagacggggtttcaccatgctggccaggctggtctcaaactcctgacctcaagtggtccacccactttggcctcccaattagaattagaggtggagcgaccgtgcccggctaagggcctactattttttttttttttttttgagacagagtttcactcttgtcacccaggctggagtgcagtggtgtgaccttggttcactgcaacttccacctcccaggtttaagcgattctcctgcctcagcctctggagaagctgggattataggcgtctgccaccacgcctggctaattttttgtatttttagtagagacggggtttcaccatgttagtcaggctggtctcaaacttctgatgtcaggtgatccacctacctcggcctcccaaagcattgggattacaggcgtgagccaccgcgcccggccaggcctcgtatttttgcttttgctcatgttttcatgtctgagatagagggcctactattaaagcactgtgctgaggctgcaagaaggtactagtgtgattaaaacaatctggtccgggcgcggtggctcgcacctgtaatcccagcactttgggaggcggaggcgggcggatcacgaggtcaggagatcgagaccatgctggctaacacggtgaaaccccgtctctactaaaaaatacaaaaaaaattagccgggcatggtggcgggcgcctgtagtcccggctactcgggaggctgaggcaggagaatggcgggaacccgggaggcggagcttgcagtaagcagagatcgcgccactgcgctccagcctgggagacagagcgagactccgtctcaaaaaaaaaaaaaaaaagaaaaaaataaaacaatctggcattataatgccatcctgattttagttaatctagttgactggctggcctcataagtagctgtgatgatcataatttttatgcgaaacacctgtcattgagcatacaggtgtactgaaagaattgggtggaacagggtatttgaaatcagaattgttctggaaagtcgggtacataaagctctatctttagcacagttgtctgtattgcacaattaatatttatagaatggtacaccttatgttatctttttatttttccacctaactctctctctagattgaaaggtacttgacgtgcagagcaagatcttatctttctttgtagtcacagtactcaagagggtgataaatgtttgttgatgataatgtaatgtcacctgtccaagtgtagccatcatcttcagtagttacttgatctgctgttgtgtctggcaagactgctatgtgctgctgcagaggagccattgtcaccttgaactatctctgtggcagtctggaggagggcaggagggagaagggaaggaataaatgagcaaagctgagtgtggatagtagtgtttgacggcagatgaaaaagcaaacttggtgaagtgtggcctgggtggtcatctaacttctacctagaagacattaaacctttactctcttctttttatgtaggaaggcagagggaaagtcaggccttcggttggcttggtaatagcaggtatcccagtaattagaaaataacttaaaaaactccattcctctaccatatacttgagaatttgtcaatctcagcaaaattttcaaatgtctgtgttcagtgtcatatttgtcctgctctgtaagactttttgtgtttataaaaaggcaagtggacccagaaggggaaaaatatgctgttctgagaaactagctgctgtaggttatgcttttctgtctttgcttgtggctcttctggttatttgagaaaggcaaaaaaacccaaagtcttttttctactctgttcccacagtcactcaacacaacacttctgataccagatatatgggagttgtttccccatacaccaagcaattctctagtagacacaccggtgcggtgtcctctaagtcagttaaattctgatactctatctggagatagcgtcagatcccaccaattgagggctcagtcccacaaaactgtcccaacttgaggcactagtcacaagtagtaaattgtcacctatacttctgacctactagctataaatcgaaagttctgacaatccctcctcgagtttgattaatctgctagagtgggtcacagaactcaggaaaacactttacttacatttaccaatttactctaaaggatattaagaaggatacagatggctgggcgtgctggttcatgcctgtaatcccagcactttgggaggccaaggagggcagatcacctgaggtcaggagtttgagaccagcctgaccaatgtggtgaaaccccatttctagtaaaaatacaaaaaaattagccgggtgtggtcgtgcatgcctgtagtcccagccactagggaggctgaggcaggaaaatcgcttggaccctgggggcagatgttgcagtgaaatgagatcacgccaccgcactccatccagcctgggcgacagactggaagaaaaaaaaaggatacagatgaatagccagatggaagagatgtatagggtgaggcatgtaggaagaggcatgaagcttctacgccctctctggaactttcgtgtattcagctatcctgaagctaatgcaaaccctggtgtgtgtgtgtgtgtgtgtgtgtgtgtgtgtgtgtgtgtgtgtgtgtgtgtgtgtgtgtgtgtttatggaggcttcattacaaaggcataattgaatacgttattggccactggtgatcaactcaacctttagaccttctcccgtcccctgaggttaagggggtagggctgaaagttcccaccctctaatcacatggttggttccccaggcaatcagcccccatctaggagcccaccaagagttacttacttacaacaaaagatgctcctattacccaggaaattccaagggatttaggaaattacaaaagttttaggagctctgtgtcaggaactgaggttaaagaccaatatcagaatgaaggattctcctagtgcccccatctacaaaggttttaggagctctgtgccaggaacctagggtgcagatcaaatatatctataaatctttttgtttgtttgtgttttgagacagagtcttgctgcgacacccaggctggagtgcaatggcgctatctcggctcactgcaacctccgcttcccggattcaagcgattctcctgcctcagcctcccgagtaggtgggactacaggtgtgcgccactatacctggttaatttttgtatttttagtagagacggggtttcaccatattaaccaggctggtcttgaactcctgacctcaagtgatctgcccacctcagcctcctgaagtgctgggattacaggcatgagccgctgcatccagcctcaaatttatctctgtatcttcttctaaattacagtatcacacccgtgcatatgcccaaaaatttttttttttttttttttgagacggagtcttgctctgtcgcccaggctggagtgcagtggtgcgatctcggctcactgcaggctccgcctcccaggttcacgccattctcctgcctcagcctcccgagtagctgggactacaggctcccgccaccatgcccggctaattttttgtatttttagtagagacggggtttcaccgtgttagccaagatggtctcaatctcctgacctcatgatccacccaccttggcctcccaaagtgctgggattacaggcgtgagccactgcacccggcctcatatgcccaaattttaaaggaggcaccacattcaagtccaaatgcctaaaggtagaaggatcaagaaacagtagtatgaggccatttgagaagtatatatagttatccctcagtatctgtggagattagttccaggacccctcaagggtaccaagatccaggatgctcaagtttcttttcttttcttttttttttttttttttgagacggagtcttgcactgtcacccaggctggagtgcagtggtacgatttcggctcactgcaatctccacctcccgggttcaaatgattctcctgcctcagcctcccgagtagctgggattacaggtgtgcaccaccacgcctggctgatttttgtatttttagtagaggtgaggtttcaccatattggccaggctggtctcgaactcctgacttcaggtgagccgcctgccgcgggctcccaaagtgctggtattacaggcatgagccactgtgcccagcttaagtttcttatataaaatggtgtatagaatttgcatataacctatgcatatcttctgtattctttaaatcatctgtatttataatacccaatacagtgctatgtaaatagttgttatactgtatcgtttaggtaatcatgacaagaaaaaaaatctgtacatgtgtagtacatatgtagccatctgttgttttttttttccctgaagattgattggttgattgagacggcatctcactctgtcaccgaggctggagtgcagtggcgcagtcttggctcactgcaacctccacctcctgggttcaagcgattctcttgccttagcctcccgagtagctgggattacaggtgcctgccacaacccccggctaatttttatatttttagcagattccgggtttcaccatgttggccaggctgatctcgaactcctgaccttaagtgattcacccacctccacgtcccaaagtgctatgattacaggggtgagccaccatgtcaggcctttttctgaatatttttaatctgaggttggttgaatccactgatgcagagcccatggatatggagggctgactgtactgtattgagcttctaaggtatgcagagtattggcactgaggggatgtgcaaatacaacaacaaaccaagcatagtctttgtttactaggagctggtagtaactgtgggaagacacaaaacagtaaaatcactttgtaaggtttatgagagttttgagaggccagggaagttaaagagtggagaaatggagaaaatgggagaacttgtactgaacccattaggacagaggaggaagggaagagaaggaaggaggccaaagaaagaagaaacccttcttagagcactcagggtcttactgaaaactttacccataaaaagagaatgtcactgatagactccttttagaacagggattgatttttttgtttttgtttttgtttttatttttgtttttgtttttgagagaagtctcgctcttgtcccccaggcttgagtgcaatggcttgatctcggctcactgcaacctctgcctcccgggttcaaacaattctcctacctctgcctcccaggtagctgggattaaggcacctgccaccacgcccggctaatttttgcatttttagtagagacaaggtttcaccatgttggccaggctggtctcgaactcctgacctcaggtgatccacccacctcagcctcccaaagtgctgggattacaggcttgagccaccatgcctggccacaggcaacatttttaaaccatacgattgtcctggagagagaatctgaagccttgctctgattctgaaagggatttgcaaccaaaaaaggataaggattgttctgacaagtaccctttcttcccatcttcaaaagtacacatctcttaatttgtgtcttcaaacacaaattgtgttcaaaaaaggaagtatttgagtagattaaagacagaaaccctaggacattcctttgtaaacaaacagccttttaccaaacaccaactgtcaagggacttgcctgagtacttgtccaaaggacagcgtgtccccatgtgtaggcagtggtctaatctggttcctaggagaggactgctgaggccacagcaacttaactggctagtgtgggtgaggcagaagtgtttgaagctcaaggtctgtcaaggacagctgattagagtatgtctgtccctaatacagggttagagctcagtaccaatgctggggatgaggtgagttgaagacacagaaactacatggttttttggaaggtcacgaacttttcaaggaactagtgggcaactggaaatgatatgtgaaagagtagagggagctctggcctagctgccagaaaactctgggcaggtcaggtctgggaacagtggctaatccaggcccagcttcccactgttgatttggacatacaggcctaagataagagaccgtgcccagagccactggtcacttagcacaggtagtgggaaatggtagccagcaaatgtttaattgaatatcttatgtctcctagaccacagctgagcaaactaggccaagctcaaggtcctgaggggaatgaggagctgagctcagtcccttttggccccctttctctttccctcctcattttaagtatggaagctcacttatttcctttttgtattggccatttgtgtagggttttgtttgaaaaagggcttgaggctgggcgtggtggcccacgcctgtaatcccagtactttgggaggccaaagaaagattgcttgagcccaggagttcgagaccaacctgggcaacatagtgagaccctgtctctacaaaaaaatttttaaaattagctagacatggtagtgaatgcctgtagtctcagctgctcgagaggctaagttggaagtatcacctgagcccaggagttgaggctgcagtgagctctgattgacccagtgcacttcagcttgagcaacacagcaagaccctgtctcaaaaaaaaaaaagaagttgggcacagtggctcaggcctgtaatcccagcactttgggaagcctaggtgggcggatcacctgagatcaggagtttgagaccagcctgacctctaaaactacaaaattagccaggcgtagcccagcggctcatacctgtaatcccggcactttgggaggccgaggcgggcggatcacctgaggttgggagtttgagaccagcctgaccaacatggagaaaccccatgtctactaaaaatataaaattgctgggcgcagtggctcacacctgtaatcccagcacgttgggaggccgaggcgggtggatcacaaggtcaggagatcgagaccatcctgtgaatggcgaaaccccgtctccactaaaaatacaaaaaattagctgggcgtggtggctggcgcctgtagtcccagctccttgggaggctgaggtgggagaatggcgtgaacccgggaggcggaggttgcagtgagctgagaacaccagcctgggagacagagcgagactccgtctcaaaaaaaaaaaaaattagccgggcgcggtggcatatgcctgtaatcccagctactcgggaggcagaggcaggagaactgcttgaacccgggaggcggaggttgcggcgaggggagatcacgccattgcatgccagccttggcaacaagagcgaaactctgtctcaaaaaaaaaaaaaaaaaaaaatgtagccgggtgtggttttgcatgcctgtaatcctagctactcaggaggctgaggcaggagaatcacttgaacccgggaggcagaggttgcagtgagctcagaccgtgccattgcactccattgtttcgctgcaacgagagggaaactccatctcaaaaaaaaaaaaaaaaaaaacaggcttgagtatacctctcacagccctggagaatgcctgagctgttggacagttgccttttccattatgtctgcttttttctaaagctattcattcattgttgcctaatcatgtcctcagtcagtagttgatgttctgggctatttgaatttcctctgaataatgattaatggagataatgatgtttgaccagttctgggaactcttgggaattaaaggaattaaactcttggacattaaacttcactttaatgtgtatagttgtgggtgctgccccattggagaagattgtgacaggaagttacacagttttacagcaaactgctgggattttttatttttttttcagtaaattatgataactgtagcattttcctttgcaataatgataacctaaggccttggtgtttcctctaaaatgtacatagatacaggatgtgggtttgttacaaagttgtataactattgcctttttgtggctgaccccttccctagagaacaacatgaagagaccttgctgctgctatgaaacccagactctaaggacaacttgggggacattggatattttttcacagatgtagacatcaaggagtcagtggtttgtgtatgcgttgagtggagaaggctggcaagcatttgctaccatgactgttaaaaatgtgcctgtacatttctttttttttttttttttgagacaggatctcactctgtcacccaggctggagtgcagtggtgtgtttttggctcagtacaacctccaccattgtgggctcaagcaatcctcctgcctaggactcctgagtagctgggatgacaggcatgtgccaccacgcccagctaatttttgtagtttttttgtagagacagggtttttgccttgttgcccaggctggtatacatttctttatataaggagggggcaagtaacacagtgttatgctaccaatcaggctttcagagaccataaaacaaaatctaaaaggtacgctcttagtagtcatatctgtggaatgtaaggaagccagtttaagaccaatgtaatgcagcattttcccttcacacatgaaacagtgagttactcgagcacaaagcatcaaatgcttattccccccacaaggccattcttatctttcaccaagtgtttagtcactaggcagccatcatcctccctccctctctcccttcctcccttactttcttcctttcttccttttgcagtggcacagtcatgggctcaagtgatccgcctcagcctcgcgagtagctgggaccacaagcactcaccaccacatccagctagttttattttatttttaaaaattttttgaaacagagtcctgctgtgtcacataggctggagtgcagtggcacggtcttggctcactgcagccgccacccccagggtcaagtgatactcctacctcagcctcccaggtagctgggactacaggcatgtgccaccatgcttggctaagttttgtattttttgtagagatggggtttcaccatgttgcccaggctggtctggaactcctgtactcaagctatccacctgccttggcctcccaaggcgctgggattacaggtgtgagccattgcgccgagcctcatccagctaattttataatttttggggggaggtagcaacagagatctccatatgttacccaggctggtctgaaactcctggcctcagtgatcctcctgcctcagcctcccaaagtgttgggattacaggcgtgagccaccgcgcccagcccattattcttatatctgagattcacctttaattgccctctgtcatcagcactttgagaatgcctcaattttgagaataccttgtattctggaaatcattcattcagtcaacaaaccctgactggtgtgtaattgggcagtaggaggccaagataaatgacctgtaatctggaaaacaaacatataaacatacacataccataacgagatatgagtgctaggatggatcacaaaaggcttacttaggtagctctgaatataatatcaggcctacaatattatcacttatgttgttttttggatcttatttttagaaacagcacaagctttttcttggaggaaatatagcaaggaagaggggagctgttctgactgaagcagggtatgggaggcccacagcctttcctgctttgcctcctgttcaaagccatcctccctgcagttcactgagaaatgactccttggagctccaaggaagtcctacagctagctagtagcagacctggtagtagaagttagttcttctgattcttagctttcttagcagtcaggtaccagactgataaacgaaaatcaaatttctcccagttatatgttccatcccacaaagaagtaataaacacatttctgtcaggggcttcagcctgcctggatttgttactgggtttgttttaaatgtttagcttccaggcatccaaatacatacaaaaaaggtctattcccaggaacatactgtaacccttttcattgtcatttgtgggcagtgccaagctgcctctaatagcttcttctgtttttttggtggaaattcagtttcctcagaaatctatataagggatatttgataaaggtgactaacaatctcgtctctgtaaattgatgaagggatgagaggggtattagactcatgtcctcttttgaatgcacactgcttttgtggtccggcagggtttctcagcgttagtgctgttgacattttgggctagattgtttgtggtggtggggtatgtgtgtgtgtgtgtgcgtgcgtgcaagcacatttgtgcgctataggacattgagtagtatccctgacctctacccactattgtcagtagcacactcccgtctttcagttgtgacaactaaatatgtctgcaaacatttccacgtctccaaacatgttccttgggggacaagttggcccccagtggagaaacactggattggagattggttgtcatgtgataaaaatgcaaatcagatttgtcacaggacaaagtaaattttcagttacctaattaaacctttactttttataagtcgctctaaagaaacaaaagtgtgtcctgtcttccatcctgattctcggttactggagggcccttcacctaagtcatgttcaggatctccttgaaggagttaaactaaaacaatacaatatcttcccttaggtcttttgcagaatttattttgctaggccgggcactatggcccactcctgtaatcctggcactttgggaggccaaggcggctggatcacttgagttcaggagttcaacactcgcctgggcaacatggtgaaaccccatctctacaaaaaataccaaaaaattagctgggcatggtgttgcatgcctgtagtcccaggtacttggggggctgaggtgggaggatcacttgagctcaggaggtcaaggctgcagtgggccgagattatgccactgcgctccagcctgggtgacaaagtgagactctgtctcaaaaaatatatatattttgctagaaatcccaagatttttctctcttttctttttgtttattttctttctttttttgagatggaatctcactctgtcactcaggctggagtgctgtggcatgatctcggctcactgcaacctccacctcccaggttctgagaagctaggactataggcgcatgccatcacatctggctagtttttgtatttttagtagacgcagggttttaccatatttgccaggctggtctcgagctcctgaccttgtgattcacctgccttggcctcccaaagtactgagattacaggtgtgagccactgtgcctaacccccatatactttcaaacaaaaaatggaaatatcactgtctccatgaaaagccatacaggcagcatcaaaactacactaggggccaggtgtggtgcctcctgactgtaatcccaacaatgggagggtgataggattccttgaggctaggagttcgagaccagcctgggcaatatagtgagaccctatgtctacaaaatactttttaaaattagcatagtggtgcgcacatgtagtcctagctacttggaaggatgaattgggaggatcgcctgatcccaggaggtagagactgcagtgagctaatatctcaccactgcactccagacacagtaaaaccctgtctctaaaaaaaaaaaattaaataaataaataaatggtttacactgagggtcacagactttgagttgaggttcgtcatgaagaatctccattttcattctaatagcactagatacaggctgggtgtggtggctcacagctataatcccagcactttgggaggccgaggtgggcagatcacgaggtcaagagatcgagaccatcctggcgaacatgctgaaaccccatctctactaaaaatacaaaaaattagctggatgtggtggcacgtgcctgtaatccctactactcgggagtctgaggcaggaaaatcccttgaacccaggaggcagagattgcggtgatccaagatcacgccactgcactccagcctggcgacagagtgagactctgtctcaaaaacaaaacaacaacaacaacaaaaaacacaaaaaaggctgggcacagtggctcaccttgtaattccaacactttgggaggccgaggcgggcggatcacttgaggtcagcagtttgagaccagcctgggcaacatgggaataccctggctctactaaaaatacaaaaattaattgggtgtgttggcacatgcctgtagccccagctactcagaaggctgaggcacaggaattgcttgaacccaggagtggggagaaaaaggaaatattaggggacatttgttaagtttatatttttttcttttctcttctttttcctctttttttgagacagagtctcgctctgtggcccaggctggaagctggaattcagtagttcagtcatagctcactgccgcctttacctcctaggctcaagtgatcttcccacctaagcctcctaagtggatgtgaccacaactgcatgccactccctccacccccgtctgcctaccagctaattcaaaaaaatttttttttgtagagatggggtctccctgtgttgcccaggtcagtctcaaactcctaggctcaagcaatcctcctgccttggcttctcaaagtgctgggattacagacatgagccactgggctcagccattaattttaaattgcaagtgacatattctttagtttattaatcagcaccatatgatgtcacagttttataactcatttatctcatttaattctcatacccaccttgtggaattgttatcactgtcctttacagatgaagaaagaaactccaagaaattaagtagctggcccaagtccacccaactgggatgggcagaaccagggtttgctcttggttgtgcctttctacagcctgtgccttaaccacatctatgtgctgcctcttggcctctgtgtggccagtagattctctcatggctaggctcatcttaattaacatttgttgggtgcctactatggctcaggctctagagatcattgtaaaatccagtccactgccccagctcctcgtgtgtcttttgaacacattagtattgtgctgtgcagaaaggacttctgtgcatatgcctgctattacacttgttgaacccaatttctacaaactttcattcagatggagggattcagtcttcttatcatataatacatacagaaatacaaatatttaaatatttatctaaattaatagtcacatatgccatttatacagttagtgagttacagccaagtgacagttgtgatgggaggctgtgtctggggagttacatactggtgaggaaactagaaaacatggctgtcgggccggcactgtggctcacgcctgtaatcccagcactttgggaggccgaggcgggtggatcacgaggtcaggagatcgagaccatcctggctaacacggtgaaaccccgtatctactaaaaatacaaaaaattagcggggcgtggtggtgggcgcctgtagtctcagctactcaggaggctgaggcaggagaatggcatgaacccgggaggtggagcttgcagtgagccgagatagcaccactgcactccagtctgggcgacagagtgagactctgccacaaaaaaaaaaaaaaagaaaacaaggctatgaaaatttaacacattgactgggcagggtaatgcatggtgatctgttttctcttcgctccaatcctgaaaggtttctttgaagagctggagtgtctagaaagctttcctagaaagctagtgtacattttgctaagtaatcactgtgtcacttagattttctgctctttaagtgtggttatgagatgtgttccaaacaatttgttactaaccatgaagttgatgaatgctttgcctttaaaaaaataagtttgggtggggtgcagtggctcatgcttgtattcccagcattttgggaggctgaggcaggcagatcgcttgagtccaggagtttgagaccagcctggacaacatggtgaaaccctgtctttactaaaaatacaaaaattagccaggtgtggtggcgtgtgcctgtagtcccagctgctttgggggctgaagcaggaggatcacttgagcctgggaaatccaggctgcagtgagctatgatcacaccactgcactccagcctgcgtgaaaaagtgagactgtctaaaaaaaaaaagtttggccaggcatggtggttcatacctgtaatcacagcactttgggaggccaaagtgggaggattgttgaggctaggaggtcaagaccagtctcggtttgattgggttaaacattatccctgtaagttggctctcattctgagaagttgtttagagtagaagagagggctgcatttacagctaattgctagtaatttcacatcatctgcaatatattttctggacactctgcccgactagtcctatgggacgttgtcattcatgtgcaaatcaggccctatatactaagggaggaaaacagttgaggacctcctttttttaggcactcttggtgccttgtgcattaagatagtgagtcagaggataagaaggaagcagattccattccccttaccactctttgggtgtaggcagggcctgctggtagtgctgggaaagccgaccatccttctttgagcaagtccaatagctgctgctgctagttctgtcccaccataggcacagtctatgtaggatgagccaaccatatgtggagttactggttcttggtctgggcttgttcctttccccaatttcagtccccaccagaatctgggcagtcattgtgaagaagcctaggaataataccttactctataggcctgtggaaacgtgtaaagataccttgcaggcccagagtgagaaattggagccaccttgttcgattgaccaaaggcttgtcctatggagttactaattttacaggaagtttatgttaacatactttctatccattgcactaccatttctgaggcacaatatatttcagtaggcagaaagatagaactgcttagattttaaatactcaatacatgcttgacacagtttagtctatttctcttcagttactatggcagtgggtgctatagagatgtgcagaccctattgtgacctccctttggtatagggatgctctggagcccctggcttcattgtccactaaggtctggcaggtctgattgcctcttttcaggcactgagtggtggggtatgccatcctcccctgctggaaccagccttggcctgccctgttagtcatcaaaaatagatctcaccagggaacaatcttctcaggttgttgtgtaatttgagtgagccaaggtgagtgttttagggacaagcagcatcaacttcggaatcttcaactgggcctgagcacttatttctcagaaataatagaatcttgctcacttttctttctttttttttttttttttagatggagtctcgctctgttgcccaggctggagtgcagtggatcagtctagctcattgcagcctccacctcctgggttcaagagattctcctgcctcagcctcctgtgtagctgggattacaggtgtgcgccaccacgcctggctaataattctatttttagtagagttggggtctcaccatgttggccaggctgctctcgaactcctgacctcaagtgatctgcccgcctcggcctcccaaagagctgggattataggtgtgagtcaccatgcctggcctcttgctcacttttcatactaaaacaacaaattacaggctgtagtttaacctctctactgcatgcataaatgcagtgtggtacgagtgcctctgtagcccataacttcagtttccttgttgctagcagtctgtggtgacactatactaatctcacatgcaggaaccaatgaggattagccagggacacaggaggagtcaccttgcattcagaatgactcaagtttagtctcaacttgaccattagctctctgagtgatcttgcccatgttaattctcttgatcttagtttcttcagagccagtgagacattgcttgaaagtgacttagcctggtatacccaggtctgtcagacttatagtctggtgctctcttgggtgaacttgagggccttctgccaaggcaggaatggcttcttttaaaaaaaaattattttattattatttttttttttgtagagacggggggtctcactatgtttcctaggctggtctcaaactcctggactcaagtgatccttcagcctcggcctcccaaagtacagagattataggtgtgagctaccagtaccagcctccaggaatggcttctaaggcttcaggctgtttatagagaggaaagcacctgggagctgatggcactctcaggtttcccaaaatgacagttctgcatatgcatcttaatcacctactttttttccctccacccccaaatgctattcacagtccttgtttatgatagaagctgaagcttacaggtgacaatttttgtgcctgtatgaaaggaaacatgactgactccacttatccacacgacacctgctttcaaggttgttcagtgttggaataatttttgcttgatggtaacctagggatgacccaaggtttcattagttaaagccagccctgtgggatgcatgaagtctagcctctgtccctgtaaaaatcccaccagaaccattttagaattcactcaggacttcacccctcccgctcctggtgctgcttatggaactaaagaatcctcatcttctcagccctgggacacattgtcctcatataaagcgaggtggcaatcagggaacaggggcgagtcttgtgcttatttcagttataataggaaggctctaccaggactcatcattgtcccaacaatagtcgattccaggccccttctttgaactcatttcagtgtctcaggttctgtccttggtgtctgtcttcactgcttgctcagttgtatttgaacatggctagagatgagcacacttctcttctccagtaaaaaagcctgcaagaaaagtcttggacttcttgaactgctattcagttgtcttttttattcaatgtattttttgagatggagggggtctcactttgttgcccaggatggtgttgaactcctggccacaagtgatccttctgcctcagagttccaaagtgcagagattacaggcttgagctaccacaaccggtctcttgtcagtttttgaggttacttaagaggttaatgcctttaaattagtttgcagttgttttgcttttgcctgccttcttgcccaaatgcgcaagtgcttatttagtaatctgactcaagtgctttgtgtccccagagtccccacttttccaggattcattgtctttttttttttttttttttttttgagacacagtcttgctctgttgtgcaggctggagcgcagtggcactgtcggctcactgcaacctccacctcctaggttccagaaattctcgtgcctcagcctcccaagtatttgggattagagtcacacaccaccacacctggctaatttttttatatttttagtagagatggggttttgccatgttggccaggctggtcttgaatgcctgacctcaggtgatctacccgctcggcctcccaaagtgctgggattacagacatgagccaccacacccggctggattcagtcttaacttgctctttttttttttttgcatctcactcccttgccaggctggagtgcaacggtgtgatcatagttcactgcatccttgaactcctggggtcaaaagatcctcttgccccagtttcccgagtggttgggactacaggtgtgtgtcaccacgcctggctaattattttatttttcgtagagacaaggtctgactgtgttgcccaggctagtcttgagctcctaggcttaggtgatcctcccaccttggcctcccaaagtgtcaggattataggtgtgagccactgcacccagcctggatttgctcttttatcaagaggttaatatttattcttccgttcagtgaaccgtgggattgaattcccccagcgattgaaatgaaagggcttatgtataacatttcctgaggaatggtagtaccagagttcagaggagacctcaggccatttattctataaactcagaagctgtagttctagatgatgtggcttcttcagggtgttgagaagtctctgttatctcgtgccttgttggattagaactgattgagctctgtctgctgccccaaacatgtggctcagccaatctccagtggcatctgcaatgtgggtattctagcctccagtgctcacgtggctcaccttagaaagggcagatattcctatttcctgacgctgctggagaatgaggtctgagtcagaagtcctcaggtgtgacctgcccagaactatctgaaattgctggatttcttgttcttcctcagtgtttaacaatcacccaattgctcattctcaccagcgacttcctcagtaagagctcaatatttgaggtggtgctgcattttgtcaaacattcatgcgtgttagcccacttagtcttcgcagcacacagtggattaatggatttttaaaagctggtatttatgcacgatggaatactactcaaccataaacaagaaggaaattctgtcatttgtgactacatggatgcatctagaggacattatgctaagtgaagtaagccaaagaaagaaagacaaatggtgcatgatatcacttatatgtgaaatctgaaaaagtcagttatagaaggagagtgtaacatgttggttaccagcggctgggggaagggaagggtgggtgtggaaaggggagatgttgatcaaagggtacaaaatttcagttaggagaaataaggtctgatgatctgccttacagcatggtgactatagttaatatggttaatattataatagtattgtatacttcaaaattggtaaaagagtggattttaaaagttgtcaccacaaagaaatgataagcatgtgagctgatggatatgttaataaccctgatttaattattccccaatgtatacatgtgtccaaacatcacactgtaccccataaatataattgtcagttaaaaacttaggagtcaagtcagatctgaagagaagtcaaaacagatttcatacagttaatttagagacatgggacccaattaaaaatttgtattactttacttggtattttagaatttagctgttattttcttgttacacacacaggcacaggcacacaaatcctctatttaactggctttctcagtaggaactccatctgtgtatttgcaacagctgtaactcaggttggatgctccccagggtgctggcctataagtcatattggaccctgatctgaatctgagggaatctggatctctcttgtaggaagcttttggtttaactgggaagacaggatgacagtcagttgtggaagctgaagcgtaatcacctcatattaatatggtggcaattttatatcggagtgagctctgagctgcaaacagccttctaggaagcaggcaggggacccccatccagggtgatggtaagaatcctgatgcccaactgcaaggtgttcagcagggagggagcactcgtggagtcccagtgcagaagtctctgagcagccacttagcctccctgtgtttgtggggtaacaacccgagttcatgttgtgggcatctcatgcagtgtagtagctggtcactgtcaagtgtcactatttcattgagtcagaagcctgcagaattgttctcattccagggagtgagtcagtctgctgttgcttactctcggtgctggctgagctcagcaacctgctctcttccttcagttcaggtttctccagggcaaagaagtctttattgttcctttctgtatgaccagatgggaaatgaattataatatagtccttagattatattcccacctggtagcaatgcactgagttacctgacctgaaatttgttggacttagtctccatggaggaggatttaccatcttcgttgtctcagaagtcctggtagtgcctcatgccagcaatttagcaggagcaaaagctttgagacagtgttctggatctgctgagctggtctaaaggaacctcttttgcttgaagtaactgtgataggaactttgttactgcttctgttagctcaggtgttggaatgagaatcagcagctgatgaggtgaacagctaggagtactggaattatggagtagtggaggtagattttataaacagagggtcccagttttttggaaatgggaaagagagagggtagactggcctttctagaatttgtaacagaaaagaggacccaggagcttccattgactagttagttaatgcagtgcgggatcttagctggtttgcttggtccaattcctgtctctcggtttcttttttcccttcccttcgctgccttcccctccctcttccctttttctttccaagagaattgagtcactccatataaaagaagcagccagttggctaaaaagtccaacaaaaaacaagtatttatagctctccaaatttcccacttgtcattatcagtatacttttgcacacagttatagtcggtgtttgggatcctttttaaaaaaataaaaagtttctgtaggcttttccatgcatgaacacagcttatcaacttgccccggctgtgccaggattccattgttgactgttgtttgagcagtcatgccctttgttcttaggctgtgtgttgtttttttcctaacatcatagtatggctgggtattattttgatacagattacaattactattactatttcttgaagtgtatttcccagagtggaatattttaggatctttttttctcttttgtgggggtggggaacatgtagcttcttgtggatattagacattgaagtctaaaaaggttctatatttatgatttggccctcaattttctagagattccaatggttcctgcaaagaaaagagcattcaagtatagaaaccagccagactaagtctggacatgtagcttttcagaaagtgaaaaaaaattatgtttctgcagttgcaaggtggcctctgaatgccacactgtgtggccactcccttggacagtggctaggccacagggtcgcctcccctggccccagtctgtgggttgaatatgctaaccgagccttcccaggagcctcctctgcccccagcccccaggtctgtacagatggtagttggtactttcagcccgccttgagaactcagtattcttcctgttagctttccttcaaagtaaaatcggtagaacctattttgagtgtagaaaatttgaagtcgtggacagcagattacaaaaaattgcccaccaccatgcctggctcatttttgtatttctagtagagatgggctttcaccatgttggccaggctggtctcgaactgctgacctcaggtgatctgcccacctcggcctccctaaatgctgggattataggtgcgaaccactgtgcctggctcctttttgtatttttcggagaagcacaaggacttgttgtttaattaagcaagactatactctcccagagcatgcagttattattgagtaaaacacagttaatgagatttaatcacgttccctatcactgttgtgcagcatgataagtaggtgcaaatggcaagaagcacgctgaagttactgcagttggtaacctgggccatggatggcacttgtctttgcctcattttgcctgtaagaagcatggggcctgtggtcctggggtacctggaccctcagcctggtgtgtgtgtgccctcagcctggtcctttacttccatcacccatctagaggctccaggaccctttactgcacccctccctcctctagatagctcagtgttttcatcccagcacctttttctctgctgcctgagaactgagcagccagagacaaattttggctctcagggtcctcaagggtgtacagcaaagctgttcttattatttaaagtattttatttatttatttttgagacagagtcttactttgtcggccaggctggagtgcagtggcatgatctcgactcactgcaacctctgtctcccaggctcaagaaatcctcctacatcagcctcccaagtagctgggattacaggctggagtgcagtggctccatctcggctcactgcaacctccgcctcccaggttcaagcgattctcctgcctcagcctcctgagtagctgggattacaggtgtgtgccaccatgcctggctaatttttgtatttttagtagagacagggttttaccatgttggccaggccggtctcggactcctgacctcctgatctgcccacctcggcctcccaaagtgttgggattacaggcgtgagccaccgcgcccggctagcaaagctgtacttttaccaaaaaaaaaaaagaaaacatttataaatcaaggtctgaaggcccatgtgaggcttattctacagcttgcaatgcctgtttttgccccttggtaagtggacgcacagctgggcagccttatgctatctctgtgaactacccatttctggctttgttcataatattcccttgatctggaggccctcccccagccctgccccaaatcctgtctgtgttgagggtcctgccccaggaagccctctgcatactcttccctgcatgtaatacctgcctgctttcacattcttctagactgtgctgtgcatcgtacagttcatcagcattattgcagagtagagtgtctctgatttggagtcaagagaaggttccatttttctgtacatcccgatgtttattttctgagtgttctcagacatcactaagcctcagtcaaaataaagtatgatcatgatgtaacattcattgagtgcttatcacatggtaggcattgtgctatatgagttattgcttgacttcctaaaataatcccagtagagatgctaaatctaaaggtgagagagatggttcaaaaagacctcagtgagcaaaccatgtactataatatcctaaaagataacaaaaatgtaactaggtatctagagaaaactcaggaaggatatgtgccttgggccttttaaggaccatttcttaacacttctgtgttcttcttgacacctgtttctgggtagagcacatagaaaatgctcagtaaataagttctttttccttggcccagtttggcctgatttggccccagttctgtctttgtgagttactttattagttgtcggtgctactgtgctgctattcatgtggaagattccccaaatgggctgcgccttacattgcctgagcagaagccccgagggatggaggatgagcttgccttgttatgggactgtgtttccctggctgacaaaggctcagcatttgcagcaggcaatgggaattgattggccaacttaatatttccttcagcctagcaaagtcctgagtaggctagggacagtctgcttttttggtaactcctgtaggctgccttctgcacaaggcacccagcctctcacaggtaggatgaactggcctcagcacgcttgcagaggggtggaactgtgcgttgcttgccaagctttttgtttccctaaggtttttgaggttttctttgtttttggtaactttcaattttttttttttttttttttttttggacagagtttcactcttattgcccaggctggagtgcagtggcgcgatcttggctcactgcaacttctgcttcgtaggttcaagtgattctcctgcctcagcctcctgagtagctgggattacaggcacgcgccaccacatccggctaattttgcatttttagtagaaacagggtttctccatgttggtcaggctggtcttaaactcctaacctcaggtgatccacccaccttggcctcccaaagtggtgggattacaggcatgagccaccgtgtctggcctaacttttaattttgatacggtcttttttttttttttttttttttttttaagacagtttcgctcttgttgcccaggctggagtgcaacggcgtgatctcggctcactgcaacctctgcctcctgggctcaagagattctcctgcctgagcctcccgagtagctgggattacaagtgtgcaccaccatgcccggctattttttgtatttttagtagagacagggtttcaccatgttaaccaggctagtctcaaactccagtctgcctcggcctcccaaagtgctgggattacaggcatgagccactgtgccctgccttgatacagttttaagcatacagaaaaatggtaagaatagtacaaagaactctcatacctcttccccagattcactgctaggattttgccttgtttgcttttctgacttgccagtgtcccccaccctgcagcatatgcacatgcacacacactgtcttctgaaccatctgacagggagttgcaggcagtgtacctttacttctgaataccccagtgtgtatttcttaggaacaaagacattctcttatataatcgcagtacaattatttttaaaaaccagcaagcttaatgtcaatacaatgctattacctaatacattgttcatattcagattttttccatattccactatggtcccagtaatggcagagctttattttaaagaaaacaatcctggggtgtgtgggtgtcaccttggttacattcgctctgaggaaagcagaaccgacaggtatttggggaagtgactgccgtgggtgccacatcaccagctccttgtgtctctgcaggaccagaggagcgagagcagcaagaaccacacccagcagcaatgtcagcggaagtggaaacctcagagggggtagacgagtcagaaaaaaagaactctggggccctagaaaaggagaaccaaatgaggtgagcgatgggggctggctgcactgaatcaggtgggcccagcacctgtcgtgctcagcacacctggttttgtctgttggcagcactggggagtggccatgggccatgagctctggacccctgggtgcctgcttggccctgcagggaccgcatacagcttcggctgcttagaactctccccactggtccattgtctcatccaaggaggcagggcaggtgctcctgggagtgctgataggatttgatggtagttatccttttttctttttaaaaacttgtgcgtttcctcatctgggctgagaaagggtaaacgcaggcaaagctggctctgttcagtcttttaccacataaaagactgcagggcagcctttccttactctgtatagggacagctcatgctaaacctgagcttccaggccctgttctgcatcattagcctctcatagccctgtcattggccaagttttttttttatcccttgaaataattgctaataataaattgattctcagcacatggatgataacgagctaatctcctaaagaagacagcagaagccagaccatgataaggccaaatttttctcactcttgtagatggattgtgtggacacatgtaagcccctgcccaagtaccaccatctttaggatcacatgttttctaccttgtccatccatccacacacctttacaactgtgtaatttcgttaagcagcacaaacccagcgtcctggccctagcctctcggttgtctcctttgcatccttccgtgcttggtcctagtcacatatagtctcaaagaagctgtgggtccaaggtgggaggaaggcagtagggccatctgaggagacccatggtcacagccttactgaggtgtgtgaattccagaagacacgttccaaggcaggctgttcttagagaagccagcaaatactgaagggaatacagatgtgtgtctcttcgaccactaggtggccacagaagcaaagcattgctcatttgggtggttcccaacacagacacatggacgtgggtactactctcaaggagcaggccacagttatcccttgtgtcctgagtccttggagcagaatgtcatgtctgcttgtcctgtgttccctgacaagttgctgctatttgtgttggagtgaagtgtctgagaagccccagcctccagtacaacaggtggtcaccttggggtgtggactcaatcttctctctatggtcctttctggaaagctgggaagggctaattgacacacaaacacctcccatctctccacagaatggctgacctctcggagctcctgaaggaagggaccaaggaagcacacgaccgggcagaaaacacccagtttgtcaaggacttcttgaaaggcaacattaagaaggagctgtttaaggtttgtgccccgcattgggttccagactgtcatatggggttggggtgggggccttggtcccatgagaaaagtgcccctggagccactctgagggaaaagctgggcttttctccacactccattccttcttgacgttaagctctggctctcggctgggtacagtggctcatgtctgtaatcccagcactttgggaggccgaggcaggtggatcacttgaggccaggagtttgagaccagcctggccaacatggtgaaaccctgtctctactaagaatacaaaaattagccgggtgtggtggcgcgtgcctgtactcccagctacttgggaggctgaggtgggagagtcacttgaacctgggaggcggaggttacagtgagccgagatcgtcccactgtactccagcctgggtgacagagcgagactctttaccccgccaaaaaaaaaaaaaattggttctcatggcttagatagaataacatagtggtgtgaaggaagcaaaagtatgcgtgttccaaagacttcaccatgccattcctttaagaaacaaaagcttccttgtgtgttaaataattcactacataaaaatggaccataggattgggtctttggggttgggggttgtcacttgagcctctgcatccagctgctcggatgtggtgtgctcaggcatagctggcctcctcctgtcacctccacagctggccaccacggcactttacttcacatactcagccctcgaggaggaaatggagcgcaacaaggaccatccagcctttgcccctttgtacttccccatggagctgcaccggaaggaggcgctgaccaaggacatggagtatttctttggtgaaaactgggaggagcaggtgcagtgccccaaggctgcccagaagtacgtggagcggatccactacatagggcagaacgagccggagctactggtggcccatgcatacacccgctacatgggggatctctcggggggccaggtgctgaagaaggtggcccagcgagcactgaaactccccagcacaggggaagggacccagttctacctgtttgagaatgtggacaatgcccagcagttcaagcagctctaccgggccaggatgaacgccctggacctgaacatgaagaccaaagagaggatcgtggaggaggccaacaaggcttttgagtataacatgcaggtactattgggggctgccagctgctagggctgaagagggaaactttgacagtggtagcagatccatagtggcccatgaaggcacacatggcattaggacagatgagctgcagggtgccgagaggaaggtggccaccagattggccaccagagcttgtgggcccagtgggtggttcccagcatggaggcctggtgtgatagatgccagtgggtagtgttttgggaagggtgagtcctctcgcacatagaggggtctggaagaatggagctggcttcctccctcattgcaggatgctggtcttgaagaatggttaattttcttttcaagttttgctctgagaagccctgctttataagttaatagagagccagtgccaccaaggagagtaaataagctctgtttacaagtagcctttagatgaggctgaacctggggaagcttactctgtccccaggtcctgtcagcttccactgaggcctcccagggcactcaggatgagtatgccctgccacagtctcattctcccatgttccaggttttctgttgcttcttgataaaaaaataaccagcacctagaaatggggatgtactcatgccctcctgtctgtgctgtggtagtttcagtggcttgagccacctcagagaaggctacatctctggtcagttcccaggggagacccagcatttggcagccttcttggggtaccaatatccacacctccccagagctcttgctagggagggaagaccatcaggcagtgcagctgccgcccaccagtgctgcttgctgtgtagttggcacacctgagcaagctcacctgctccagctcactctctctggagggcgtcctctaaaaggagagtgtagccaggcgcagtagctcatgcctgtaatcccagcactttgggaggctgaggcaggggcattacttgaccccaggagttgaagaccagcctgggcaaccaaggtgagacaccatctccccacaaaatttaaaaattagccaggtatggtggtacacacacgtaggaggataaggtgggaggaccacttgagcctaggagtttgaggctgcagtgagttagccatgttcataacactgcactctagcctgggcaacagagacctcatctcaaaagacatttaaaaaaaaaaaaaaagtatgggcagcccaaagatggctcagtcgatcctctgctcctgcagatattcaatgaactggaccaggccggctccacactggccagagagaccttggaggatgggttccctgtacacgatgggaaaggagacatgcgtaaatgccctttctacgctgctgaacaagacaaaggtaggtctgtgtgtcctgagctcccctcctggggcaggtgtagcaggagactccactgatgccatgtctcctattggtgctgccacacaggtgccctggagggcagcagctgtcccttccgaacagctatggctgtgctgaggaagcccagcctccagttcatcctggccgctggtgtggccctagctgctggactcttggcctggtactacatgtgaagcacccatcatgccacaccggtaccctcctcccgactgaccactggcctacccctttctccagccctgactaaactaccacctcaggtgactttttaaaaaatgctgggtttaagaaaggcaaccaataaaagccagatgctagagcctctgcctgacagcatcctctctatgggccatattccgcactgggcacaggccgtcaccctgggagcagtcggcacagtgcagcaagcctggcccccgacccagctctactccaggcttccacacttctgggccctaggctgcttccggtagtccctgtttttgcagtacatgggtgactatctcccctgttggaggtgagtggcctgtaagtccaagctgtgcgagggggccttgctggatgctgctgtacaacttctgggcctctcttggaccctgggagtgagggtgggtgtgggtggaagcctcagaggccttgggagctcatccctctcacccagaatccctctaaccccttgggtgcggtttgctcagccccagcttatctcctcctccgcgctgtgtaaatgctccagcactcaataaagtgggctttgcaagctacctccttccctgcctcctggcaccgggtgggtcaagccacctccccataggagagtccctcagaagcaagggcatgttatgtctgtgtggggagtggacatcgtccatcatggctcccagcagccacctcctgctctgggtctactctccagcacctctagtctccaaagcaaagtcactctaaccgtcttgcaaagatctttaaagtgtatccagcactgctattttttagctcagaaataccttagaggtttcctacttaaaaggtttttttaaaatatatatatatatttaaaaataagggttttaaaaaagcacatatttgtatttaaacaattcattctctaaaagagaaacatgaacttaaataattttattaataggaatctactacctgtaaaagttttatttcaaaaagggttaaaaagtagggaaactctttaaactactgaccaagactgccaccttcataattcagatgagttagtgcagagatggccagggccagaggtcgcccagaacctgcgtgtgcagactgcgctctgttagtcttctgcctgtcagcctcagcccagtctgtgttgcttaagggtgcgcctccccagggctggatgatgctgtgctcaagcctgcgggtaggagggctccagcttgcagatcccatgcgtggatgccatatatagatggttgaaaccagcatcagaggaaggaaggtgaccttacagccactgccgagaccaacgtgtgccctggcccagtcacagctggaaatcccagggctggtctacacccgactctggtttggtttaattaggtccttacgtgttggtgttgtcccaggcagttggcatggcatcagcactgagggtgtgagaccctgaggactcagcctcccgtcctgccagtagactgcctgcagccccaccctctttccctcaaaaaagaaggaagccaggcaagagagcagaggcccagggcgggggagtgaaagggccaatttaatgagaaactacaaactgagactgggccacgattcacagtgacaggaggccatgcagtggcagtgcgagaccaggaaggacagtggcaggatacagtggtccaggtgagcaagttcacaaaccattcaggaaataaagacagggcgaggctggtgtccaccaaggcagttctaccacttgtggctgctccttcctcgtccctagcccagtgtgcctgcaggagcaggtgtgagcaggcacagcaacagcctgtcagctggggtgaggggcccggcacttacagggaagaaaatccatggagaaggctctgcacatccaagcgcacccacaagggggaccctctgccatctcttgcccagttgggatacaccagccaccaggcagaggtcatacccacacgcagtgaggacacagggcagacgggaaggggctaggctcaggggctccttccggccccagcaatacagggttcacagaggcatggcctgaaagggggtctgcacactgactcaaagggacaagttccttcttagctaccagggtctgatcattcacccaggtacagtgtcctctctacctgacaccaggcagctctcgggcactgggacagggtattagacatcctgggcttctatacctgagagttctgagggccagagttggcagttttacttccagccaccatgccccacctctagcaccccagaggcgcaaagtacccagaaacaaacccaggctttgtgaccctgtcctacgtgggcccacctgactccagacaacttacccattctcggcccagcaggtcagaaacgcctgtggccacaggcctggggactaactggctaactgctctggctgctgttggtcccagggggaaagagtctggactgaacctgtaccttgtttggaaacagaggcatcaggaccccagcaggagacccctcccagcttatcttcccgatcacacacaccaagcagaccaacaacacacaagctcattgtcagccccctgccacccactgacccttggccttaaatcccaacagaatttttgccagaagagtcagcggctcaggtagggcagggtgaagaggacaggacttctaggggatggtggcacggctcccagccccaagtgggagcgggaaagtgaccactgagcacagggagcaaagcacagggggccagactgacaggcgggggagtcccgagtcccagctccgttagcacaggcgcttgtacgtgtagatgtaggctttgcagctggggcatgtgtgcgtcacatccttgaagtcattgatgaggcaggggatcaggcagcagcccagatcacatctgaatcagagacagggaagaacaggctgaggcctgctgcggaggaggcagaggcagccagttgaccctggtgcagcccccaccctaccagtgcccacaccacctaccccatgaagcaacagaagaaacccagcacgaaattcatcaagccaatctcgtaggagatcttggtggtgatggcctgctggcagtggggacacaccgtctgcacaggcgctccctcaaagatctctccctgcagcactgtcaccgtggtggcagctcctgaagggaccaggactgtggctgtgtggcccccagggccagggtagggccctggcgtgtagggccctggggggtagtagcccatgggtgggtgggggcctggaggagggtagaaacctggaatggcacagaagatggaggcgagaggtcactggcctgccacctgcaccagacaaagagattggcgcaaagccccacggtccacagcgcccagcgtgcaaggctacgcctcagacctcctaccgccctcctaacgggccagtgggaggccttacagctggggccctaagtcaagtggggccacattctcccagcccttcctggtccccaccccttggggcccatgacagatgtggcagagagccaggcacatggcccggtccctctgctcctctgtctgtctccagcatgcaaggacagggcactcagcctcaagcccatgaccaagagagggaaagccttgcgggtcacccacccctctcctgcacacaaggcgcccctccccacccatgtcaggtcctggtgtgccaaggaccagcccttcctgaccagcctgaataagagcagtcccaccttcccacgtccacagtccctgtccacacacagcctgagccctaggcaagggctggttgggcgtgttggagtccctgccctacagcagatgcccacctgtactgaggacagccagcgcaggccagacagcagccaggagttccccatgctcccctcagatcccttccccactcacccggaggcatgtaggtgccatctgcactcatgtgtggtgggatgaagccaggctggggcattgggtgacccggcggctcatagggtggggggccaatgtccgcagggggcagtggcatgcctggagggggctgcatcacagctggggaggaacggcctggacagagagaggcagaaagaggagactgagctggagcctctgcacgatgagctcgaccagaggccactgttttgggacacagatggggcccaggggtaaccctggagtgggcatcaccacttagagagtcccaaccatgccatggcggcagggggctgcaatatggagcctcaggaacagtgaccccctacctggggtgggcggggctccacttttctcttccagaagtggggctgtggggcccccaggataaggagggggaggctcgctggacatcttcgctgcttctcctggacatggagggaaaacccagacatgaactaagctcccagccaggttccttctccttcagccctgtggggtggccaagatgctgcacaaggcgtgtgaccatcctcagaagggtctgcctccaggcactggggatcccccacctttcccagggccacctagcccagagccaccatcctcacctctcagtagtcacctgctcttccctgtttggaagctgaagggcaaggacagaacccaggaagcagggcccagtgaggtaaagtcccccaaggagcctaactcagcacttgccccacacgagagcagtttggcaccgagctctcccctccccaaacgtttagcgggcactaaggcagtcggaggagacactggaccgatctctgccacaggctgcactgggaatgggggttctgggggatttcttacctcaaatccgtgctactcagagaagggaggcaggtgaggctccttcagctgctggcctggatggacagggaacaggcagggctccgggagctgtttcaggggaaggaaaggcagggccctcagcagggagcaagggctgccaagccagggctgggcccaggggcctgggcataccacacagttcctccccttccacatccggcttctccctagctgtcactctgccatccacacacccgaccacccctccattcctcggtcccgtcgcaggtctgcttcctccctcccccaggactgctggcacccaagggccacggctgggccctctgcctcccctcccaccaggcctgagctcccatgcatgaggactggactgccaggcaagctgtgctctggcctgtgcccttctggtttgtttgttgaggtgggggtcagggggaagaagagtcaagtgaaatcttttccctcatttctgtcaccaaactctctgagcacagctcagaaaggtgggaagcttttgctcttacttagcatcataaaggacttgggaagtggggttcagttaccttagctaaaagtaataaaatgagacaaaaatcagtttcagtggaacaaaaaatacagggaaaggagtgtttcccagacagcccagcacctgcaggggatggagggcacataagtttgaatataaagtttaacaaatcaggggcagggccagaggaaccaagtccaagctcttgggttcaactataaagtaccatggaagtttgaaaactgaaagagatcaaaaagctgttagaagaaaatgcaggcatcaatctttatgaccttcgattaggcagtggtttcttagatatgacaccaaaagcaaagcaacaaaagaaagaaaacttaaagtggatgtcatcagaatgaaaaactcttgtgcttcaaaggataccatcacattttataattcatagatctgataaaggacttgtattaagaaatacaaagaactcaactcaataacagaaagacaacccaatttttaaaaggatttgaacaaagacttctcaaaagacaaatggccaaaagcacatgaaaaactactgagcgtcttttcataagggaaatgaaaaccaaaaccacaaggagaccatttcctatctactaggatggctaaaatttaaaaagacagtaataggcattatgtagaaaaactggaaccctcatacactgctggtaggggacagcccctgcaaaccttttgaagaactgccagcccctgttccccttttgaggaacagtctggcagttcctcaaaaggttaaacctagagttaccagatgacccagcaattccacccctagttatctgcccaaaagaaatgaaaacctgtctacacagaaatttgtacacaaatgttcacagcagcatgaatcataatagccaaaaagtggaaacaacccaaatgtccatcaacaaagtggataaacaaaaccgtaggctgcccagacaatggaagacgattcggctataaaaaggaaggaagcactgacaccctacagcatgaactctgaaaacatgcttggtgagagaagccagacacaaaaggccacatactgtatgatttcacttatatgaaatgtccccaataggcaaacccatagaaacggaaagtacattagtagctgtttaggtctgggggagaggggaaatggggaacatggaatctccttctggggtaacgaagatgctctgaaaccgattgtagcaacagttgaacgattctgtgaataactaaaaaccactgaattgtacactttaaatgggtgaattgaatggtacgtaaattatgtcaataaaacttatttttaaaaaaaatgagggaaaagaaaattagtcctactgcagcccatctccacatgtccctgctggtctgtatgcacaggcacctgtaccttttggttttgttttgtagagacgggggtctcactatgttgcccaggctggtctcgaactcctggcctcaaacaatcctcctgcctcggcctcctaaagtgttgggattacaggcaggagcaactgcgcccagcccataccatataaaaatatagttgctgtcctgacagttttaaatcctttttttttttttttttttttttttgtgagacagagtcttgctctgttgcccaggctggagtgcagtggcgcgatcctggctcactgcaacgtctgcctcccgggtcccagcgattctcctgcctcagcctcccaagtagctgagactacaggcacacggcaccacgactggctgatttttgtatttttttagtagagaagggatttcaccacattgaccaggctggtaaatccttttaatgctgtgtcacacatattccatcttacaagactccgtgaccgttgatattaatattccacaaaatgggcatacttgaccaaaccctattaagacatttaggcaaggccctacttgctgctttcatgaaatacaagagaacacctctgtccaccgctctttcccttttgttagattatctcctcaggctaagcttgtcagagtgagatgactaggtcaaaggacatgagcattttatgcctttttgaaaggatgccaatttatagtgccagttattaattttcatattaaaatgtcacttatttttatatgcatttctttggcaatcaggagacagaacatctttccaagtgttcagaaattacacctcttctgagttgccttattatccacagaagacatggaggcctagaaaaggatggggcggggcataagtctaggaccccagcatgactctcccaccctcctgcctgcacagtgaattccaatggcacagggttaagaaaagggagcagtggccaggtgcagggacttattcctgtaatctaatctcagcactttgggagactgaagctggcagatgaactgaggccaggggttcgaaaccagcatggtcaacatggcaagactcttgtctctacaaaagaaaaatttttaaattaggcatgataatgtatgcctgtagtcccagctactggggaggctgaggcaggaggatcacctgagcccaagactcagaggatacagtgagccatgatcaggccactgcactctagcctgggcaacagtgcgagaccctgtctcaaaaaacaaaaaaaaaaaaaacagaacagggagtagcagcagtgcctcttggggctggtcctggggtcccttgcccaggctgctcctagcctgccaggtgccctcctgcaggggagaagagggcagcctttcatggggctttacctgcgtctggaaaactgctccaatacgttgagttggaataagtgccagcccctgctacaaactcccagactcccagaaaatgctctctggcgcctctgggtggcaccaccgtccaccaagtggcccaacactgtggtctgcagtggtcttgctcatcggggaatggtccaggccctgggatgctctgagcagaccaggaaaataagctgcactgtgcttggtgagtcactgaagcacctgcagatcccagcctgggtcccttgcagggagcacacacacacacacgtgtgcacacacaccccatctctgagaatgcaggtgttgcctttctctggcccatcttttcatcaaagtcaacagatataatcctatgatctcctagagctcaaaaattctatttctggaattccacatacagccttgcccatgatgatagggtgtaagcccacagggcatagccctcctttggtgttcacccaacctgggtacagaaaatgcaggccacagggaagggtctggacctgcacagggctggcttcccctccagctcgatggccacaccagagcccaccttctctttgcccctcaccgggggccgcagggccctgttgctcctccgtgtcttccccacctagggccatgcctgctactcactgctccccctcacccctccatatccacatgcgtcctcctgctgccttcctgaaccccagcagagactgcagggcaggtccttctctaccaaggagaggatctggaaaacagctcatgaagatttcccgaattcaaacacccattctcccagtgccttccaatacaaaatcaaacatgcattcccacaaaaccatgttgtgtagggtgtaataaaaactacaagaataatctttcaatcacacgatcagaagcaaaatagttttccaataaaacgagtactgttcaaattaagctacaaaatggaaaatgtctgatctgaaaatgcagccccagcacctctgctgtgggaaggtgctggtgagggagggggctaggagacctggggatctgcccagttcccaacagaggaggaaggggagacttgcggggtctggggagcccactgaagtcaacttgcagccctgacaaatccaagagaggcttcttggccttcttgctttaaatcttggatttattaattgcaaacaaaataggtgcctgtttgaaaatctttacaagtcaatcacaaacttaatagtaagtcactcctatggaagaccagaggcctctgcaaagtctacccctccacaccctctgggttctgtggcatgtgaaggtgtggagaaaaaacctgtttctcctctgctttcacaccataacaatcaacagaaaagacttctgtggcaaaacatgtgggggtttctccccaataacaagcaagcagtcagttctgcagcggacaccaggtggacgtcttctagtggcattcaagtctgatgctaccgtgtcagatcccacaggttgagggctcagttccatgactgccccccacttctgatcatcgcaattcctagcttgcgacctgcgcttctgacagactggctacaaatcactatcttgggagcggattccttgtaagaggattagctagtcttttgtgggtgcctctccccgcggcccttccaccatgggatgacacagcaagaaggcccttgccagatgctggcagtgccttgatcctggacttcccaagcaccacagttttgatgactgatggtgaggcttaatgggagttgtttgggacatgggaggtggattcctcatgaatagataaatgccctccctggggtggaggagaagcgagtgacttctcactctgttagtccccgcatccttgctggttgtcagaaagagcccagcgcttcccctccccttctcaccccctctctcgccatgtgatctctgcacagagaccccccgtgccttccaccatgaatggaagcagcctgaggccctcaacagaagcagatgttggcaccgtgccatcctataaagcctgcagaaccaggaaccaaatactctcttttctttataaattactcagcctcaggtaatttatagcaacacaaatagactaagacaccagcctccagaactgtaaggagataaattcctcttctttatgaatgacccagtctcaggtattctgttagagaagcacaatggactaatactacatcaagacttgacaagtggtaggttttttttttttttagacagagtctcgctctatcaccaggctggagtgcagtggcgcaatcttggctcactgcagcctccgcctcccgggttcaagcgattctcctgcctcagcctcctgaggagctgggactacaggcatgccacccatctaatttttgtatttttagtagagatggggtttcaccatgttgaccaggatggtctcaatctcttgacctcgtcatctgcccgcctcggcctcccaaagtgctgggattacaggtgtgagccaccgcacttgaccgacaagtggtagtttcttaagggttagttgccacaggaattggaagccttaacaatggtttttttctaatgtgttacattagaagtcattggtgtaccttgcatttggaatgggtcttttacatagacatgatttcttaacatcatgtgtgggtcacctgaaaatacgggttcctgtaatgcagatctaccaatgttgacacatctcattgaacaatatatatttttttaaatcacattgctggtatcactaccaatgtcattaaagtcactaaatattgttaacgctaatcatcatttgaaagcttgaatttcatcactggcaacaaagcactaacaaatatagaaacagcaacatatacaaaaataaaaggtcagttgtttcccttgaagtagcaagttcactttgctcattttcaagaaagtgtatgctaaatatccaaatctgaataaccacggtgtgtgccagttgttctttaagtgaagatggagtccatgaaaaaggcagctagttcggcccacacttcaaatgaatgcacgtgtgcttttcctcacgacagcatcaaactccatttgacatacttcatgtgtgcctcatttcgtcacaaaggatcttaaaaagctgtggactcatgggtcaggacttaataaagttgatttttactgctttttctgatgcaacactggtgtgtgtgtgtgtgtgtgtgtactgtgtgtgtggtggtgaagactcaattacaacaagaccagcacagtgtggtgccagtcttgagtcagtgcaggccccacagcttgtttccgcactgctcctacaccatcaatgtgaaagccatcacaaacaaagaggcatggtaacaaatcatggccgtgttattattaaaacagttctgatcctagccccccgagtggtctcaggaagcccccaggagactgcagatcacatttcaagaactgctgtgctagaggaacccccactagaagttaaggggtgcgtatcagccaagtgcagggctgggacaggacttcacaaccagaaggatcaagagtggcctgcaagtcttggagtcgctcctggggaggccctgagtttgttgttctggcaaggccccaccccagggatgtgcttgccacccggtggaaggctttaaatgaaacaagcagtcaagaacatgggctctgggccaggtgtggtggctcaggcctgtaattccagcactcggggaggccgagacgggaggattacttgagcccaggagttcgaaaccagcctggacaacatggcaagacgtcatcaatattaaaaaaaaaaaaaaaaaaaaaaggcgggggggcccgctctgcatcagcttaattcaaacccagacccccaagacccaccactttccagctgagcgagctgagcctcggtttcttcctctgtaaacagagatgatcatgcctacctctcagggtgggagtgaggttgaagagagactgtgtgtgaaacgcctgcagcagaaacgctgggcctagcacacaatgacgctaaataaatggaaactgctattattatgctttattaggcaacttccaacagggaggaaaacaacaggtattgacgcctctgccatggagtgccttctgattcccaacgaggggtcctggtgcatgttcactaatatgactacaaggggatgcctctaccggattctggagggacttgcaatcaaaaccctccctaagaactcagctcagcagcgttccctcacagcacagctcagctgggccacctgctccacggtaacccgagacaactctttgagaaggcagagacactagcagtcctccaagggccatctctcctggtgggctgtggaaatgccaggggcctgcctgggagtgcccaaggttggcaatgcccctggaaggatgctccaccaatacaccctggtggcaggggctctgcagcagctgctgcccagacacatttctcagagctgggctggcttggtgctgcatccccaggaggtgcttacccacgtggcagccatggcgtcaggacgccagctggcctcagaggggctcctctgtccccaggaggcaggtcccaggcatccagccaggaacagggctttctgctttgctgggaaaactgaaaggccgatttctgccttgcctgcagcttccatgtgctgaataaaggaggtgcccactgctccatgaggggcagagccgaggtaaaagacaaacactctctgtgcttcttgggtctgaaaagagaatggcaaggcccaaaccaggtctggaggaaaaggccaaagcaagaagtgagccagaagcaagcaggagctcacgtgggcctcagggaagatgctctcagtccagatagcagcaccctgcagggacagggcagcgggaaaaggagagcacagaatccccaccaagggtgcaggcctgaaggggacccttccagggaggcttggcccacactaggcctttccatcctgtgacatctccatccaacacacagacggattagttcaaacccaccttggagggcggtgtgagaattaagtaaggcatggatataaaaacttactgaaccactgtaacgggccatgcagcgtgagggtcattaggagggggactgttacttgcaagggatggccgctgaccacgtagctgttccgcctattctcccaagcaccccagggctgggctgaagcacagtctgtgaggtgaccacgtaacagaggccctctaaggggagggcgggggatggtgcttccttctgatagttactcagcacatcctccgtgccagatacaggctggggattaaagacacgtccctggctgggcgcagtggctcacgcctgtaatcccagcactttgggaggctgaggagggcggattacgaggtccagagatcgagaccatcctggccaacacggtgaaaccccgtctctactaaaaatacaaagattagctgggcgtggtggcacgtgcctgtaatcccagctacttaggaggctgaggtaggagaatcacttgaacccaggaggcggaggttgtagtgagccaagatcgcgccactgcactctaacctggcgacagagcgggactccatctcaaagaaagaaaaaaaaagacatgtccctgccttccagaagcttacggtcaagtgaagaggatgagcgttaaataatcacccccctcgccaaaaaaccacaaacacaattacatctgtgaccagtggtatcgagaaagtccagggcacagtagaaggacagcaagatcgccgttctggagctctaacaccatctcttcaagcaaacctgggaggaggtggcggaagagttaatgagaccagcaggcaaagggagggatggggacagcagagggaacagtgagtacacaaggcctaaggaaggagggatgtgcccctgagggtggccagatggcagcctggggccctcacagcgacccagccacagggtttgttccagagctcaaatacctcagatctccaggacaaggatgacaaggccagctggacagtgtcccaggcccttctcctcaggctttaggcttccccaggagacctccggcaccattcagccttgttgcattgtggcacttggaaacaaagacagcggtcttctttgcttgactgtcaatagaatattgggagagcacaggtctccctgggaccctgcctcgccgctgatggcctgcagccctagacaaattcctcaacctctctgagcctcagtttccccacgtgcaaaatgaggttcttggaaggctgaacaaaatcccacatgtagatgtccaggctgtattgctggagacgccttccatgaattactacgcagataccaccacccatacagagctgtgctgtgctcctccacatcacactgcaaaggaagaaggcagaataacaagatctcaaacagcaatgttccgcctaatgaagtacagactggagattgccagctgcacccaaatccactctctcccccattcttgaatacagaactccactttcactcagggcaagtccatcaaccaagagggtccccgagctttcttagagtgacaaagctttggctaatgagctgtaagcagaagtgtccagaccataagaaggcattcagggcaagccgactcagcccggagccaggcccttcatctttcctgccttcctcccatctaccacctggaagatagatgccatggctccagtagctgtgcttcaccatgagggccttgggatggaggccagtgcctaggacagccatgggacaccacaccagcaactaactgaccacctcccacatcttccacatgagtaataaaacttggtttactggttaattattggtaaattattttcaggttaagtattaacaagtgtcattacaaatatacagcacagacaggtgcagtggctcacacctgtaattccagcactttggatgccaaggtgggaggactgcttaaagctaggagttcaagaccagcctgggcaacataacaagatcccatctctacaaaaaaataaaattagccaggtatggtgatagacacctgtggtcccagctacttgggaggctgaggcgggaggattgttctagcccagggattctaggctacaaagagctatgtcacgccaatgcactctagcctgggcaacagagtgagactctatcccccctccaccacaaaaatatatctctacagttccttaggtctgaaggaacacaagttctcttcaagtgatccatgatcaaaaggatcatggctttctttaggtcacatgacacagcctcagccagtacagaggccaaggcatggggaatactccctggcgggaaggctggagcagatgcttccgtagttaaaacaggccccgagagaagtgcagctggttgccttggagcgaggacacattcttctgcaactccagtgctcatttcagcatgagcactggctcaaggaggagctgaggaggacgatggcgtgcagtgaacgttaatagagcatgcactgtttggatgcaggtgcccagcacagggacatgaaggaagtgctccaagtgaggaggtgctcaaaagggagcccctgctgtgagactgctcctgggccccaaaccctctccactcccctctccaccatgccctatccaaacctggggctaatccagccacccaagtccatgtgggaccaggccaggattccctgtggcctttcgcagctgaccagagggaccctattcccaacgctgggtgatgagcaggaaagaggaggccctccacaaaggtccactcagttgcagagcagcctctagtgaggctgagccctcccaagactcagggaggttgccaatgtgtccccttctctgggaccgttgtcctcggctgccaagttctagcacaggcaggcctggaaaatcctgaacatggcccatttcccattgtcctgatggaggcaggacgagacagtccctccctcagataacatcgcgggtggctctgaaccatttatttatttttacacttgaagatgggtgtatctgatgccttgggaattctaaacacttcaaaacaagctcaacttaagtcacagaaaggaccagaaaacagatctggttttcccatctgccagctctcctcccacccaaccctacatgctcctcctcgaccatgatgagtctcagcggaaataagacaccagcctagccaggcacggtggctcatgcctgtaattacggcactttgggaggcagaggtgggcggatcacgagggcagaagttcaagaccaggctggccaacatggtgaaactctgtttgtacaaaaaatacaaaaattagctgggcatgatggcatccgcctgtaatcccagctactcgggaggctgaggcaggagaattacttgaacccaggaggcggaggttgcagtgagccgagatcacaccgtcgcactccagcccgggcaatagtctgagaatctgtctcaaaatataaaaaatagctggtcacggtggctcacacctgtaatcccagcactttgggaggccaaggcaggcggatcacagatcaggagattgaggccatcctggctaacatggtgaaaacctgtctctactaaaaatacaaaaaaattagccaggcatgatggcgggcgcctgcagtcccatctactcaggaggctgaggcaggagaatggtgcaaacccgggaggcggagcttgcagtgagctgagatcgcgccactacactccagcctgggcaacagagtgagactccatctcaaaaaaaaaaagataaataaaaataaaataaaaaataaaataaaaataaaattaaaaataaaataaaaaagacatcagcccaaccccatggccccaaacaccactgcgccctccaacagaagcatgagccctgtgtcgcaggcagagctgcaggggcagaatcttgcaccgagtggggcacaggcatcaggccccacgcccaccaccctgccctgccacctgactctccagtctcagattttttttcatctgtgatatggcggtaggagcagccccttatcaagaattgtgatgagtcacgggagaggccatgggtgaagagcacaccactgaaggcctgccacaggagcctgagagaggaagtacacgagaaaaaagaagacactgttacttttttttttttttttagacggagtctcgcactgtcgcccaggctggagtgcagtggcgggatcttggctcactgcaagctccgcctcctgggttcacaccattctcctgcctcagcctcccgagtagctgggactacaggcgcccgccaacacgcctgggtaattttttgtatttttagtagagacggggtttcaccgtgttagccagggtggtcttgatctcatgatctcgtgatccacctgcctcggcctcccaaagtgctgcgattacaggcaagtgccaccgcacccggtgacactgttgctcttaagcagaagcaaaatcaaaaggcagacaggactcaaagaatggttctaaacctaaaagtactaaggcctctaggaactatgatgatgacaattactgtgcaatttatatcatgctgaattttagtaaaacctcctggcaaaccactctcacttggtgacactccgtccacagcacggggccacagcatagtggatcagtacaactttcctggacagccttgctacctgtacactcttatggactcaattccacttcaatgtattcgttctagaggtaaatggacatgtgaacacagattcacaggcaaagatgtttatatgcaccactgtcttgatgttcaagaaaatggaactggttacatgcatgtgattagctatataatgtaactgtattcagcccctaaaaaatgatatagttttgtttttgttttttgagatggagtctcgctcttgttgcccaggctggaatgcaatggtgcagtctaggctcactgcgacctccgcctcccgggttcaagtaattcttctgcctcagcctcctgaataacaaggattacacgcacccgccactaagcctggctaatttttgtattttagtagagatggggtttcaccatgttggccaggctggtgtcgaactcttgacctcaggtgattttgcccaccttggcctctcaaagtgctggaattacaagcatgagccaccatgcctggccaatgatatagatttttattgacatagaaaaatggttttaatatagcagtgagtgaagaataaaaaagcagtagcacagtgtgattcttctttagatgtatttacatacgtaacacattttttgtctttgttttttcctttttgtggagaacagcgtcctgatatattgcccaggcaggtctcgaactcctgagctcaagctatcctccagcctctgcctcgctaagagctgggattacaggcgtgagccactgcactcttccataacacatattaacagtttttctgggcagtaggagtttaggggatttgtttatatgtaagtacacatacagaaacgttctactgatgtggagtttctagttttttaatggtaggcagcacctttacatgactccttcctcaaaatgctcattataagtcagacacagtggctcacgcctataatcccagttacttggggggctgaagagggaggaacactcaacccaggaggtggaggctgcagtaagccatgattgcaccgctgcactctagcatggacaacagtggggaagaaccctgtctcaaaaaaaaaaaaaaaaaaaaaaaggctggccgcggtggctcacacctataatcccagcactttgggaggctgaggcacgcagatcacctgaggtcaggagttcgagaccagcctggccaacatggtgaaaccccatctctactaaaaatacaaaaattagccaggcgtggtggcgcatgcctgtaattccagctacttgggaggctgaggcaaaagaattacttgaacccaggaggcagaggttgcagtaagctgaggtcgcatcattgtactccaggccgggcaacaagagcgaaactccatctcaaaaaaatatatatatactactcctcatactcctcaatccagaaacacacctcagactataatctaatttcacctacaggagaaaatgctctgcagagcaagccagaggcctggactggttagtggcctcctctccaaagccagccccttatggccataggtctcccatgagtttggtcaaatgagtcagttctgccagatcacctcccggtactccaggcaaatggaaagtttagatctgtaaagttggaatgtaatgacctcacagtcctgctagcctaggagaccccgccaggagacccagcaggaggtcacctgaccaaagagggctggtaagaaagtccccgttggatgcataataaaaacgagtgatagagcccatgctgaggacacagccccggcctcccaactcgcccagtgatctcgccaggactctgaactacctcccaggcagaacgctgctcaagagcttgttcctgcatgctctcctgctagcagagaaaatgaaggaagcacagacaggaggggaaatgcagagcaaaaggaaaaaatcagacacagctcaaccacaagtgaataaacaagtcatctgcacctgtcccacaggcaggccttggtaactacaaggctgactaattttagaaacagcatgaacctaaagaaccatcatttaagtgctcaaaatggagcccttaaaaaaaatccttctgtctgcctgtactgagcagacacaaaatggacagtcttgggttgactctattcaaccagctgtctgttggatgagatcaagacacaccactgcaacctacaaaaaagcaccaggccgttaagtgcagtcaagacacgtggccactcacggccacccaggtggaagagtcttaattcagacacaaatgtctcctggccgtccttagccagggagctgggctctgcccgcggccaggtcttgcctgagtccccctattccgtgggtcggggtgggatgtggaaaagcaaacctctaggctttcttcctccaaatgtgtcagtcaccatacatacctgtacacagaagctccccctccagcaattttccctcagaacagtgaggacagtggctcatccctgcgacatttagatctctcatgttacagggcattctttcaattattttgaagacatttctgatgggtgaagaaagcgctctaggaactgagagtgggaatctaatttgtattttacactacattagatgcaacagtatatagcatatggaaattagttaactgagtttctatcactcttagttggcatctgaccctaagaattcacttacattggttgggtgtgaaacaaactgaattagtagtttacactgcattatatgaaacagtatatagactgggtgcagtggctcacgcctgtaatcccagcactttgggaggctgaggcagtcggatcacttgaggtcgggagttcgaaaccagcccgaccaacatggagaaaccccatctctactagaaatacaaaattagccgggcgtggtggcacatgcctgtaatcccagctactcgggaggctgaggcaggagaatcacttgaacccacgaggtggagcttgcagtgagccgagattgcgccagtacactccagcctgggcgacagagtgagactccatctcaaaaaaaaaaaacaaaaacaaaaaaaacagaaatagtatacagtaggccaggcactgtggctcaggactgtaatctcagcactttgggaagtcaaggcaggaggatcacttgagaccaggagttcaaagctgcagtgaactgagtgcgccactgaactccacctgggcaacaaagcaagactctgcctcaaaaaaaaagaaagaaatagtatatagaagtttattaggttggtacaaaagtaattgcagtttttgcctaagttcctgtaactctaagtcaacatctggccctgagttcactcatgctggctgggacagaagacttattctggaagcttgggaaaacaggagctcacgtcatgattgggactgccatctgcttggccatgtatatatttctctatgactcagacatcagagaccaggctggagtgcagtggcgtgatctcggctcattgcaacctccacctcccaggttcacgcaattctcatgcctcagcctcccaagtagctgggactacaggcgcctgccaccacacccagctagttttttgtatttttagtacagatggggtttcaccgtgttagccaggatggtctcgatctcccgacctcgtgatccgcctacctcggcctcccaaagtgctgggattacaggtgtgaggcactgtgcccggccttttttttttgtatttttagagacggggtttcgccatgtttgccatggtctcaaactcctgacctcaagtgatccttctgcctcagcctcccaaagtgctaagattataggtgtgagtgtctgctcctggccagagaacaccttttggaggttgcaaggccatcagagatgactgggtccaagtctaagctgccattcatttctgtcttaaatgtttactaagcacccatggaagacaggtgccctgtgaagtgctggagatgacggtgggcgagcaagcagtggcacagagtggggagcagtctccgaggagagaagtggctgccccgggcaccccagctgcctggagatgacagagccaagacaggacctcagctgtcctgactctctccttccacatcactgtcagccctgtttcttttctcacacattctccagaaatggttttcaaaatacacttgagtgggatctcacactcccaataaagtgcttcacacagtgtagctcacacagtgcagttccttcacatgcgttccatttacatagatttcatggtacccaggacaaaaagctgaagtggcagtgcccggtcccctgctttccctggggagggaaatgggacacagaacgtgctgtttcctcaggccccgctgggcctctagcagggggagtgcctctgagctaataggcaattcaaggactttagaggacagtttgacttatgaggtctttgctctgctagttgactttagaacctaacccactgaatgtgtactgaagaattcaacacagcatgcaaatcagcacccccaacactcaggcaatgacggagcacatgaagaccacggtccctgcgtcttggctcttaggaagatgagacggctgaaatgcaggcatggtgtatcattttattcaaccaataagtatggaccacacactatgcgtgaggcatttcctaggcactgaagatggcagatcaacgtctgtcttaatggcaggcagcttcagtggggggctgagtagagggcataaaatacagaaataaaacatcgggcctggcacagaacaaagcgtggcatggaagaaggaagaacaaggaagtggttgccacagggctgcagttgtcaccagggatagctccactgagcagggaacactccgtgttggaggatgggtgagccgggtcctctggccacagcaggatgcccacttttaccctgataagccgagaggcttgcagagagcttgggaaatcatttcgccccacgactctccattttccgcactcacctgccatgctaatccagttctccaaagttctgacatcaagtaggtggctcctagagctggggagcctgagagcactcggctaccacctccagcaggtatagttcctttttggccaattttactggggccacagagaaatgcgtcatggtgtggccactgtccctgcaaagcagctaaacacacaccacagaacctgagcttgaccatgctggggacagaaactaaggcctgaggtcaggtgacacaaaatgcctggggaatctgagatctgagaagtgctcacttgaggccttctcccctgaacagggcaggactcttcaggttcaaggatgaggccgtttcactcagcagagccatcaccatccaagttcctctcttttttgtttaagtgactacctgtttgaaaagactcatcagaccctccatggaggtcactcacctcatggtccctgccctcagggagctgcagatctacctggcaagacaagtgacacttgagaagaacttataaaaaatacacaggcaagcccagcaggagctgtcgcctctgtgacagcaggtgctccagcagagaaaaggtgaggcctgtcatgggcttcacagccctgcagggaggtggccagggaattctgggtctagggcaatggagtcactcataacatgcagaattagaaagttgtgatcaaggccatctcccagtcagacccatagctcctgcagggcagggtcagaccttggggccagtttctccagggcaccgggcagcctgtgaaacatgggttagtgggtggatgggctgcagcttggctgctgctctaggcaggaactctgctctccagccagaggacccttctgttcacttcactcccattgccaaactggatggctgagaggcgctccagacctttctcgtctccttaaaccatgaccagtcagcaagtcctactaactccatggttcaaaggccctcagatccactatctcatctaacagtcaagggtgacagggaagagtctggacttggaccatatcccagatctaccaccggatcgtaactcacactcctccaaactatctcatccccccacccttcccaagcccacccccgtactctttccctggcctccaaacacgcccacaccccacttccctgcaaacctgggccttcctgaggattctgctgccaggggattctctgtcccttgtcttatctcccctcaagaatcctgggactctcccacttgtattgttgggccctgcttggtgcctagtccatgtgtgttgaagaaatgagtgcacaggtttggggttgacctaagtggacctcctgtgccattcttttttgtttgttttgaaacagtctcactctgtcacccaggctggagtccattggtgcgatctcggctagctgcaacccccaactcccgagttcaagcaattctcctgcctcagcctcctgagtagctggaattacaggcacctgcccccacacctggttaatttttgtatttttagtagaggcggggtttcaccatgttggccaggctggtctcgaactcctgacctcaaatgatccacccacctcagcctcccaaagtgctgggaatacagccatgagccaccgcacccagccccttctgtgccattcttaacccaaaggccactgcccagggtgagaacacagccgcagccgagagagactccactgcgtcctcaggaaagtacttacgttcacagccaaatatccagacaggaaaaaacaccatttcttgaattccagtcaactccgtgatgcagtgatcacaatggggctgggagagcccacgtctccctcagctgctcttccgccacccctgctgtttcagggccagccatgggcccttctctgccattacttggcaaccatgggcaagtcacttagacactctggctgctgcctcagctggccaagtcccactgtgctgctacctccctggctgacaggtgagaacaacgcatgttcatagggcggtacactgcaaagaaccccatttcctcctgcttccccagcctgtgaggccgctgtttgcatggtttttttttttttttttttttttggtttttgtttgtttgattttttgagatagagtcttgctctgtcacccaggctggagtgcagtggtacaatctcgactcactgcaacctccacctgccaggttcaactgattctcctgtctcagcctccggagtagctgggattacaggcatgcaccaccacacccggctaattttgtatttttagtagagacggggtttctccatgttggtcaggctggtctcaaattcccaacctcaggtgatccgcccccgttggcctcctaaagtgctgggattacaggcatgagccacagcacccggcctgcatgttaatcagaattgtgacaaccaagctcgctttcttcctgaagtaatacgggttgaaattctccctaaaccctcccaaggcagctctcgcactcttctctacctacttccacctttcttggcctcttttccttcttgggggaaaaacccagacactgggactagatctgaattcagacttaattagcattgattgaacaattacatctcaggaagaccctcagtgtttactgaacccccattacacctccttgcagtaagaatcgatggtactgaatcactcaatgtacagaccaagccaggtctcacccacaaatcaggagcactgaaaaggtgacaagaaatgtttcctggaaaaatggtccagtattaccaaaaatgcatcacaactgctttcaaggaaagaatcagaatgctcctggaccccctcaccctgcactgcaggctctgtattggttttgctttgtctgccgtcagggacccttcatctcttcagcgctaacagcagatgcaggccttcctgtggcctgggtgatgctcttcacctatcacagacgcggccagcaaggcctgtctgtcacacagcttcaacatgacagagaggtctccacgtctaggcagccctggtcccaggacaccaccaatgtcatggaccactgcctgatgactcacagagtaggagaagtggtgaccggggccatcaggcccacgggttcaggagccaccagaccagtgtctccaagagtggacagccctctgggcatggggaggttctggcccaggccctaggcgcctccacctctgctgcactgtattgcaaggtagcctttaccacctcccacagagactgtggcttggagactcctgactaggcagagacagaaacagaaactttttgtgggatcctagaaaggggcacatttccattttgagtaatctatttccaagtcccctcgtgggggaaagggaacctcctgtcaccactgccggcctggctctctctctccatcctccccatggagcgccaaggtcctctgcagagctctccctgcctgccaccttctcaccagcacttcctccacctacaggacagtgacatgctataaaatgccacaactttaactaccatatttccctgtgtcttctatgagtaaaaacatgtccttacccttggaaccatgttcctcaaagtggagacaaattttcacagggcctatcttttctctcccactcaggcaactgagtagggtgaagggctggtgtttgtggctaaggaacaaagtacctgggcccaagggtctcaaagccacggcctctagtccatcaacaccatgagctaaattgcactacacaccccagttcccctagaccttagaaaacacacactgaactggtaggttcaacctggacaagcttacagtgtaaagagccgacagggagttgcaagctgatgactagcttcaattattgccaacgtgatctgctggggcaagctggccttcgggacgcattccgttagctccttctcaaaacaattttgttccctgaagtattactttacatcatacagtcaatgttctgctcttatggtgattctagaaccacggctggctgctcttaaatccttgtaagaacttgggcacggtagctcctgcctgtaatcccagcactttgggagggtgaggcaagaggatcacttgagcccaggagttagagaccagctgggcaaaataatgacatgccatctctacaaaaaaaaaaaaaaaaaaaaattagccgggcatggtggggcatgcctgtagttccaggtactcaggaggatcgctggagacaaggagttcaaggctgcagtgaacgtcgtgacggcaccgctgcactccagcctgggccacagagcaagaccctggctctaaataaataaatgaacctttgtaagagaacctgtaaagctcttccctggttctcccatcctgtggaaaacctccgaactccttcaaattctcaagggtgagagacggatttctaaatacccagggcttccattaaggtaaaaaccattaagaagataaaaaagtcaaacccaataaacaacaattctaagactctaattaatgacatgcatgcttatttgggagggaaaggcactgatatctgcaacttactttgacacaaaaaacaagagggactgctggttggacaaatatgtgatgaaatacaataaagtgttaactctacattctaggtggtggtctgtgggtgttcactgtaaaattccttcaacttttgtatgtttcacgtttttcgtaactgaatgtgtagagggggagtcttctgagactggcaagtgactgggcataacctttccgattaagggcagagggcaaggcagagctggcacgcctccctccacccagttctacctagatcggccccaagggaagcagcaaagaacccaggagagcagtaacttgcccgggcaccgccccgcccagcatcaggccccagaatacagaagaaactggcagaaacactatggaacgtccctgcccccgggcccgccaaccccctcactgggacaggttctcagccccagctgcgcccgggaatgatctggggagcctactaaatgcagattcctgggcagcgcgacggaactacagcatcccaacacctggggtgggccccaggaatctgcccgtttcccaagagccccaggtggttctgacgcagaggatcttgagcccacctttggaggaactcacagccactcgccccacctcatctaacacctgttgagaagccccccaaggaactcgctaagccaaggtcctcgaaggcgcgactcctagccccaagctaggccaggccgtcgccatctccgccggggatgcgcggccgagcgccacatcccgactccacacgtcggcgagccgggcgcgggtgcaggacactgctgggctccgggacggccaaggtcacccgcggggctcggcaggggctggctcggccacggggctcctcctcgaccccctttccttgagaaaacaactcccacccctcccctccccgtctcgccctgcaagacggagatggcaatttccacaaccttccctgacggaaaaacgtgcgggcgagcaggctgccattccgggcgcacaaccccgcggcacacagcggggcgcccgcccgggccccgccaccgcagcggcttcgacatccccagggccgcgctaggtctcggcagcgccctgaggggaggacgggccccgccatgccgcgccccaaccgccggccccgctttacctccagaagcccggtgcccgaggccggccgaaagcggagaggggcccgggtccggacaggcgccggcagaacaagaccctcagccccgcgcggctttgcgcgcacaacgaaaccccccaacccaccgcccaccccaccgcccagaggcttctaggacttgtagtccgcccggtcaccccccccaccacaacccgctctgagaggctggggactacggtgcccggcatgcaccgcccaggcgccgcgggcgggggcggggagggggcgccacggtccgaggtcacgccccgacctgaggagagctggcgcccagacccttcccccggggaggagggctcccgcgcgaagccgtctccgaatgcgtccagtcgactcaccgtccccgcagccctggggcagcggccgcaacagcaggaccgaacgcctcggcagctggcagtcgcacttctgtcacaaggaggcgggtagactttggaccagggccgaggcccgggacgtcacggtggggggtggggtctcgggaggcacgtgatgcgccgtgatgacgtcagtgggagcggaggcgatttggcctagagctggggctgagcacgtgggatggtcggggcctgtttgcccaatgtacacgaggctggagaatagggaaagaaccgtccctgtgagcgcctcctcttcactcatgccagcaacagggcagggcatcttcctccagggctgcattttttcttttatgcgactaatatttattgagtttgggaggtgcattacataaaaccttgaaccacacggtcactgtccctgcgcttgaaactgcctttgcaaaaattacaacagaaaattatgacagtgaaagagagctgacctaacccactccatcttgcttctaacctccaggttgtccttgttcattcctaggcataggcagaactaactttgggagcaacttagtttatagtttaatattgaaacaaagatagttaacagccctttcccaaaacaaacccccttgttgcctgagaaccaggcttcctttgtaagagtaacacgttagctacaagattagacattatagtttagggcccagctcagtggctaacgcctgtaatcccagcactttggaaggctgacgcaggtggatcacttgaggtcaggagtttgagaccagcctggccaacatggtgaaaccatgtctctatttaaaaatacaaaaattagccgggtatggtggcacgcacctgtaatcccaactactagggaggctgaagcccaaaaattgcttgaacccgagagatggaggttgcagtgagctgagattatgcctctgcactccagcctgagcaagagactgagactccatctcaaaaaaagaaagaaagaaagaaattacggtttaggagtcatgcacccagaggccacaagattctaaacctccccagttgatcctaggtataatatcactattgtaaaacctaagattggtactcttaggtgtttttctgaccctgcagtctgatgcaccagccaaggccacctagagctgtaatctgactcaaccagttcttgcatccttcaacaccctgtgatttcatctcccaccccaccaatcagcactccctactccttggcagcttatctaccaaattaccctttaaaaactctaggctctgaatttccagggagactgatttgagtaatgaaactttggtctcccattcagccagctctgtgtggattaaactctttctctattgcagttcccctgtcttgatacattggctctatctgggcagccaggaagaagaacccactgggtggctacttgctcaggtacttcctttgttacagacagtatacaaggaaaccacaaaatgcccaggactgtgaaggagaggaagggacgccctaacagagttacggggtggtgccactagacaggttggttagaaaaggcctctcagaggaggcgatgctgaggcaggggcatgaaattgaaaagacattctattctggaagggcattccagagggagggattgccttgggtgagagagtcagaaaggtgaggatgtcagtggggcaggctggatccaagtcatgttgagatttgtaggtcattttaagaactctggccaggcgtggtggctcatgcctgtaaccccagcactttgggaggccgaggcaggcagatcacttgaggtcaggagtttgagaccagcctggccaacacagtgaaaccccgtctctactaaaaatacaaaaattagcccggcatacacgcctgtaatcccagctattcgggaggctgaggcaggagaattgcttgaacctaggaggcagaggttgcagtgagccaagatcacaccactgctctccagcctgggagacagagcaaaactctctcaaaataaaataaaactctggattcttctttcttttttttttgagataggatcttgatcaggcacccaggctggagtacagtggcatgatcatagctcactgtgacaactcctaggctcaagcagtcctcctgcctcagcctcccaagtagctgggattacaggcataagccaccatacctgtctgcagtttggatttttttttttttttagatggagtctcgctctgtcaccaggctggagtgcagtggctcgatctcggctcactgcaacctccgtctcccaggttcaagcaattctcctgcctcagcctcctgaggagctaggactataggtacctgctaccacgcctggctaatttttgtatttttagtagagactgagtttcactatgttggtcaggctggtgtcgatctcctcacctcgtgatccgcccgcctctgcctcccaaagtgctgggattacaggcgtgagccaccgcgcccggcctggattttatttcaagtggaatttaaagcccttgaagagttttaagcagtagagttacagtcaatcttcattatttatggattttgtgtttgcaaatttgcctactcactaacatttatttctaatcccaaaatcaatacttgtggtgctttctcattcattcatggacataacgatcctgcacattctccactgaggtcaaataaggcaacactgggctgtcatggtggcactcgccttctatcccagccactcgggaggctgaggtgggaggatcccttcagcccagcaggtcgaggctgctgtgagctgggattgtgccactgcactccagcctgggcaacagagtgagaccctgtctctaaaaataatagggcagcgctgcctacaagtctcctttttggtctatttagtgtcatctttttctcatttatttttacgctttttattggtgattctggtgtttaaaatggcccttagtgttgtgcagaagtgctgtctagcattcctcagtgcaagaaggtggtgatttgccttatagagaaaacagctgtgctcagttagcttggtgcaggcaattgagttcaattgcactgaatcaacagtgtatattaactaagttgcctttaaacagaaacacctataaacaaggttattgattggttgacaaaaatgttgtgtccacaggctcacaggaacctaggttgttcccccagaagcagtggttcagtgtttgcttaattcagtgtttgtggccacttatatgattcgattgacatttcacaggatcatctgactacagtgtggagaatggtttagaccaagagaggcaaatagaaggctgggcgaccagcacatatgtaatccagaaatttccaggctggtccctgtggctcacacctgtaataccaacattttgggagattgagttcaagagtttgagactagcctgagcaacatagtgagtctcccatctctacaaaaaaatttataaaattaaaaaattagccagctgtggtggctcatgcccatagtcccacctactcaggaggctgaggcaggaggatcacttgagcccaggagtttgagactgcagtgagcaagaattgcgccattgcagtccagcttgagcaacagagttagactcagtctctaaaaaaataaataaataaaaatttgaaaataaaaatttcccagtaaccacattaaaagtataaaaagacacaggtgaaattaattttaataatacatttaactcaatatatgcaaaatattgtttcagtaatcaacataaaaaattatcagccaggcgcagtggctcatgcctgtaatcccagcactttgggaggccaaggtgggcagatcacctgaggtcaggagttcaagaccagcctggccaatatagtgaaaccccgtctctactaaaaatacaaaaaattagcttgacatggtggcaggcgcctgtaatcccagctactcgggaggctgaggcaggagaatagcttcaactgggaggcggaggttgcagtgaggcaagatcacaccattgcactccagcctgggcgacaagcaaaactttgtctcaaaaaaaaaaattatcaatgatatattttactcttttttcacactgtttttgaaatgcagtgtgtactttatatttacaggacatctcaatttggagcagtcacatttcaggggctcagtagccacatatggcttgtggctactgtattggacagcacagatctagaatatttattcatttactcatttgaccaagcaaggtcctgttctaggcctggaaatacacaaaatggaataaagccccatctctgtcctcaaagcgcacacagtccagcacgggagactaatataatagcttatgttcaagatgtcaaaacagagtgctttgagagttcaggagagggagtgcccgaacaaggaaggcttcagagaggaggacgtttaagttggggcttgaaggatgtgtaggattccccaggtgaaagaagtggggtagggtactccaagtagttagagctgctaatgcaaagttgcagagaaatgaaacacagagtgtgtggggaaatgcaagcagttctgtatggttgggtggtaggatatgaaagaggagggcagagggtgaggaaacatgagggccttatagaccaatctgtggaatttagactgtatcctattgggtaggtagtgggtgatgtaatgttgagaattttgggctgagtaatatgactagattcttgttttattttaattaattaattaatttatattaaaatagaaacagggtctcactaggttgccaggctggtcttgaactcctaggctcaagtgatcctctcaccttggccacccaaagtgctgcgattacaggcatgagtcaccatacctagccatgatccgtattttatttatttatctttgtttttatttttatttaaattttattttattttgggacagagattgcagtggcgcgatcttggctccctgcagcctctgcctcttggcaagcgattcttctgcctcagccatccaagtagctggaattacaggcacataccatcacaactggctaatttttgtatttttagtagagacagggtttcaccatgttggccaggctggtctcaaactcctgacttcaagtgatcctcccacctaggcctcccaaagtgctgggattacaggtgtgagccaccgcaccccgccaggattcatgttttagacaaatcattctgacagtgtggagggggtgcaaatttgaggcaggaggacccactgggaagggaaggggctctaggatggatccagaggaaggacctgtggaaactaaggaggggtcatagagggggtagggcctagggtaggcaaagggttggtcccaagtgtcccatgcagtaaaagtcaaatagaacagtcaacgtgaacattaccatgctatgtactgggtgaaaacttgctgatctctggagcccactgagtagcggagggtttgagagccagtgagaaccagaaatgtagtgagctggaactgggttcaagtcttaggacacaccacttcacggccctctccaaaatatttcatttttctggctggacgcaatggctcactcatgtaatccaagaactttgggaggccaaggcaggcagttcacttgagcacaggaatttgagaccaacctgggcaacatggcaaaacccggtatctacaaaaaatacaaaaatattagctgggtgtggtgcacgtgcctgtggtcccagctactccagagactgaggtgggaggatcgcttaagaccgggaggctggagttgcagtgagcctggtgatcacgctgctgcactccagcctgggtgacagagcctgaccctgtctgaaaaataggtatatttaatttttctgactaccaaatgagggtaaacctaatagcaatttcacggggctgttgcgaggatgggatggcttaatgcatttaggtcactgctcatagtgcctggcacacagccagccctcagaccaatggcagctggtattatttgttagcctctgagtgctctgggcctcagctccctcacctccaaaaatgaaattgtcatctcccacttgctgttgacgggaactggggactagatgagacgattgaagtgtatatgcaaacgtaaaggcggtattcctcgaaagattgaacgtagagccactatgtgacccagcagtcccactcctaggattgcacccaagataaaacacacagccgcataaaaacctatagtacacgaatatgcatagcaggtattcatatcatagcatggatgtttatattcataatagccaaaaagtcaaaacaactaacaggttctccatgaccagacattagttgggtgctcctctctaatgaccagacgttagttgggtgctcttctgaatcctctcccccgccagacctcaatttttggacttctgtatctgtctttgcgtcactcagttgtttgtttagggacagggtctgttctgtcacccaggctggagtgcagtggcgcgatgatagctcactgcagcctcaagctcctgagctcaagtgatcctcctgtctcagcctcccaagtagctgggactacaggtgcatgcaaccacaaccagctatatatattttttaatttgcttgttgcccaagctggtgtcaacttcctgagctcaagcgatccttgtggcctggcctcccaaagtgctgggattacaggcgtgagccgctgcacctagccaagccgggtttcagcaagaattctgttaaattgatttagccagaatcgcccctgcatatctgtccaaatttcacaacccccatcatcctccaggtgatatttgatcaccctgacctgccttcagcaagactcttgttagactcaatttagcaaagaattaccctcctctcctagtaactttccatccaccaacagcacccacctcccactccttggctatcaatctctattttcccttgttgtattcggagttgagcctatttctgtactgaggtctcttttcccctattgcaatagtcctgaataaaatttgtttttacagctttaattactgtccagctctggttttctttttctctttttctttcatttttttgagacagaatctcgctctgttgcccaggctggagtgcaatggcgcgatctcagctcaccacaacttccgcctcccaggttcaagcgattctcccgcctcagcctcccgagtagctgggactacaggtgcacaccaccatgcccggctaatttttgtattttcagtagagatggggtttcagcatgttggccaggctgatctcgaactcctgacctcatgatccgcccaccctggcctcccaaagtacggggattacaggaatgagccaccatgcctagcctctttccttctttctttttttttttttttgagacggagtctggctctgtcacccaggctggagtgcagtggtgtaatctcggctcactgcaagctccacctcccaggttcacgccattctcctgcctcagcctcccgagtagctgggactacaggcgcccgctaccgcgcccagctaattttttgtgtttttagtagagatggggtttcaccgtgttagccaggatggtcttgatctcctgacctcgtgatctgcctgcctcggcctcccagagtgctgcgattacaggcgggagccaccgcgcccggacttttttttttttttttttttttaagacacagggtctcactgtgttgcacaggctggagtgcagtggcggcaatcatggctcactgcagcctcgaccttccaagctcaagcgatcctcttgcctcagcctcctgaggagctaggactacaggcatgtgccattatgcccagctatttatttgttatttttgtagagacagggtctcaccgcgttgcccaggctggcctcaaactcctgggctcaagcagtcctcccatcttagttagcctcctaaagtgctgagattacaggcataagccaccacacccaacagctctggttttctttgacacaaccaaatgttcatcaactgatgaatggataaacaacgtgtgatctccatataatggaatattattcattccataaaaaggaatgaagcactgatccgtgctacaacgtggatgaaccttgagaacactctgagtgaaagaagccatccatttctctctttttttgtcttttttcctttttgtggagaatagggtctcgatatattgcctggcaggtctgtaactcctgggctcaagctatcctcctgccgctgccttcctaagagctgggattataggcatgagccaccgcccccggtgaaagaagcccttcctaagtgaaagaagccagtcacagaagaccacttattgtttttctcttctgagacagcgtctcgctctgtcgcccaggctggagtgcagtggtatgatcttggctcactggaacctcgacatcccaggttcaagcgattctcctgcctcagcctcccaagtagctggaattacaggtgtgcccaccaccacacccagctaatttttgtatttatggtagagatggggtttcaccttgttggctaggctgatcttgaactcctgacctcaagtaatccacccaccttggcctcccaaagtgctgggattacagatgtgagccactgcgcacggcccacttattgtgtgattcagtttacattaaatgtccagaataggcaaacccatagagacagaaagtcagaaaatagattagtggttacctagggcgtggggagttcaggcgaaatgggaggtgagtgctaatgggtacaggttttctcctctcctctcctctcctctttccttcctttctttctttctttctctttctttctgtctttctttctttccttccttccttccttccttgcttccttccttccttccttctttctttctttctttctttctttctttctttctttctttctttctccttccttgcttccttcctccctccctctctctctctctcattctctctttccctccctccctcccttccttccttccttgagataaggtctcccagtattgcccaggttagtccaaactcctgagctcaagctgtcttcagtcctccttcctcagcttcctgggtagctgagattacaggggtgagccactgcacccggctgagttttctttttagggtaatgaaatgttctaaaattgattgtcatggtgtttgcaactatctgcaaatatactaaaagccattgaattatacatggatggattgtatgttagatgaattatatcttaataaagctgttatcagaaaaggaggggcagggctacacaaaaagccgctccgggagaattcggacatgtgatgaaataacaaagtaaacgcaggcccggagacaggacgatgttcctcatgttcctgcctcactcgctgtcagatcaggagcccacggctgtcctgaatggcattattttcaggcttgcagaggagctgcttgtgtcaccttttcctgggcaacgttcactttctgcagaacgcagctcctcctccctggcacccaaggcgcgcctctgagactcacatcggtactgcaaagccaccacctcttatttttagtccagatttcaccataattggggcagcaggagtgctgtaggcccgggacatcttcagtgacaggtgtctttctacctcgtggcacctgctaccagaagaccattctcccaccagtgggggaacacctgctgaccttcagcagagccagcccatggggctcccaagaacttttgcgcctaaaagtatgaaaagcaggagctcagctgggcgtggtggctcattcctgtaatcccagccctctgggaggccaaggcaggtggatcacctgaggtcaggagtttgagaccagcctggccaacatggtgaaaccccatcactactaaagatacaaaaattagtcaggcgtggtggtgcatgcctataatcccagctactcgggaggctgaggcaggagaatcgcttgaacccgggaggcggaggttgcagtgagccaaggttgcaatgtcacgccattgcactccagcctgggtgacaaagtgagactctcaaaaaaaaaaaaaaagaaaagtgggagctcttccactttctctataaccagtgccatctgctggcaacacagtggcactggggatgtggtggagtcccttccttgcctttcctttcctgtcttgcagtttgcattacagagaccgaggggtgatgtttatctctcttagtttagttcttttaggccagagttaaaataagacccgagtcttatatggagaccctattaaaaaaagtgcatatgagtgttaaggttgaagaattttcacaaacctcactcactattgcaaccagcaccacatcaaaacagaacaccaggccgggcgcggtggctcacgcctgtaatcccagcactttgggaggccaaggtgggtggatcacaaggtcaggagatcaagaccatccaggctaacacgttgaaaccccgtctctactaaaaatagaaaaattagccaggcgtggtggcgggtgcctgtagtcccagctgctcgggaggctgaggcaggagaatggcgtgaacctgggaggcggagctcgcagtgagccaagatcgcgccactgcactccagcctgggcgacagagcaagactctgtctaaaaaaaaaaaaaaaaaaacaaccaaccagaataccagctgggcacagtggctcacacccgtaatcctgtaatctcagcacgttgggaggccgaggcaggtggatcatctgaggttaggaattcaaaaccagcctggccaacatagggaaaccccatctctactacaaatacaaaaattagccgggcagggttgcgggcgcctgcaatcccaactacttgggaggctgaggcaggagaatcgcttgaatctgggaggcagaggttgcagtgagccaagacctgggcaacacagagagaccctgtctcaaaaaaataaaacaaaataaaataaaaaggagcctggcatctccccactctcttgctcttctctcaccatgcaacatgccgactccccttcgccttccacaatttgaagcttcctgaggcctcaccaggagcagatgttggcgctgtgctttgtgtacagcctgcagaaccgtgagccaaaacctcttttctttatcaattacccagtctcaggtattcttttatagcaatgcaaatgaactcatgtactcactttgcctgtttctgtatcttctgttattgagctggttagagcacacagtgggtaatttttttttttttttttgagacagtttcactcttgttgcccccgctggagtgcaatggcatgatctcagctcactgcaacctctgcctctcgggctcaagcgattctcctgcctcagcctcccaagtagctaggattacaggcacccgccaccatgcccagctaatttttataattttagtagagacagggtttcatcatgttggacaggttggtctctaagtagtgacctcacgtgatccgcccatctcagcctcccacagtgctgagattacagtaatttttgtaatacaaaaccccagagcattttgaatgcagttctgcacatcagagcaaacactgactggtccaaggaggtacctctctcctcccatgttctctccttcctccttggccccctctccagcatcaagctaatgcattgttgccttgaaagcctcaaacaaaatcatgtactcattttgggagatgcagctaacgtcagtgagcactttgtgctgggtaccatgccactctcctcacctcccttcatctcaacaaggaacctgcaaatgtttacctccagctcctaaacctacgtggagggtttaaggcacaggctcagggccacacaacgcatgcccagcagaccccaggtcttgtggttctagcctcatggtgctgctcactgcccaagctgctctcctggcatgggtgtgagtcagcacacactgaggtgagagaagaagctgttatattcaggccagatttttttttgcaaaaatctttctttacacgcagcaagaactgggaaggagcccactggagctgagccagcaaaacccaaatggaatccacgttgttggcctcttaatttgtttgaatcattgcagattcccagaactttgatacagaaaagtgctcagggtcgggcgcggtggctcacgcctataatcccaggactttgggaggctgaggccagaggaccgcttgaggccaggagtttgaggccagcctggccaacatggtgagacccatctccgcaataataaaaataatcagccaggagaggtgttgcacacctatggttttagctactcggagggtgaggcagaaggattgctggaacccaggtgtttgaggctgcgtgagctgcgatcgcaccactgcactccagcctgggtgacagtgagaccctatctcaaaaaaaagaagtgcccatattagaagcgaatggcttgatgaattttcccaaactggccacaccagcgtgcccactcccctacagctcagcttcatgcttccttccaagcatgaggtcacccaaggataaccactcgcctcacctccaacacctaagatttgtttactccatttcgggacttttgtttgtttgtttgtttttgagacggagtcttgctctgtcgcccaggctggagtgcagtggcttgatcttggctcactgcacgctccgcctcccaggttcacgccattctcttgcctcagcctccccagtagctgggactacaggcacccgccaccatgcctggctgattttttgtatttttttagtagagatggggtttcaccatgttagccaggatgtctccatctcctgacctcgtgatctgcccacctcggcctcccaaagtgctcagattataggcttgagccaccgcgcctggccatttgtttctttttaaattctgggatacatgtgctgaatgtgcaggtttgttacataggtgtccatgtgccatggtggtttgctgcacctatcaacccatcatctaggttttaagccctgcctgcatttggtatttgtcctgatgctctccctccccttgcttcccccaccccacgacaggccccggtgtgtgacattcccctccctgtgtccatgtgttctcattgttcacctcccacttatgagtgagaatatgcggtgtttggttttcttttcctgtgttagtttgctgaggatgatagtttacagcttcatccacgtccttgcaaaggacatgaactcatccttttttatggctgcagtttggggactttttatagcaatggtttcatacagcatgaacccttttatgtatgtaattccgctcaattttatatcaatgaaagttggccgggcgcggtggctcacgcctgtaatcccagcactttgggaggccaaggcaggcagatcacctgaggtcaggagctcgagaccagcctgggcaacgtggtgaaaccccatctctactaaaaatacaaaaattagcctggcatggtagcatgtgcctgtcatgccagctacttgggaggctgaggcaggagagtcgcttgaacccaggagatggaggttgcggtgagccgagatcgcgccattgcactccagcctgggcgacagtgttagactctgtctcaaaaaaaaaaaaaaaaaaaagaaacgaaaagaaaagaaattcatcccactattacatgtagttgtctttgttcattctcactgctgtgttatagtctactgtttgaatatgcgatagttggatgggaatttttagctactatgagtagtgctgtcacaaacatccttgtgcatggtgtatgtcaattcctggtgggttccggtcgagggctggactggctgggtcacagtgtgtgcaatttttcagcattgcagaccctgccaaacagttttccaaagtctgctaatttctgctctgtcagagcagatgagagatctgttgttcatatgcttgccaatgcttggtgttgccagaacttcacatttaaatgctaaattattctaaaagaaacatgaatggttacagtgttaacatttattttataatatttctatcattaatatggccccatgagagttgacagctccttcggagctatcatccatttagcaaacacttactgagcacctactgtgtgcagggatctgtgttctgatactagaaagacagagaagaaagagaaggtctctattctgaaagagcttcaggaatgccctctcttcaggtctcagctcagatgtcacctccccagaggagcctccttgggttacctttgcccagctgttatctcattgtctgcctccacgcctggctgaagagccaggttttgtggatggactggtaatgacctctgcagaagcatctgttgtgaagtaggaacatgggattgattcacaagcagcatccctgaaaatatcccactgttcaattcagaaggcgttttcctggactcttgctcccacagttctaaccattggcaagagtggctgccagatcagttctggtcaaggagcgatttgtattttgttttatttgagatggggtctcactctcttgcccaggctggagtgcaggggtgtgattctggctcactgcagcctcgagtagctgggattacaggcacacaccaccatgcccagctaattttggtatattttttagagatggggtttcaccgtgttgtgcaggctggtctcacgctctactcctgggctcaagcgatctgcctgcctcagcctcttgagtagctgggattacaggtgtgagccactacgctcagctaattttttattttgtagagatggtgtcttgctatgttgctcaggctgctctccaactcctggattcaagcaacccgcccactttggcctcccaaagtgctgggattacaggcatgagccacagcgcctgactgcaagaaacgttttccatcagcactggcctggcatgttacatatgttatttctagccgccatgttttatttccccatttagcagagagggaagctgaggctcagagaggttaagtcacttgctcaagattccacagctggtgcaaggatttgcctccccacctgcatgaactcaatgtggaatccctcagcagggctcctgctgtgtggcgcgggaccaggaatgtgggatcacagtgctggctgggttgggagtcagggctcccggtgttaagccgagagtgtccctgcagactttcccaggagacaagcaggctgggattctcttgtcccagaactgaccaagcagagcctgaccatacctcatatctccacgcagcctcctggtcctgtggcagctggctcttggccatgtccttatgatgtcagagcagggctgagaccctgtttgagagcacaggggttgtgaagagcccagctcaagcggggagcagagcagggtctggtgagggcaccgtcacttgggtgggcagggacatgcagggcctagaaaggacaacgccctttttttctttttctttttctttttttttttgagacagagtcttgctctgtcgcccaggctggagtgcagtggtgcggtctcggttcactgcaagctccgcctcccagattcaaacgattcttctgcctcagcctcccgagtagttgggattacaggcacccgccaccatgcctggctaattttttgtatattttttgaagtagagacggggtttcacactgttagccaagatggtctcaatcttctgacctcgtgatctgcccgcctcggcctcccaaagtgtggaattacaggcgtgagccaccgcacccagcctatcgcccttctttgtttgagacggagtcttgctctgtcaccaggctggagtgcaatggcacaatcttggctcactgcaacctctgcctcccgggttcaagtgattctcctgcctcagcctcccgagtagctgactacaggcacgcaccaccatgcccagctaatttttgtttcatcatgttggccaggatggtctccatctcttaacctcatgatctgcccacctcagcctcccaaagtgctgggattacaggcgtgagccaccgcgcccagccgacaatgcccttcttaccacctgggctctccttcccagaaaatggaacacttggccaggtgtggtggctcacacctgtaatcccagcgctttgggaggctgaggcaagcagatcacctgaggtcgggagtttgagaccagcctggccaacatggtgaaaccccatctccactaaaaatataaaaattagctgggcgtggtggcaggcgcctgtgatcccagctactcaggaggctgaggcaggagaatcgcttgaacccaggaggcggaggttgcagtgagcggagatcgcgccactgcactcctgcctgggtaacagagaaagactttgtcacacacactacacacacacacacacacacacacacacacacacacacacacgagaaaatggaacactgtggggggcctttggatgcgtccagaaatgaatgtagttcttcagattcttttttttttcttttgagacggagtctcgctctgtcgcccaggctggagtgcagtggcacgatcttggctcactgaaacctccacctcccggatttaagcaattctctgcctcagcctccagagtagctgggattacaggcacgtgccaccacgcctggctgatttttgtatttttagtagaggcggagtttcaccgtcttggccaggctagtcttgaattcctgaccccgtggtccacccgccttggcctcccagagtgctgggattacatatgtcagccactgtgcccggccttttctcttttctttttcttttcttttctttttttttttttttttgaggcaaggtctcactctgttgcccaggctaagtgcagtggcacaatcatagctcactgtagcctcaaactcctggcttcaagcaatcctcccaccccatcctcctgagtagctgggactacagatgtgcgccagcacatccagctaattacaaatttttttttgtagaaacagggtctcactatgttgcccaggctgctctcgaactcctggcttcaagcagtcctcccgcctttgcctccccaaagtgctgggattacaggcctgaacccccacacccacccagccagtacttcagattcttatctctttgtaaaacctgggtcttcctaactccaagaaacctgtcttctgcccggattcgagaaaattccaaggagggagctgcctctccatcccttccatatgtgcttctaggaaaaagttaccagtctcacatcaccagagggcttgaatgaagaggctgccatcagctattcaaacattcatccaatattaactgagcacctactctgggtgaggcttaccagggagcacctgccccactccagactttgaattgcgcccgtttcatcacattctttggtgtcctggcaaccagagactctgatctgagctccagccagaacagaggccattcctccctgactgctgtgactcaccaccaccccaggcctctgaggaccagtccatgtagctctcggaaccactgaaagctaccccttgtccttgaggacacctggaaccccagccccactgacccaccctggcaggatgagcttctcactcacgttcaccgagctggccaacatcgccatcccacagtgcggggtgctgaacttcaaggccctgcacctcctgctgcacggcatcttggagcacatccacatggccgagctcaagaaagtcctctcaggcgatgaggacttcctgcagacctcgcaggtggtcatcatgcccagggaaggagacgcccagcctatcctcaaccccatgaagaggctcagcaatgtcttcgaccacgtggtgagccgcctcgacaagttggagaaccagctggccctgctgcaggacctgccctccactgcccagctgctggaagccagccagggcactgcccggcccgtccaggacctgtggcatctgatcaagctccggaagatggtggagggtcatgatgaagtcatggccaaggtacgcccccagcctccagacacttcttttcctcccttcaccactggctctctcctgggacgtcttttttttgtttttgagactccgtctcgctctgtcacccaggctggagtgcagtggtgtgatcttggctcactgcaacctccgcctcccgggttcaagtgattctcctgcctcagcctccctagtagctaggatttcaggcacatgccaccacacccggctaatttttgtatttttagtagagatggggtttcactatgttggccaggctggtctcaaacccctgatctcaactgatccacctgcctcggcttcctaaagtgctgggatgacaagcgtgagccactgcgcccagccttctcctgggacatcttgttgcttactcacctacgatgggccatctccttatgcagagtgggaagaagggtgctttagagtcaggcacaaccaaaacgccaagcttgcagcctccatcaagtattgcaaagaagccagacacaaaaggctacccagtgtatgattccatttatacgaaatgtccagaataggtaaatccatggagacagaaagcagtggttgccaggggcttggaggaggagagaatggggagtaattgctttgtggatatagggtttccttttggggtgatgaaaatgttttggaactagatggaggtggtagttatacaacctcactgatgtactaaatgacactgaattgttcacttaaaaatggctaattgtacattatgtgaatttcaccccaatttttttttgagacagggtgtcactctgtcatccaggctggagtgcagtgactcagtcatggctcactgtagcctcgacctcccagactcaagcaatcctcccacctcaacctcccgagtaactgggaccacaggtgtgcaccactgcacctggctaatttttgtattgtttgtagagatagggtctccttatgttgcccaggctggactcaaactcctaggctcaagtgatcctcctgctttggcctcccaaagtgctgggattagaagcgtgagctactgtgctcagccttaccccaatttctaaaaaatgcctggaggagctaccatgggagaagtaccagagtagtcacggtgaacaggcacgcccggcctagcaggggagatagacacaagtgagtgagaatctccaagaaccagccctgtgaggagcagcaaagaggcattccttctgccttacagaagaggaaactgacgctcagaggagctcagtgattggctgaaggcccagcagctggtgggcaagggagctgcgcgctgaggcgtggcctctgaccctggctcacctttgactgctgacccctgctaaccccgaccagcacgtggacagtgttcagttactggcagcccaagaagaaataagaaagggaaaataagccgagcacagtggctcacacctataatcccaacactgggaggccaaggcgggatgatcacttgagcccaggagttcaagaccagccttggcagcgtagtgagacctcatctctataaaaaaatgaataaattagccgggtgtggtggcgtccacctgtagtcttacctcaggaggctgaggtgggagaatcacttaaccccaggagttggaagctgcagtgagttgtagtcactctcctgaactccagcctgggggacagagcaagcccctgtgtctaaaaatagtaataataatttggccaggcacagtggcgcacacctgtaatcccagcatttcgggaggccaaggtgggtggatcacctgaggtgaggagttcgagacaatcctggccaacatggtgaaaccctgtctctactaaaaatacaaaaattagctgggcatgcttgcgtgcgcctgtagtcccagctactcgggaggctgaggcaggagaatcgcttgaacccaggaggcggaacttgcagtgagccgagatcgcaccactgcattccagcctggtgacagagcgagactctgtctcaaaaaaaaaaaaaaaaaaaaaattagccaggtgtggtagcaggcacctgtaatcccagctactcgggaggctgaggcaggagaatcacttgagcctggaaggcaggtgttgcagtgagttgagatcgcaccactgcccttcagcctgggtgacggagaaagtcttgtctccaaaaaggagaccatccagcgatgactgccttcctatccctggaggcagcatgtcctagtcctctctgagccagaactgtgcccgttggtgtgtccagctggatctccctgggagtcagggccattttcagagcgttcccaagttaccactcttctctttcaaattgaggggaaactggctggatgtggtggctcacacctgtaatcccagcactttgggaggccgaggcaggtgggtcacttgaggtcaggagttcgtgaccagcctggccaacatcatgaaaacccgtctctactaaaaataaaaataaaaaaaaattagccaggcatggtggcgcatgcctggaatcccagctactcaggaggctgaggcacgagaatcgcttgaaccctggaggtggaggttctagtgggcggagattgcgccactgcactccagcctgggcaacagagcaagactccatctcaaaaaaaaaaaattaaaaataaataaataaattgaggggaaattgacctaacataaaatcaaccatttaaaagtggacattaaacactgaattaatgaaaattcggtggcacacgatatattgacattgttgtgcagccagccacctctatctagttctaagccatttccatcaccctgaaaggaaaaaaccctatttcccctttacttctcctccctgcaacccctgacaaccactaatctgctttctgtcttacggatttgcctattctggacatttcatctaaaggcataatctgtgtatttcatagagacagaaagtagattagtggtttccagaggctcaggaaggggggaacagagagagactgtaacagggacgggatttccttttaggagaatgaagtgtcttggaagtagatagtggtgtacataccaaatgccctcaaattgcacacttcatttttattttatttttatttttttgagacagagtctcactctgtcatccaggctggagtggactggtgcaatctctgctcactgcaacctctgcctccaaggttcaagtgactctcgtgcttcagcctcctgagtagctggaaatacaggtgcgcgccaccatgcctggctaatttttctttgcatttttatatatatgtttgtttttgagatggagtctcactctgttgcccaggctggagtgcagtggtgtggtctcagctcactgcaacctctgcctcccaggttcaagcagttcttctgcctcagcctcccaagtagctgggactgtaggtgcccgccaccacacccagctaatttttgtatttttagtagagacgcggtttcaccatgttggccaggatgatcttgatctcctgacctcgtgatccacccgccttggcctcccaaagtgctgagattacaggcatgagccactaagcccggccaatactaaaatatttttatactttaatattatgggtattttaccacaaaaaaaagcagagattggcagaatagataaaaaacaaacaaacacacaaaaaaaaaacatgacctaactactatatgaggtttgcaagagacacatttaagattcaaagacacaaatagggccaggcacagtggcatgcacctgtaatctcagctctttgggaggctgaggcaagaggatcacttgagcccaggagttggtgattgcagtgagctctgatggccccactgcactccagcctgggtgacagagtgagatcctgtctctacgaaaaaaagacaagacacaaatacgttaaaagtaaaatgatataaaaagatattccagcggggcacagtggctcacccctataatcccaacactttgggaggctgaggtgggtggatcacctgaggtcaggaattcaagaccagcctgaccaacatggagaaacccgtctctactaaaaatacaaaattagtcggatgtgatggcacatgcctgtaatcccagctacttgggaggctgagaacggcttgaacctgggaggtggaggttgtggtgagccgagattgcgccattgcactccagcctgggcaacaagagctgaaactccgtcaaaaaaaaaaaattagcctggcgtggtggcgggagcctgttaatcccagctactggggaggctgaggcaggagagtcacttgaacccaggaggcagaatttgcagtgagccaagatcgcgccaccacactccagcctgggtgacaaaagcgaaactccatctcaaaaaaattaaaaaataacaaaagatattccttgcaagcagtgaccagaggagagtgggatcttctcagacaagatagacttcaagacaaaaattgttactagagacagggctgcctggggtggctgagggcaagttatgagggccttgcaggcaggatgggcagataccaggatccaaggtgccggcactccagaggcagcttgccccctggcctgccttgatggatgaaggcttctaaaaagcagctcaacagggcaacccacccagctcacaaaaggggctcgtggacaggttcagacctagctgtacagccttcaggactgtttgtgcagctaaggaatgtccccatcattagagaatcttgccttgtcccagcctgattgaagttgcccgaggttcccacaatgacccattgaagggggttgccatggcagctggttctagaatgatgcaaactgcacagctaactgtctgcacccaccaactagtgaggctgccggggggtcgcctggcaaacaaacgtgttttacaatgttcctttcgcgagtcccagtctgcctccttcaggcctcggtttttctcccctgtaataataacctcttgcagctggcctcacaggcgaaaacaagggatgatgtcagctgtttgttgttgaaactgtttcgtctaaccctgtttccataacattgtgggtccaaggcttagggtatttttttaaattgtagaaaacctttaacttattggtctttttgagggaatgagatgcatcgccactgcattacaactaagccattaatcctgtagcttcatcaacattaactggttcactttcatgatgccaatggggaatcagttctttctacagatgttcaagagaaaagattgccaggtgtggtggctcatgcctgtaatccccgcactttgagaggctgaggtgggaggatcgcttgagcccaggagttcaagaccagcctgagcaacatggcgagactccctttctaccaaaaaattttgaaattggctgggcatggtggtgcacctgtagtcccaggtactcaggaggctgaggcaggattgcttgagcctgggaggtcgaggctgcagtgagctattattaatattacagcctggacaatggagcaagactgtgtcaaaaaaaaaaaaaagagaaaagccttttgagaagagtgcaagttcttttatatatttacaaaacctttattcactcaatttttttgtttgtctttattttttaagattgtattacttgattttattttacactaggtggtgggcacacaaagcaatccttaataaagttgacaattagcttcattcaacatttttaataatgcacatataaaaaaagtattcatcttacaaattcttctgcaatccaaacatataatagcttggagaacatttagaaaacaaaagccaatgtaaaaagacagattaaaacaactagaacagtacaggttttatttatatggctcgaattttacaggtttcttactgtatcatcagtgtcagaaatctgttctgtcagctggctccattgttctggatttaaagaaataccttttcttcctggtttcatttcaccttcaggatccatccaatattctccaatatcaattagcactttgcctttaaaatcttgaacgccaacgtacctcattttcccaatctgaaacatgttaccatctctgctgctgctcctctgtcagaagatgacagagctctccaagtttcgcctgtcttttgcttctttacaggtttttctggagcaacttgctttttcctctttaagtttttgtcaacctcactgtcagaatcactgccagaagagtttgaagaaacaagttcctttgctttaggcatcgcttcgctcggctctagcagtggaacaccctcttgctcgttcgctcatgactgactcgtttgtttttatttttaaggcagggtctcactctgtcgcccaggctggggtgcagtggctcgatctcagctcactgcagcctcaacctcccgggctcaaccctggaggcaatcctcccacctcaacctcctgagtaggtaggactacaggcctgtgccaccacactggctaatttgtattttttgtagagacagggtgttgccatgttccccaggctggtctcgaactcttgagctcaagtaatcctcccacttcagcccaaagtgctgggattacaggcttgagccactgcgcccaccctctgttaaccttttttttgtttgtttgtttgttttgagacggagtctcgctctgttgcccaggctggtgggcagcagcatgatcttggcttactgcagcctctgcctcctgggttcaagcgattctcctgcttcagcttcctgagtaactgggattacaagcgtgcaccaccatgcccagctaattttcgtatttttagtagagacggggtttcaccatgttggccaggctggtcttgaactcccgagctcaggtgatccacccgcctgggcctcccaatgtgctgggattacaggcatgagccactgtgcccggcctctgttgacttttaaatcataacatttgtcttaagactagtggtaactgccaggtgtggtggctcccacctgtaatcccagcactttcggaggccgaagtgggcggatcacctgagctcaggagttcaagaccagcctggccaacatggtgaaatcccgtctctactaaaaatacaaaaattagctgctagtcgggaggctgagacaagagaattgcttgaacctgggaggcagaggttgcagtgagccgagattgcgccactgcactccagcctgggagacaaaatgaaactccatcttaaaaaaaagaagaagaaaagattagtggtaactggttttgctttgtttttagccttaaagtgtttttggctggctttgtgaagtccattcgtggacttctgccctcctaatttgttcttggccattgtcagacttggttggatatgtgcacgcagcttctgcagctcaggtgatgccatctgcatgcactgggtccaggaagtccccgggagagggatccagtctaaggggatgctaacaacctattgttgctttctttatttctaaacaccctccccattttactccctcagaaactacaaagcacctgctgtatattgtacaggttaaaatgatgtcacatttaaattggatttttaaggctgggcgtggtggtttacgcctatgatcccagcactttgggaggctgaggcagaaggatcacctgagctcaggagttccaggccagcctggccgatgtggcaaaaccttgtctttactaaaaatacaaaaattagctgggcatggtggtgcgtgcctgtagtcccagccactcgagaggctgaggcacgagaatcgcttgaacccgagaggtggagatttcagtgaaccgagatcgcgccgctgcactccagcctgagcgacagagcaaaactccatctcaaaaacaataaataaaatacaaataaaaattgggtttttaactattttgtaacattgcttaaaggtgtggaagacactttggggtgttagaggaccaaggttgccatgattgcagtaatggtaacgaacactcagatgtcattggtgtcaccttcacagtgtcgtgaagtgctcttacattcctcgtttccgtggagggaaatgttagcattcctgttttccaaagtcccacatgtgaccgtgtggacaagtctagctgcttgtctgagggggtgtttgccttagcccctttttcaggcctcttaaggcctttgtaagtactgggccctagctgaaccccagcatccttaaagccctcttgagagagagagagagcaggtttggacaagccctgcctcgaggactatggcatgggtcagcttctggaagggcaactgtcggggacgcactttcccttgaactcagcaccatccaagccctgaatgtggcccagtcaccctgggcagaaaaaagacctcagccactttccccacagctctctctcctgccccttcttccccaggacaggagtccagagcatgtcccctacatgtgagacagcaggtgggtcttgggtgagaaacctctcactgcatatcacacagagggggaggttgtagtaagctgagatggcaccactgcaatctccacgcaagatgcagggagtctggctctggcgcccaggctggagtgcagtggcacagtctcagctcactgcaacctccacctcctgggttcaagtgattcttgtgcctcagcctcccgagtagctgggattacagctgcccaccaccacacccggctaatttttgtatttttcgtagagacggggttttaccatgttggccaggctgatctcgaactcctgacctcaggtgatctgcccactttgtcctcccgaggtgctgggattacagacatcagccaccacacccagcctcgtttctaccttttgactgttatgaatatgctgctataagcattcatgtacaaacttctgttttgtttttagggacaaggtcttgctctgttgccctggctgaagttcagtggtgccaccatagctcactgcagcctcaaactcctggtctcaagcgatcctcccatctctgcctcccaagtttctgggactacaggcgcttgccaccatgcctggctaatttttaagttttatgtagagatgtggtcttgctgtgttaacagcccacgctggtcttgaactcctgacctcaagcactcttccaccttggcctccgaaagcagtcggattacagacgtgagctaccatgcctggcccatgtgtgcaagtttttatatggacctatgttttcatttcttttgggaatatacctaggattagaatcagagatcatctggtatctctataatcttgtgaggaactgccacactgacttctaaaatggctgcacaatttacattcccagcagcagtgtatgagaattacgatttctccttatggttaacagcacttagtatctgactttcgcttctgaccatcctacagagtttgaagtggtatctcattgtagttttgattttcatttccctgatgacgaatgatgttgagcatcttttctttttatgtgcttattggccatttacacatcatctttggagaaatgtctattcagatctttgcccatttttaattgggttatttgtatcattgagttgtaagagttctgtatatattctgcatatactgggtcagatatatgatttgcaaaatgaggttttctcccattttgtgggttgtattttcattttcttgctggtgtcttttgaagcacaaaaggtactttttattatgactttaatctcttcacttgttttaggtttactcggattgtctatttctgcttgagtcagttttaatgattttctaggaatttgtccatttcacctaaattatataatttgtccacaggcaattattcatagtatttctttataatcctttttatttctgtagagttgatagaatgccctctctttcatttctgattctaataatttgagtctgattcttggccaatctagctaaaagtttgtcaattttgttgaccttttcaattaaccagtgtttagtttcattgatttttctgtactatttttttatcctctatttcattaatttcaccatattctttgttattttcttatttctatttgttttaggttcagtttgcttttctttgttccagtgtcttaaggtggaaggttaagttattgattcaagatctttctttgttaatatagtcacttacaacaataagtgttctaagtgtctaatcaccactttagctgcatcccgtaagttctggtgtgttgtgctttcattttaactcatttcaaattagtttctaatttctatttctattgtgatttcttctttgacatatttcttttctttttttttttttttttttttgagatggagtctcgctctgtcacccaggctggagtgcaatggcgcgatcttggctcactgcaagctcagactcctgggttcacgccattctcctgcctcagcctcccaagtagctgggactacacgtgcccgccaccacgcccggctaatttttttttgtatgtttagtagagacggggtttcaccgtgttagccaggatggttttgatctgacctcatcatccgcccacctcggcctcccaaagtgctgggattacaggtgtgagccaccgcgcccggccttctttgacatattccttttgtgatttcttctttgacatatttgtcatttagtagaatgttttttaaatttttacatgtttgtgaattttcaatagtttcttctgttgcctttttttttttttttttttttttttgagatgaagtcttcctctgtcaccaggatggagtgcaatggcatgaccttggctcactacaacctctgctcctgggttcaagcagttctcctgcctcagcctcccgagtagctgggactacaggcacgcaccaccacacccagctaatttttgtatttttagtagagatggggtttcaccatgttggccaggatggtctcgatctcctgacttcatgatctgcctgctgtagcctctcaaagtgctgggattacagatgtgagccaccacgtccggcctgtttttgttttttgtttgtttgtttgttttaagccctgtctatgggagccattggcaatccaagaacttttttattttatttttgaattatagagacgggagctcactatgttgcccaggctggtctggaactcctgagctcaaatgatactcctgcctcaagctcccaaagtgctgaattacaggcatgagccaccatacctggcctcttctgttgctttctaatttaattccattgtggtcagagtatgtattttgcataatttcagtccttttgaaatttgttaaggcttgttttatggctttaccatatggtctaccctggagagtattctatgtgcatttgagaataatatgtattctaccattgttgagtggggtattccgtagatatctgttatgtctagttggtttatactattgttcaaatcttctcttttcttgctggccttttgttttgttaattttatttattttatagtgacagggtctcccttggttgcccaggctgctctggaacccctgggctcaagccatccttccactgcagctacccaaaatgctgggattacaggtgtaagccactgaacccagcctcttgctcttctttttttctttttcttttctttttaatttttttttttttttttgagacagagtctcactctgtcacccaagctggagggcagtagtgcaatcacagctcacttcagcctcaacctcctgggctaggaagatcctcccatctcatcctcccagggacctgggactacaggcatgcaccaccacgcctgtctaattttggtatttttttgtagagatgggagaccgctatgttgcccaggctggtttcgaactcctgggctcaagtgatccacctgcttcagccccccaaaatgctgggattacagatgtgagccactgcacccaggatactgttctttttatctcgggttttgttttttcgagatggagtcttactccatcttgtgtgacttactcagatggagtcacacaggctggagagcagtggcataatcttggcttgctgcaacctctgcctccggggttcaagtgatcctctcacctctgcctcccaagtagctgggattacaggcaaacactaccacgcctggctaatttttatatttttggtagagatggggtttcaccatgttggccaggctggtctcaaactcctgaacttcagatccactggcctcagcctcccaaagtgctgggattacaggtgtgagccaccatgctggaccttccttatcttagttattctattcattactgaaaataggaaattgaagtctcaaactattcttgttaattaactatttctccttttgtaactgagtacccccatttttctaaaagatagtttattttaaaaattattttctcttcctttctccttccccactgctccccacttcctacttagccctttagaaatgcaaagagaggcctggtgagttggctcatgcctgtaatcccagcactctgggaggccgaggtgggtggatcacttgaggtcaggagtttgagatcagcctggccaacatggtgaaaccccattagcagggcgtggtggtgtgcccctgtagtctcagctacttgggaggctgaggtgggagaatcacttgaacccgggaggtgaaggttgcctaggtgacagagtgagactctgtctcaaaaaaaaaaaaaaagaaggcaaagatagtctttgacccctccttcaccagtcactccctacagggcaagttcatgtaactcctggagagttaagaaacagacttagagaccaaagcacgccccttataggactttcacctgggaacttccactctccagggattgcctgagagctcagtctcaccaggaggacatgttgaaagcgtgcccatggccacttttacaacttacttcttcccaggaaggtgccaactcagctgcccagtagataagacatcacgctcaaaaggagacccctgcccttgctggctgtatcccctacgtcttaaaagtgcccactttttctccagaagtgaagcggcacgtttaaagccagggcgctttgtgccccttccccaagctagaacttttttattttatttttgaattacggagacgggatctcactatgttgcccaggctggtctggaactcctgagctcaaatgatactcctgcctcaagctcccaaagtgctgataattcggaataaattcactttctttttggtaccagaccttgctcatggtaactgaaccctgcaatgcagcgagcaaccaacgtgcttttcagttacactttcagttctgtcagtgtttccttcatgtattttataaagggctctgttaagtgcatgtatgtttataattattatatcttccagatagtttggccctctgagtggaaaaaaactcagtttctttcacactgttctcacaacacgcttttttttttttttttttttagatagagactcacttcgttgtccagtctggagtgcagtggtgcgatcttggctcactgcagcctctgcctcccaggttcaagtgattctcctgccccatcctcctgagtagctgggattacaggcacgcaacatcaggaactgctaagtttttttgtatttttagtagaaacagggtttcaccgtgttggccagactgttatcgaactcctggcctcatgttctgcctgacttggtctcccaaagtgctgggattataggcatgagccaccgcgccaagctcgcaacacacttctgacaccagatgtgtgaggatttctccctacagcaagcaataatttctgcaggcagcctgcttccccttttgccctccagagccaggctccacaggagcccgagagatcctttaaaatgtaaatacagaccgggtgctgtggcactttgggaggatgacgcgggcagattgcttgagctcaggaattcgagaccagcctgagcaacgtggtgaaaccccatctctaccaaacaaaaacaaaaacaaaaacaaaaaaaattagctgggcgtggtgatgcacacctgcggtctcagctacttgggaggttgaggcaggagaatcacttgagcccaggaggtggaggttacagtgagttgagatcgcgccactgcactccagcctgagccacagagtgagactccatcttagaaacaaaaagtaaatgcaaccctgtctctcctgctcctgatcctccagtggctcctacccagggatgggctgtgcttcctccctggctgacatctatcatagaagaaagggcgtgagatgcttcatgacgagtaactcctggtttctggatatattcaaatacagagttgcctccttctcatccaggccacttggagatgagagcactgttgactttagtagcatctcctggtccccttgtaggttccagtctaggccttgggagagccaagaggacctcttgaacaacggctatcatcagaaagcttctgcacttcacttaccttctcccccagccatacccggcttcacattttctcctcctcttttgcagtcaatgcagaccctgcaggacttgctcactgatcttcatgcactccaggtcaccatcacagccctcagaaaagaagtggacatgctgaagaacatgcttgacaaggtaggccctcccccagcatcctccatgccagctgcgttgctcaggcctctgggggttggagcaatgaggaaaatctaggaagcttactgttaggccaagagtgcagctgtgagggtgtggtcatgtggaccctccaattggccagtgccaccgacttctctgtgacccctccatgctttcttttcttttcttttttttttttaagacagagtctcactctgttgcccaggatggagtgcaatggcatgatcttggctcacggcaacctctgcctcccgggttcaagtgattctcctgcctgagcttcccgagtagctgggattacaggcacgcaccaccacatctgggtaatttttgtatttttagtagagacaggggttcatcttgttggccaggctggtctcgaacttctgacctcgtgatccacccacctcagcctcccaaagtgctgggattacaggtgtaagccaccatacctggccgacccctccatgctttctaccccagtgtgttaaaacgttagttgtaagtgacagaaatcacgttcatcctggattaggcaaaataagggatttattgtctcatttactaaaaggtccagggacggccagatctaggtactcatgcaatacttatatttctttttttttttgagatggagtctcgctctgttgcccaggctggagtgtagtggctcgatcttgactcactgcaacctccacctcccgggttcacgccattctcctgtctcagcctcccgagtagctgggactacaggcgcccgcccccatgcccggctaattttttttgtatttttagtagagatggggtttcaccatgttagccaggatggtctcaatctcctgacctcttgatccgcccgcctcagcctcccaaagtgccaggattacaggcgtgagccaccacatccggcaatactgacgtttctcagtgaaactttcctcccagttggcttcattctcaggcaggtgctcctcaagtcttggcaacagcagacttatattccaccaacctagcaaaaagaaaacctcttccccttctggaaagctctgtccacatggaaagtggaataatcataatagtgcaggcatacatacaagctccttctgtacttctgtagccaaaaaccatcagccaagtattttctaacaccctaccatgcatggaaggacatggagtccccgagacatgaggcagctgtccccgtcacaactgatgagtcacagctggggtctgaagccagctctccacacccccaggtttaacaacttcccccaaatagtgtaattttctgtatcatcccggcttcacagatcagggcctgtatttgatcatcatggcaactgtgggagctttaggcatgggctggatggctcccatctaagcagaaagaacgctgttaaaagctgcatcatgagctactcaaaagggccccttagacaaagctgttggagaaaccatgccttctcggcggggcctggtgtctcacgcctgtaatcccagcactttgggaagccaaagcaggcggatcacctgaggtcaggagttcgagaccagcctggccaacatggtaaaacccccgtctccactaaaaatacaaaaattagctgggtgtggttgcaggcacccgtaaccccagctactcaggaggctgaggcacgagaatcacttgaacccaggaggtggagattgtagtgagccaagattgcgccactgcactccagcctgggtgacagagcaagactccgtctcaaaaaaaaaaaaaaaaaaaaggtggggtcggtggggcggcatggtggttcacgcctgtaatctcagcattttgggaggctgaggtgggcagatcacaaggtcaggagatcgagaccatcctcgctaacacggtgaaaccccatctctactaaaaatacaaaaaattagctggatgtggtggcaggtacctgtagtcccagttactcaggaggctgaggcaggagaatggtgtgaacctgggaagtggagcttgcagtgagccgagatcacaccactgcactccagcctgggcaacagagtgagactctgtctcaaaaaaaaaaaaaaaagaaaaaagaaaagaaaaacaatgccttattggcctgtctcttggaggtgtttttgttgttgttgttttgttttgtattctttttgagacggagtctctctctgtcacccaggctggagtgcagtggcacgatctcagctcactgcaacctctgcctcccgggttcaagtgattttcctgcctcagcctcctgagtagctgggattacaggtgcaagccaccacgcctagctaatttttgtgtttttagtggaggtgggggcttcaccacattggtcaggctggtcccgaactcctgaactcatgatccacccgcctcagcatcccaaagtgctgggattacaggcatgagccactgtgcccggccctcttggagattcttaatgtgcttttgctcattcaaggctctgggaagtcctgccgtacagaaacctgttgaaatgttttttatttatttatttatttacttatttttgagacaaagtctcactctgttgcccaggctggagtgcagtggcgccatctcagctcactgcaacctctgcctcctggattcaagtgattctcctgcctcagcttcctgatagctgggattacaggcgcatgccatcaggcccagctaatttttgtatttttagtagagacggtgtttcaccatgttggccaggctgctgtcgaactcctgacctcaagttatccacccaccttgacctctcaaagtgctggggttacaggcatgagacactgtgcccggcctgacatgctttcaagcccagcatttcccaaacttgtttgcccatggaaccctttcccactccttgggaaacactggatttggaacccgttcttccttctcaagctcttagtcacctagagccacgggaaaaggcaggggtgggacagaacctggacccccagtccacagactcagttcctttgacaggtacacccagaaagaatggacatctttgctgaagacttcaaaatacagaactggaagatggttgcactgcagcgggaagtggtgagggccaccatccctgtcttcccccactccccctgggaccccccaacctcccgggtcctgggtgctgagggtagggaggtgcaaggaggagaacacagcctggaaaggtttctttgcaggtgtgggggacactgccccctccaggctcacagccctcattttctacccccaccttgcaggcttctctccagaataagtttaaaaccatccccaaaaccgaggacatggtgctctggagtggccttcatgatgccatgttcacctcagtgagtgaggaaggaaggggaggttagcaggaagctggggagcaggcgggtggctgactgagagtgggaggcggggctggaagccagcagagcccctctgccccctcttctgcaggaaattggttcatcaccactggacctgtggcagtctgtagagcagctcccagaggctgccctggcccagaccaccaagtaccttgaagctactcgtgccatccaggtctccgagcccgtccaaaacccccagctactgcagactgtctggcattatgaggtcccagagctcctcccggagggctcatctgcccaagcagtttcactcagcagagcccaggagccagcgcagcctccggccctcacgcctgagtctgcacctgggtgcacaactgaatttgcacctgggcctgcacctgggactgaacctgtgccaggactggagctggggctggagctggagcctgtgcctgccctggggcctgtcccagggcccagtgtgacacctgggtccttgccagcaccttggcctgtgcttggacctgtgcctgccccaggtgcccagcctccaccactgggagactggcctgcactcccaagacgctggcctcttccccaaggctggcccagggtgggctcttggcctctgtgggacttaggtgtcctgcggccaactcagccccaaccctccagggccccaccaccagccactgagtttggctcattgtggcctcgaccactccagccatatcagtctcgccagggagaagccctccagctcgcagctgtccaagtaaagggggaggaaaatgatgtccccagcctaaggggccttcgggagagggcccgcaaggatggggcccccaaggatagaactcgcaaggatggggtccccaaagatagaggtggcaaggatgtggaccccaaggatagagctcacaaggatgatgtccccaaagatagaggtggcaaggatgtggaccccaaggatagagctcacaaggatgatgtccccaaagatagaggtggcaaagatggggaccccaaggatagagttggcaaggatggggcccccaaggaagcacagcctaaggctccccagtctgcccttcaccggctgaaaaccaccgctgccatcgccgccgctgccgccgcagcctacgccgctgccacatcctccgctgcccaggcagccaaagttgctgccaagtttgtcaaggatgccccagccaccaaaatggccgccattgcaacagacacggctgcagctgggcccctaggggtctttgcagatgtcctgggtgcagggccttcccggggagccacagaatcccagatcttgggcgatgattccgaaatctacgaaatcctctctccctcctactctgctgccagcatcggtcccgatccagccctgtcccaggccatggtggctaccaagcaggccatgagccctgaagacaagaagagggctgtcaagtattccatgagccacatagcccagatacctgtcaaacacgactctctgaaggaagaatttgcccagctgtcctgtaacctgaaccagcgcttgagttatctaggtaggcctggtctggccctgggaagggcacaagggagtggggctctccctgcagcctttgagaagtgtgtcctgtccttcactgggctccaccaacaaaatctgcattccaccattagccattctttcctttggcttaagcatttggctcttaacgagtctattcttttctgttgaatgtacaatgaggtcttatcttagggcagggaggctgttagggtctaaagttggcacgaggaaaatggcatgccaaaattactctcaaaaactcttgtggccaggcgtggtggctcccacctgtaatcccagcactttgggaggctgaggtgggcggatcacctgagaccgcaagttcaagatgagcctgaccaacatggagaaaccccgtctctactaaaaatacaaaatttgctgggcgtggtggtgtatgcctgtaatcccagctactcgggaggctgtggcaggagaatcgcttgaacccaggaggcagaggttgcggtgagccaagatcatgccattgcgctccagcctgggcaacaagaacgaaactctgtctcaaaaacaacaacaacaaaaaaaactcctttgtgatagcccataaaacagtattgtattggctaagcatggtgactcatgcctgtaatcttagcactttgggaggccaaggcaggaagactgcttgaactggaagttcgagaccaccctgggtaacatcaagacctcatctctaaaaaaatttttaaacactagctgtgtgcggtggctcacgcctataatcctagcactttgggaggccaaggcaggcagatacggagaccatcctggctgacacggtgaaaccccgtctctactaaaaatacaaaaaaattagctgggcatggtggcgggcgcctgtagtcccagctactcaggaggctgaggcaggagaatggcgtgaacccaggaggcgaagcttgcagtgagccgagatcgtgccactgcattccagcctgggcgacagagctagactccgtctcaaaaaaaaaaaattttaaacattggccgtgtgcggtggctcacgcctgtaatcccagtcccttgggaggatgaggcaggtggatcacttgaagtcaggagttcgagaccagcctggccaacatagcgaaactccgtctcgactaaaaatacaaaagttagccaggcttgatagtgcgcgcctgtaatcccagctacctcggaggctgagacaggagaaacactttgaacccgggaggcagaggttgcagtgagcagagattgtgccactcccgcctgggcgatagcgagactcctcctcaaaacaaaaaaaaaagcctgagtggtggcgcaggcctgtagtcccaactactcaggaggctgaggtgggaagattgcttgagcctagcagttcaagactgcactgggttatgatcgtgccactgcactccagcctgggcaacagagtgagaccttgtctccatacaaacaaaatttaaaaaaaaatttttttaattattgttattattttttgagatggagtttcacttttgtcgccggttggagtgcaatggcgtgatcacagctcactgcagcctccgcctcctgggttcgagagattctcctgcctcagccttccaagtagctgggactagaggcatgtgccaccaagcctggctgattttcgtatttttagtagagatggggtttttccattttggccaggctggtctcaaactcctgatcccaggtgatccacctgcctcggcctcccacagtgttgggagtacaggcgtgagccactgcacctgataaaaaaaattttttttaattaatttaaaaactaataggccgggtgcggtagctcatgcctgtactcccagcactttgggaggctgaggaaggcggatcacgaggtcaagagatcgagaccaacctggccaacatggtgaaaccctgtctctactaaaaatacaaaaattagctgggcgtggtggcgtgtgcctgtaatcccaggtactcgggaggctgaggcaggagaattgcttaaacccaggaggcggaagttgtagtgagccgagatcgcgccactgcactccagcctggtgacagagcgagattccatctcaaaaaataaattaattaaaaaataatgaagaaataaataaaaaggtaccacaagctgcgaggcccagtgcatttccactgggcagtgctgcctgagatgctccataagagaagcagctagagcccaacagaaacatcttcctccatccgagccctcagcagccaccctgtcctctgctttcagccaatatgggaggtccttccagcctcgggacaacagtggacatattgcagaaaaagattggcagcctccagaaatctaggctcaaggttagtgtctccggcgaagggcttttgaggcagtgatggcttgaggtgagctggctgaagactccttgactctgcccccctcccaggtgcagctgtgttctgcagcaaaacaggctgggggaaagcgagctggctgcgaaggcagctgctgcctctcaaagctgattcactggtgcggtgggggggcccagcaggtgtggggctacacggttctgtgtctcaggtggctgttcagagggcaggtgaagccggtgcggtggctcatacctgtaatcccaacgctttacaaggctgaggcaggcagatcacttgagctcaggagttcaagaccagcctgggcaacatagtgagatcccttctctgcaaaaaaatacaaaaattatccaggtgtggtggtttgtccctacagtcccaactactcgggaggctgaggtgggaggatcacttgagcctgggaggtggaggctgcaatgagccaagatcacgccgctgcactctagcctgggtgacagagcaaggccctgtctcaaaaaaaaaaaaaaaaaaaaaaaaaaatggcaggtggaaggcaccctggtctgataccttatttttttttttttttgagacggaatcttgctctgtcatccaggctggagtgcagtggcgtgacctcagctcgctgcaacctctgcctcctgggttcaagcaattctcctgcctcagcctccctagtagctgggattacaggggcccgccaccacacctggctaatttttgtattttttgtagagactggtttcgccgtgttgggcaggctggtctcgagctcctgacctcagttgatctacccatcttggcctcccaaagtgctgggattacaggcatgagccaccacgcccagcctggtctggtacattcttcttggcctcaaccctccctcaggccccttcccggccatggtaacttcagaagcagaggcctggggtgtctgtgtctcccccttttaggaggaagaacttgagagaatttggggcaaccaaatagagatgatgaaggatcgctacatcactttggacaaggcggtggagaacctgcagattcgcatggatgagttcaaggttaggaggactgggtaggctggagaagggctggcaaagggagaattcctcacctagaccttctggcccttcccgaaggttctgcatgaggtggggatgcacttgaggctgggaaccagtggggctttactggcattttactgtgtgtaaattacacttcaatgaaaagcaaacgaatcccaccacccccccccacccatataaacagaagggccgggacaatgttcgtctttttgaccactgcgtcacctgcccctggaagggcaggggtagtgaaggctccatcacatttgctgaatgactcagtgaatgattaagagaacttcttgtgccaactgttacattcttaacatttccctgagccaagaggtagaaatatttactgacattttgggctgggtgataaaaataaaaaaataataataaaaagaaatatttaggctgggtgcggtggctcacatatgtaatcccagcgctttgggaatctgaggtgggaggatcacttaagacaaagagtttgagacaagccagggtaacacagggagaccccatctctacacaaataaaaaatttagctgggactgggcgcggtggttcacgcctataatcccagcactttgggaggccgaggtgtggtggatcacttgaggtcaggagtttgagaccagcctggccaacatggtgaaaccccgtctcttctagaaaaatacaaaattaggctgggtgcagaggctcacgcctgtaatcccagcactttaggaggctgaggtgggcggatcatctgagatcgggagttcgagaccagcctgaccaacatggagaaaccctgtctctactaaaaatacaaaattagctgggcgtggtggcgcatgcctgtaatcccagctactcaggaggctgaggcaggagaatcccttgaaccggggaggcagtggttgcggtgagccccgatcgtgccattgcactccagcttgggtaacaagagcaaaactctgtctaaaaatatatatgtatacatatatatatatatatatatatatatatatatatatatatataattagccaggcgtagtggcacacacctgtaatcccagctacctgggaggatgaggcaggagaatcgcttgaacccgggaggtggaggttgcactgagctgagattgcgccattgcattccagcctgggcaacaagagcgaaactctgtctcaaaaaaaaataaaaagggccaggcgcggtggctcacgcctgtaatcccagcactttgggaggctgaggcgagtggatcacgagttcaggagattgagaccatcctagctaacgtggtgaaaccccatctctactaaaaatacaaaaaattagccgggcgtggtggctggcgcctgtagtcccagctactcaggaggctgaggcaggagaatggcatgaacctgggaggcagagcttgcagtaagccgagatcccaccactgcactccagcctgggcgacagagcaagactccgtctcaaaaaacaaaaacaaaaacaaaaaaacctagctggatgtggtggctcatacctgtgatcctagtactttgggtgcagaggcttaaacctgtaatgagggaggattgcttgaggccaggagttcaagacttggccaacagaagaaaactgtctctacaaaaaaaaaattataaaattagccaagcgtggtagcacatgcctgtagtcccagctacctgggaggctgaggtgggaggattgcttcagcatgggaggttgaggctgcagtgagctgtgactgcatcactgactccagcctgggtgacacagaaagaccatctcaaaaaaagaaagcaaagaaacaagcaaaaagcaaaaaactcactaacggccaggcgcggtggttcacacctgtaatcccagcactttgggaggctgaggcaggcggatcacctgaggtcaggagttcgagaccagcctggccaacatagtgaaaccccgtctctactaaaaatacaaaaattagccgggcatggtggcggatgcctgtaatcccagctactcgggtggctgaggcaggagaatcacttaaacccgggaggcggaggttgcagtgagcgaagattgcgccattgcactccagcctgggcgacaagagcaagactcagtctcaaaaaataaataaataaataaataaataaataaataaataaataataacccaccaaggttgtttccgtgaaggcttccaagtcggggggctgttgctgggatgcactggggtgtgttgggggaaaagggaccaaggaaacccatggcgtatggctgaccccaaggctggcacactgtaatcaggctgggacccatttgaggcaactttgaatggaaaataactcattaaaggggaaccaattcacagcctatgaagtgggggtggacaggagggttggctgtctctggagatgctgggccgagtgtgggtggactgcatgcaggggtacgtgctcagactgtgcaccactggccaggaaccaggtctcctgccaacactcctcttcagagagacccaggccaccatgtcctggggtcatcttggtgccctttctccatggagctggagccagttccattcagcatgtccatcgtgcacccagcactacgccagaccctgcatgggggtgagcaggggctgcagtgtctgcctgcgtgtccgtagttgtcacttattagaaagactctgaagctgatgaagccctgccacgtgtgccaaaacagagcacatcccttgtcccaggaccgttgtcccagcttcctggctcttgtgctatgaagatttcattgctggccaggctcggtggctcacgcctgtaatcccagcactttgggaggctgaggcaggcggatcacctgaggtcaggagttcaagaccaacctgaccaacatgatgaaagccgatcgctactaaaaacacaaaaaaatcagctgggcgtggttgcgggtgcctgtaatcccagctactcgggaggctgaggcaggagaatcgcttgaacccgggaggcagaggttgcagtgagccgagattgtgtcattgcactccagcctgggcaacaagagcaaaactccatcttgggaaaaatctcagcactttgggaggccaaggcaggaggatcccttgaggccaggacttcaggacgagcctggacaatacggcaaggccccatcgctaaaaaaataaaaataaaaatattagccagatgtggcagcgtacgcctatagtcccagctaccagggaggctgaggcaggagaatcacttgaacccaggaggtggaggttgcagtgagctgaggtcatgccactgcactccagcctgggtgacagagtgagactctgtctcaaaaactaaagtaaactaaaatacagtcttaggattttgaaccacacaaatggtttgtattaccaatagttaaagaagaaaaataaaaaataatgtagaacaagtgtgggaataggcaaatcaataggccaagaagactgggcatggtggctcacacttgtaattccagcactttgggaggccgacatgggcggatcacttgaggtcaggagtttgaaaccagtctggccaacatggtgaaaccgtgtctctactaaaaatacaaaaaaattagccaggcgtggtggcgcatgcctgtaatcctagttacttgggaggctgaggcaggagaattgcttcagctcaggaggcggaggctgcagtgagccaagatcgcaccactgcactccagcctgggcgagagagcaagactgtatctcaaaaaaaaaaaaaaaaaaaaaaaataggccaagaagaccagatctaagatttacaagaatttagcatatgaccactacaggaaggatggattactccacaaccagtgttaggaaaaccatttcaaggaataacagtaagtcttaagtccgatagcaatcctctagatgacacaaggcagtagcacggtgacaaatgcaggatgggagcaagatctcatgactgtgtctctgtcttgctctccaccatgtgacttacatgtaagacttaggtttcccagtgtcgttttgggtcttgctctgtcccccaggctggagtgtagtggcctaatcatggctcagtgcagccttgaactcccaggctcaagtgatcctcccacctcggcctcctgagtagctgggactacaggcgtgtgccaccatgcctggctaatttttttttttgagatacagtctcgctctgtcgcccagcctggagtgcagtggcgcaatcttggctcattgtaacctccgcctcccgggttcaagcaattcttctgcctcagcctcctgagcagttgggactacaggcgtgtgccaccatgcctagttaatttttgtggtttttttggtttgttttttgtttttgttcgaggcagaatttcactctgttgcccaggctggagtgcaatggcgcaatcttggcttactgcaacatctgcctcccgggttcaagtgattctccttcctcagcctcccgagtagctggggtaacaggcgtttgccaccacactcggctaattttttattttgagtagagacagggtttcaccacattggccaggctggtcttgaactcctgacctcaggtgatttgcctgcctcggcctcccaaagtgctgggattacaggcgtgagccaccgtgcccagccaatttttttgtatttttagtagagatggggtttcaccatgttggctaggctggtctcgaactcctgaccccaagtgatccacccacctcagcctcccaaagtgctgggattacaggcattagccactgcgcccagccaaaataataagattataaaacatgaatatagcctggcatggtggcttgcacctatagtcccagctactggggaagcagaggtgggaggatcactggagtctgggaggtggaggttgcagtgagctgagctcgcaccactgcattccagcctgggtgacagactgagaccctgtctcaaaaaataaaaataaaaagcataaataaggccaggtttgatggctcttgtaatcccagcactttgggaggctgatgggggaggatcctttgagcctaggagttccagatcagcctgaggcaacatagtgagacccctgtctctacaaaaaaaaaaaaaaaaaaaaatccaggtaggtggtgtcacctgcagtcccagctcctctggaagctgaggcaggaggcttgcttgagcctggaaggctgagactgcagtgagctgtgatcaagccactttactccagcctgagtgacagagcaagagcctgcctcaaaaaattaaaataaaaaaattaaaattaaaataaagaggaggtaacagagactcagcaaagaaacgagcccaagcctgctgggctgggagggggcctggagtggctgtggttcagagcccaggctttggaacagacgtgcctaggtttgaatcctgattctgccacctgctggttggatcagttccctgcggttgctgcggcaaatcactcttggggttctggaggcgggaattctgaaatcaaggtgtcataggctgtgttccacctgaaagctcagaggggcctcctcgcctctcccagcttctggtggttcaaggtgtcccttggctttggagcaacttggatggaggccggggtcattattctaagtgaagcaactcaggagtggaaagcaaagactgcatgttctcacttgtaaatgagctaagccataggtgtgaaaagacagaccgagcaggataatggacacaggagactcaggataatagagagagggaaggatagaaaactacatattggagccaggcgcggtggctcacacctgtaatcccagcactttgggaggctgaggcaggcgaatcatttgaggtcaggagttcgagaccatcgtaaccaacatggtgaaaccccatatctactaaaaatacaaaacttagccaggcgtggtgttgggtgtcagtgaccccaactactcgggaggctgaggtgggagaatctcttgaacccgggaggcggaggttgcagtgagccgaaatggcgccactgcactccagcctgggcgacagagcagattctgtaaaaaacaaaacaaaacaaaacatgttaaagatacccattcacttctgttgacaccccagtggccacactaagctataagagaggctgtgaaatggagtcttgattctgggcagctgggttccagctaaaagtccagagttctgttcgtaagcgtgagcgggacacccgacaggaagagagaagtagaagcctgtttgcagctttgcaggaactatggcccgaccctctggggaaatggaggctcttcccaagctgaccagctgctgctcctattacaatggggatgtagtaattggagagagggtggaattcatgggggcagttggttctttgtggagttgtggggataggacgtgaggtttttccctaacgcttgagcacagtgtgtgtggctgtgataagtgctcagttcatagtagactggagttcctgctgggaccccaggacagatcagaagtagtaaacatgccttaaacatccagggagcgaaatcgtccacattggtttgtgctttccttccttgggtctaactccccgtggaggaaagttcctatgataccatctctgaggggacagcttgtcccaagtcgcacgttccttcccttttcatctgggcacctggagcccttgagcctgagtcttgtaacgcccatgcccacctgcctgctgtccacacggcctgctatccctccccagcatatggtaatggtagaggtgggaggttgacattttatcctcaaggctctccaggatggcagacatgcctgtgcttctgttcttagactctccaggctcaaatcaaaagactggaaatgaacaaggtgaataagagcacgatggaggaggagctgagagaggtgagtgagcagaggttcctctgccttccctgctcccctacccagggaaacggcaccatccaggcaaagcccaccaaagagtcttccagaatttccctccccctttgttcatattgaaaccaggagttggctgggcgcagtggctcatgcctgtaatcccagcactttgggaggccaaggcgggtggatcacctgaggtcaggaattcgagaccagcctgcctggcctacatgatgaaactccgtctctagtcaaaatacaaaaagtagccaggcgtggtggcaggtaactgtaatctcagctatttgagaggctgaggcaggagaatcacttgaacctgggaggcagaggttgcagtgaaccaagatcatgccattgcactccagcctgggcaacaagagcaaaaactctgtctcaaaaaaaaaaaaaaaaaaagaaagaaagaaaaagaaagaaaagaaaggaaaacaggaggcacatcaactcccattttcagcaattgaggattattaacactctacttgaaaatcacacatcagctgtgcacagggtggctcatacctgtaatcccagcactttgggaggccgagaagataggatcacttgaggccaagagtttgagaacagcctgggaaacataggaagatcacatctctacaaaaaaataaaaaaatgaactgggcatgatggaacatgcctgtagtcccagccactcaggaggctgaggtggaaggatcccttgagcccaagaggtggaggctgcagtgagctatgattgtgccactgcaatccagcctgggcaaccttgaacaagatcctgtctcaaaaaaacacataataataaaatacatcaacttccctgttataggaaaaccttggctttgatctcgagatcgtgtttgaatccacgtagaccccagggttgcatttaagccaaggctaaaagtccagagtcccaaactagaagcatcagacccaaggggtgtgatgtctcccagctttgccttcctccatcccagcagccatgcctccctgaactccctgtctccctagaaagctgacaggagtgccctggcaggcaaggcaagccgcgttgacctggagactgtggccttggagctgaacgagatgattcagggcatactcttcaaggtcacgatccatgaggacagctggaagaaggctatggaggagctcagcaaggacgtgaacaccaaggtgaatgcccccatgttgattttcactttattcctaacaaattaacccagaacttagcaactgcaaacaacaaacgttttcagtttaggaggagcaagaatttgggagtgacccagcaacttagctgggtggctcagggtttcctgtgaaattgcagtcaagatgtcatccagggctggtctcatctgaaggctcgaatgaggctggatgagccaattcaaagagattccctcacatggctgttggtaacactcttcagttcctcatcccatggactctgcctttgggccacttgagagtcctcatgacattgcagctgacatctcccagatcaaatgatccaagaggggaaggaagaagcagcaatgtcttttttttttttttttttttttttcatacagggcctcactctgggcacctgccccatacatagtcaataaatgaattgatccccatttcacagaggagaacactgagcctcagagaggttattatacttccctcaggaaacgctgctgctcatggtggagcttgagactcaaacccagagctgcctgattctaaacctaatttaacctctttgggccagtccagccacctcagttgcaagaaccatgtagcactgttgttggaccaactgttccagtctactatgaggaaggggctgtgactcctctagacacttccccggggtctgacacatcactggcagtcagtaaacgatgaatgaataaatgaatgactgtcacagtccctcagagactctcctcctccaccccacatccctgcacttacgcagccaggagagtggcatagttagcctccagggcggtcgccaaccatacctcttggtattcacacagttgtttagccccctcccacattgaatgggaccagcttgtgtaacctacaggatattagagagatgatggagggtgaccaccttccatcataaaagacattgcagccagttgtggtggctcacgcctgttatcccagtactttgggaggccaaagcaggcagatcacttgagcccaggagttcaagaccagcctgggcaacatggtgaaactctgtccccctaccaaaaaaaaaaaaaagccaggtgtggtggcacatacctgcatttccaactactcaggaggctgaggtgagagaatacctgagcctgggaggttgagactgcagtgaaccaaaatcgtgccactgcactccagcctgggcagcaggagcaccctggcaggcactcagagtgaaaccctatctcacaaaaaaaaaaaaaaatgggcgcagaacaaccaaaagcaacacatgaagagattttacttgtttcctggtttaattgaaccacatctacaaatgggctggagatgacatccaattcaggaatagttgctaattgtattaaacatgataatagtgttgtggttatataataaaatgttatcacactcaaatatttattagtgaaatgtcaccatttctgtaacttaaaaaaaatactccatcggctaggcacggtggctcacgcctgtaatcccagcacttcgggaggctgaggcgggcagatcacgaggtcagaagattgagaccatcctgaccaacacggtgaaaccccatctctactaaaaaatacaacaaaaattagccaggcctggtggcgggcgcctgtagtcccagctacttgggaggctgaggcaggagaatggcctgaacccgggaggcagagcttgtagtaagccgagatagcgccactgcactccagcctgggcgacagagcaagactccgtctcaaaaaaatactccctcgggtggcacagtggctcacacctataatcccagcactttgggaggttgagatgggaggatcacttgagcccaggggtttgagaccaatcctggcaacatagagagactccatctctactttaaaaaactatttttggccaggcgcggtggctcacacctgtaatcccagcactttgagaggcagagatgggtggatcacttgagatgaggagttcgagaccagcctgaccaacatggtgaaacactgtctctactaaaaatacaaaactagccggatgtggtagtgggggcctgtaatcccagctactcgggagactgaggcaaggagaatcgcttgaacccgggaggtggaggttgcagtgagccaagatcgcaccattgcactccagcctgggcaacagaagtgaaactctgtctcaaaaataaataaataaataaataaaataaaagtaaataaataaggccaggtgcggtggctcacacctgtaatcccagcactttgggaggctgaggcgggcagatcatgaagtcaggagtttgagaccagcctggccaatatggtgaaaccccgtctgtactaaaaatacaaagattaggctgggcgtggtggctcacgtctgtaatcccagcactttgggaggctgaggtgggcggatcacctgaggtcaggagtttgagaccagcctggctaacatggtgaaaccccatgtctactaaaagtaaaaaaaaaaaaaaaaaaaattagtcgggtttgggggcacacgcctgtaatcccagctacttgggaggctgaggcaggagaattgcttgaacctgggaggcggaggttgcagtgagctgagatcacaccactgtactccagccagggcaacaagagcgaaactccctctcaaaaaaaagccaggtgtggtaacacgcacctgtagtcccagctacttgggaggctgaggcagaagaattgcttgaacccgggaggcggaggttgcagtgagcagagattgcaccactgcgctccagcctgggcaacagagcgagactctgtctcaaaaataaataaataaaattaaaaataaataaataaatacgattgattatgatggtcacacaactctgtaaatatactaaacgccataaacctgcccactttacatacagaccgtcaataaacatgtgttgagtgtgtgaatgtcaggtgcagtgggaccattgccagaaaggtgtctcagaccgcccagcctgcagctgagcttggtttgatttggtcttttgcagacagtagctgatggtgttttttgcttctgctgctaggaagctcaccttgcagctcccctctaccaatagcatctagtaggggttgagcctcatcgaagctgtgtcattttccctttcctggactccctcactattttagttgaattttgttacaccgtgtaacttcccaggttgctgcaaccctcttctggaaggaggcagggtgtgaattcatagagtattctttcttatcttccccttggctgttggcagttagtccacagtgatctggatcccttgaagaaagaaatggaagaggtctggaaaatcgtccggaagctgctgattgagggcttaagactggatcctgacagtgctgctggctttaggaggtgagtgcccgcccgagcccctcctggtaggggtcctgctgcccaggctgtggggaacacaccctggaagctctgggaggaaagattccagacctttggatgaggggatgggggcttggctgtggctgaaagcactgaggaggagggaagctctggcctgagctggcagaggtgatccagccctattcctgccaatggggaaaccaaggctcagagagggaaggggactgggcagatccaggacccctgacccccacccagacagtgccccaggcagagggacccaatatttatggggctcctgtcctcagaccacccctcacacagctttaaaaaccatccgttgtgtttggggcggcagagaaaccacaagagtggttggagactgcagggcctgtggggctgagctgggccgggcactggcaggagggatgcagccctggggctctggctggctgcagcctcccacacatggcctgggcccagcaggggcagcggctgatgatcatgtgcctttcaggaagctgttcaagcgcgtgaagtgcatctcctgtgaccggcctgtggagatgatgactggcccgtgagtaccaccgcccagggtgccccggccctaagggcttgtggggcccatggaggtcatctccgtgcacctccatgtgcaccgttccatgcacgctgtgtgtctacacatccatatacagcattctctccagccatcaagtccatacacgcccacatgcaccattctctatgcaccaggtatctacacatccacatccactgttctgtaccgtcaagtccatacacatccatgtacactgttctgtatgtgccatgtgtatccacattcatatacagggttccccagccttcaagatacacatgtccacatacactgttctacagccatcaaaaatatacaaatatgcggccttgtatgatagcgcctgcctatagtcccagctactcaggaggctgagatgggaggatggcttgagcccaggagttcgaggctgtagtgagctaggattgtgccactgctctccagcctgggtgacagtgagacctcatatcaaaaaaaaaggccatgttggcaaggctggtctcaaactcctgacctcaggtgatccgcccacctcagcctcccaaagtgctgggatcataggtgtatgccaccgcgcctagcctggtttttacttttggaaatagaacaattgttttttgtgtcttactgtgatgatcagaggtcctgagatgcctttcgggggggccccttctacttctatgctgtggacgcttctggcattcgagggtggtgacctgagtctgcacctccttcctcctgctgggaaggcttcctggaggggtgggagacgagccctctgctggcctagcacgcctcccacagcccctgctgtgcccttgtcctccaacagacagctgatcaccatccgcaaagcccacctgctgtcccggctgcggccagccagcgccaacagctgcgagtacttgcagcggcaacagatgaggtgagcaggatgggcgccccgcagggaggccgccccgcatggaggccactctggagcctgggaaccctgttcctgcagagacacatcctccaggcccagggacctaagattgtcctggacatggccagcccttcgcaagacaggcactccgagaggtggctggggcggcagacaggcccacgagatgatggcggagggaggaactgacatatttactgcacatctattgtgggccaggaactgttagacggtttcttatttaaatctcacaaccccctgtgagctagggttcctatgcccatgtccctgtttcttggcggagggaatcggtgatgatggggaaccctcagggagccgctgctgtgcccggcaggcactgtgccaagcgctggggctcacctggccttgttgagtcctcacagctgccctctaagatgtatcctggtaccatcccatgtcacagttgaagaaactgaggctcagagaactgcagtgacctgcccaaggtcactgctagcaagtccagggctgatgtccaaaccctcaggtttccaccgcacccagctggctccctgggtgccagccccacccctcaacctcctgacatcccacagctctatggatctccccagcctccaaccctgctgtggggacgtctggccaggtgggggaagaaccggtgaatcgtcaccacagccgtgggaaggggagggacgtgggggcctgtgctgactctgccaccctccctccctggctccttgagatcaagagattagaaggacacgctcttcaggccaggggtccaaagggaaatggctgggtctggggaaatgcaggtctcaatttgattcctctgccccactgtgtgtgtctgtatccatccgccaggccccaggcctgcctggctgtgccagctaaacacaagctgaaagaaatgctggtcttccctcgatgctggccaggcccttggggcccgtcctgggctctggggtacagggtctccaggtcgctgctgacccactgccctgctgcagggaacagcagtggctgcagctccaggacctcggtatccaggaggattgtcagcaggactggggtgatggcccccaaaacgccaccagcctcaagtgcaagtcctgcaacctgttgacgctctatccctacggggatccccacgtgatcgactatgacagcgtgagtctggccggggcctccttctcagagggtggacgtcagcgcaccccagccccaggtgtgggaccaggcactgagcagtgggcaaccccagcagaggctgcactctgtctcctgggcttctgcgtgtaccaaagttcgggggcagatcgggtcgggggctccctaacccgggacctgggccatccaacaggccgaggtggacatcctgggcgtggatgggatcctgtacaaaggccgcgtgaacagccagcgtggggctcagcccttggccgtcgcaaaggagctggcaggtgaggggcgtagggctccctggggcacccttgcctggggccctggttctgctgggcagggtgagagggtgcaggtggggcccagagccagcactatccctgaccggggagtcctcacacagtcagtcacaaaaattgggtcacagcaggcccccaggagactcagtctttgcaatgggggagggagaccgcgggagcgaggatctgctgttcccgagatcaacagctgaccagagagagggccgtggccacaggaccatggcctgtgacgaaggacgatgagctaggaaaggtgctgggctggtgccaagggacgccagtccacggaggacggactggacagctgccctgaagcccttgaagagggactaggacttagctggatgaaggggtcgggtgagaggagagtggtcgtgtggcaggaacggtgggtgcaaaggccctgtggtgggtggaagccactcacaggcaggagctcaggacgccgagtctccctgaagggtggagactggggtggggcagtggggtgacaaggaggagacttgggccagaccccagaagctgtgtgttaatatcacaggcaagggttgggccagcgggagacccagaattgtgcacatctggaatcagtcaatgtggttgctgcagtgctgaggcccggctctggccggctcctgctgggaccccaagactctggagtccatcactgggttcgaaggacaaaaagaggagccttctctgcacaccccttgaaggctcttcccccttggggatggggagttctaaattttgcccctgggtgggagctacacgccgccccataaggagcagtcccggagccacaagatggccggggcctgaactccacctgcagaaattctggttttttgttgttgttgttgttgttgtttgtttgtttttgaggcggagtcttgctctgtcgcccaggctggagtgcagtggtgcgatctcggttcactgcaacctccaactcccgggttcaagcgattctcctgcctcagcctcccgagtagctgggataacaggcacgcaccaccacgcccggctaaatttttgtattttttagtagagacggggtttcaccatgtttggcctcaagtgatccacctgcctcagcctcccaaagtgcaaggattacaggcatgagcctctgcgcctggcccaccggcagaaattctttcttgccaacgctgtgcctccattgactcgaagaccagacatggaagaagggaagggggactgtttcatcaatgtgctgggcaaaggaggaggcaccctgattcgtctcctggggttgccgagacaaattaccacaagcagggtggcttaaagcagctgaagttccttcattccccggcccatgtagcacgccgtcccattggccgggcacggtggctcacgcctgtaatcccagcactttgggagaccgaggcgggcggatcacaaggtcaggagttcaagactagcctgaacaacatggtgaaacctcgtctgtactgaaaatacaaaaattagccagccatggtgacacacgccgttaatcccagctactcaggaggctggggcgggagaatcacttgaacccaggaggcagaggttgcagtgaaacaagatcacgccactgcactctagcctggacaacagagcgagacttcgtctcaaaaaaaaaaaaaaaaaacagctgaagttccagctgggcaacaacaaattagctgggcatggtggcgtgcgcctgtagtcccagcttctcaggaggctgaggcaggaggatcgcttgagcccgggaatttgaggctgtagtgagccatgatctcaccactgcactccagcctgggcgacagagccaggccctgtctcaaaaacaaacaaacaaacaaacaaaaacagaacagaacaaaaccaaacaacaacaacaacaaaaacaaaatacagccagagttgatcctcccgctgtcctggaggctggaaatcctaaatcaaggagtcagcagggctgcactccctccaaaggcttgaggagggtccctccctgtctcttcagcttctggggccgatggcactccctggcacttctctgtccccatgtgagcttctcttctgtgtgtcctctcctctgtcccccataaggacatttgtctttggatttgtgcccgacctaacccaggatgatctcatctcaagatccttaagctaattatacctgcaaagaccctttctccaaataaggtcacattcacagcttctaggagatgtatctttttggggagcacattcaacacaccctgtttccaggcgggccagacaccgtctcaaaccctgcattctcctgggcgggatgtggcttctcctcgagaggactggccgttccagcccctgccccctgcctggtatctgctgggagggctcaggctgggcgtcagggatcaccaggcaggatcacaacggtggctaatatttaatgaaccccgacttcgtgccaggccctgccccacctccttcaccctccaacaacctgccaaggagtttcacaaatgaccagctgagtgagggctgcttgccgggcggccagggcagatggagtccacatctgatgcacccagtcctgtccccactcattcactggcctccccaagggctgtcatctagagggaggggctttcccccttggctcattcattcccaagacccacacagcaagccaggacttgaatcatgatggcgtcaactgcttcatcttttttttttttttgagacggagtttcgctcttgttgccaaggctggagtgcagtggggcgatctcagctcactgccatctcaacctcctgggctcaagaaatcctccctcttcagccttccaagtgactggaactacaggcgtgcgccaccacgcctggataatttttgtatttttagtacagatggggttttgccatgttggccaggctggtctcaaacatctggcctcaagtgacccacctgtctcagcctcccaaagtgctgggattacaggtgtgagccactgcgcccggcctcatgtaacttattgactactatatattacattgaaattgtgacggatttatagcatcttaaagctgaaaagtggtaagtcaaaccatcataaatcagggaccttctgtattagaaatcaattggaaacctgtctgtggccagatcttgatcagtttgctgttgtcactcatttatttccccaaaagaactttctaactcaaaacagactcaaagccaggtatagtggcttacacctgtaatcccagcactttgggaagctgaagcctgaggatcacttgagcccagaagttcgagaccaacctgggcaacatcgtgaaaccccgcctttataaaaaatacaaaaattagcagggcatagtgaggctccctgcagtcccagctacttggggggctgaggcgggaggatcacttgagcccaggaggttccagctgcagtgagccatgattgcgccactgcactgcagcctgggcaaaagaatgagacttggtctcaaacaaaaaagaaagaaaaaagaaaagaaatgtccagaatagaaaaatctatagacagaaggaaaattggtgatttccaggggctggggtttggggcggggaaagggagagtgactgcttaatggggacagggccccttttggggtaatgggaaagtttcagaacaagatagtggtggtggtgtgcaacgctgtgtgcgtcctaaatgcctctgaattgtgcactttaaactggttaattttacgttatgtggattttacttcgaataatgaaaaaaaaacaaaggtgaaggacaggaagatgggggcatttaggtgctctggcccccagcgggacagctaaaccataaatagccctgccagcatttcacctgtgtcttactgtgctgaaatcacgtcacactcctctctggcctagagttactttcaaagagccttcttttctttcttagccttgagacactctccactcaagaaggcaaggaaggctgggcgtaatggttcacgcctgtaatttcaccactttgggaggtcaaggtgggaggatagcttgagcccaggagttcaagactagcctgagcaacatagcgagacctcctccctaggaaacatttaaacaattaaccgggagtagtggggcacacctgtagtcccagctactcgggaggctgagttaggaggattgcttgagcccaggagttcaaggctgcgtgcgctccagcctaggtgacagagcggagaccctgcctcaagaaaaaaaaaaaaaaagaagccaaggagggaagaacattgattatcccataaaggaatggaccggggagcctgggaaatggggttggtcccaccagagggagactgcccagtgctgggatcggcctgacacaggcccaggggtggatgccacccacacctgtctcttttcttttctgctaagctgtgaaggctccatctcccccgtcacaaagcctgtatgaccgtgtgcactccagtgccctatttggcgccatctgcccccgtgagtacctggttcccagccccagcccagctgtgattctggaagggtctccagtccctcctcgtctcatcccatcccccacaccccgcctgggctctcctgtccacctcctccacctcctgcctgctttgcctgcctatggcacttcagagatgattcctggccccggtgccatccccggtgcccaggccaagcatctgtccccagcgtccacccagctgcaggggcggcaacaagggaactgaggttggaaggaactgagcttctctggttcggatcaccacgtagcaggcacctgagggtactttacagtttacaaggcagtttctcccttatctcatcagaacctcatcccgactcctgtgaggcaggcactgtttgcccatttcacagaggagggagcagaggctcggtcactttgagctgtggcccaagatcacagagctagtgagctgggagctgagcccagatccgtggactccaagcttcatgttctctcccgggggctctgctccatttaagcaaacattcctggtgtcatttatcttgggtcacccacccaggacatttagggtgcccagggcccaggtgaggtatggtgcccagccggccatggcctgtacagcacttctagtcctgggcttctcttctctttagtggggatggccccatcaggctagtgtctcccaagaaggttcttggcacacatctagggtttctcctgcccctccccagccctgtgcccccgctccagtgcctgctcagctgcctcgggccctcacctgacgatgccagctcgaccaccttccctgccacctctgctgctgctgccaccgctgattccatccctaagggacccccagcaggccccagggtccaccaggctctcaagagctccacacattgagtcccgagtcggcaggaagccccccgaggagcccgccaacccgtgagccccaccccgctgcgccccccatcgccaagtcccctccacgtccgaggctgaggcccatgtggccctcccactcccaccaagtcccctccacatcggaggctgaggcctatgtggccccccacccccacccccaccaagtcccctccatgtccgaggctgaggctcatgcgcccccccccatccctaccaagtcccctccacgtccgaggctgagacccatatgccccccccacccccaccaagtcccgtccccggctgagacccagggccctgagcctggcccagaaagggtgctggggccctggatagaggggaggggtctgtgtaggggacccccatgctgacccagtggctgttttatcctgtgcatataaatacaaacagcacagtgcacattctcattctacattgtcatataaacacagctttctagagtgaattttccaacaagccaatttaattccttgatccattttcaatacaacaccaagtggtttgaaaaacacttttccagccgggcacagtggctcacgcctataatctcaacactctgggaggccgaggtgggcggatcacctgaggtcaggagtttgagaccagcctggccaacatggtgaaaccccatctctattaaaaatacaaaaattagccgggcgtggtggtgggcacctgtaatttcagccactttggaggctgagacaggagaatcacttgaatccaggaggtggaggtttcagtgagccgagatggcaccactgcattccagcctgggcaacaaagagcgaaactcactctcaaaaacaaaaaacaaaacaaaacaaaaaacacttttcctttttatttgctgaaatgatttcattagaatcacttccaattacagttcctggcactgtgcctttcatttgggggccattatttccaagaccagttccccacgggaaccagactgggctgtgtgcatcctttttatttcatgttctttctaccagtaactagttattaatttttttaaacaaaatctgattgtttatatttgcctcttggctgatccatgaggaggctggtgcggcgcccgtgggatattctgggatggccatcccttccagggccaggtgccacttgcctgtttcaagcctttctggttcctgtgctcaccaccgatgcgtttggtggaaaaagagccaactgtgaggtcacacggtcttgctgcggcaattcagggattggccttggcacgcagagcagagggctcccccaggcccccctcccaacaatgctcctggcctcatttcttccccttctgacagtttgcctgtctctcccttcaatttcctccctttcaatcctcctccctctttcctttctcgcccctaacgctgtctcgttttgctctctccttctgtactattgacggttctatcccatctcggagactaaaacaatgtccctgtgcaggggtgaagcctgacccgccgccatagtccccagtgtccactggatccctggggtggtgctggggagttgaggggctggtggggagctgccaggagggagctggaggggggctcccctttcacttccctttggctgcctagggggggactttgggctccagtctctcccccggccccggtggccatcggagtctggggacactgcatgcctactctgttcctattgtcctcaaggtccctggcccagctcactgcgacccacgccccccaccctggctgctcttttctttctccaaagactgtgtccaaatgaggccaagcccctcttgacctgggtgacacctatccaagctgccttgggggtgctgtctggtgtagccctggcccccaccccgacccctataccacagatgagtattttgggcaatttctgcccagaacaaaatcttccacatttctgaccgtggatgaggggactggcggagtgccttctgtgtggggaggtgggacttgctggtccctcctccagccaccacccgaggctcagcccgtgggcaggagagaaggcacccagggtcacagagagagaggccccaacttgccggcccccaccaggaggctgaacctgctgggtcctgtgacttccaccccctcccactgcagtgaggcgtggcccccgctctgctgagctgggaggggagggctcctgggggacaccaggccaggccatcttgacacgtgacacccagggcatcccccggtcccgcacagctgggcccccctctccctagtgcccctcactgcctgtccccactgggcccctccagagcaccatcccagcccctttcttgggtgtacaagccagggctggagtgagtttctgcagcccagcaggtgaggagcgaggcctgggggcatctcctctgcatcctcacgggccacctgggggcttgggaaggtggggactccggccccacagcaggcccgtgaggagcagtcccggaagaaggcagtgcccaagggagggtgtggggaggctggccttggcctgggtcccaggtgggagctgcaggcagaatctcccctaacccacactagtgcagaggggtggcgcctgcaggccttggaagctgggagggggagctgcgctactccctaggcagcagctgtggcttggttgggcatagcggctcatacctgtaagcccagcacttttggagggagaggctagaggactgcttgaatccaggatttccagaccagccagggcaacagtgagacccgtctctacaaaaaaataaatagctatgcgtggtagtgcatgtgtgtggtcccagctagttgggaggctgaggcgggaggatcaatttagcccaggacatcaaggctgcagtgagctatgattgcaccactgcactccagcctgggtgacagaaaacaacaacatggccgggcgtggtggctcacgcctgtaatcccagcactttgggaggccgaggtgggcaaatcacctgaggtcaggagttcgagaccagcctggccagtatgatgaaaccccgtctctattaaaaatacaaaacattagctgggcatggtggcacgcgcctgtaatcccagctactcaggaggctgaggcaggagaatcgcctgaacccagaaagcagaggttgcagtgagccaagatcgcgccattgcactccagccccggggacaagagtgaaactccgtctcaaacaaaaaaaaagaagacagatgaattggtcatgtggggagaggagggaggggcgcggggctctgtgaatggggtgggcaggaagggaaaggaaggtcccaccttgaggtgctgctggaatagaggagatgctgtgtggtgaccacctcacactgccaggcccatcccagcccacccctgcaagtgaaaggtcattcaacgtgttctccctttcaaggaccatgaactcattaacactaagggataaacaacagacgccagcacgtgtgttggaaaagggcactgtgagtacccgaaagtggactgcccagggtggaagttcaggcaccagacagaagggcgtggcatgcagcgacttcttagggacgcaggaaccaacacatgctccctccaaccccccacacccactgtcctggctggcttgacttctgactctccatggatgtgcgagctctaagcagagaccttccacacacacaaccggcagacaagggtttctctcctctgcctccctcaccttgctcgtggctccactgggatgaggacaaaatgactccatcaagatcgtggctttgcaattccccaggagatgagagatgaccccgggaagcagagcagaatttcaccagcaggctcctcggtgcctagtgctgtgccactgacaagtccttggtcatcctggaaggggcccccaatttctgccctccctaaaaggactcggtagcccctcacctccaaaacagccgtgttcttttaaggctctgttgaaatacatccgttgtccaaatatgagcagtgctcaaaaacccagagaactttccaaacgcaggaattagaagtagccttgtgtcaaaagaactccattccggccaacctaggaggtctcccgtattcggggaagaagaccggagtcaaaggactcatctgtcctgtgccagggactgctgtgaaagcccctcagagacctccagggccacagcagccccacccagccccgcagtcagcctcggagacagcctggttccctgtggctgaccgcagggtgttctcagagaaccctggctggaccgctgcaaagaccctggggacactcagcagcccctggtgagtccctctcgaccgagagcatcttgcagaacaagccgtctgttttcacggccgtttccagggggagccctgcccaccgccgttcatcctaccccactggacagggcatttacttctgaagctccccgtggtgaaaagacagaccccctccagggattccagccgattcccacgcaggagttggactcgtgcatggctgtggtggcgtagagcaggctggcaggggcaggccacgccgtgtccccagtgccatggtcagtttcagccagttatggccttaagggaatttgcaccaaatcttccagtttccaagataagtcggaagtgaggcttttcccataaactctcctgattttttttcttgagacggagtttcgctcgttgcccaggctggagtgtagtggtgccatctcggttcaccgcaacctctgcctcctgggttcaagcgattctcctgcctcagcctcctgagtagctgggattacaggcatgcaccaccacacccagctaagtttttgtatttagcagagatggagtttcaccatgttggtagggctgctcttgatcccctgacctcaggtgatccacccacctcggcctcccaaagggctgggattacaggtgtgagccaccgtgtctggcctccggttggttttgctttcgattttccaggcttagagaagtcatgggaggctccaggttctttgtgtcacattcaaggtctggggcatgtggtgatttcgtaggcccacctctggctcccctagagttagtcctagcccacgtgcacagcccccttctttttgtaagatgcccctgcgaccaagggctccaagcacacctggtagggcctctgcatctgccggaaaacacctgcactgccagccccagccccagccctgccctccccaaggctcccagactgctcccactgggagtggttcccacctggcctggggcacttattaaaaatcagatctggggctgggtgaggtggttcacgcctgtaatcccagcacttttggaggccaagccaagaggatcacttgaggccaggagttcaagggcagcctgggcaacatagcaagacctcatctctacaagaaaatttaaaaaaaattagccaggtgtggtggcgtgcacctgtagtcccagctacttgggagcctgaggtgggaggatcacctgagcccaggatttcaaggctgtagtgagctatgattgcatcactgcactctagtctggggaacagagcaagaccctatctctaaaacacaaatcagattctttgaccctcctccagaacaactgcctcaagggagaggccgggaacgtgggtgttcagcaagcacccaggggacgcttgtgctctggaagtccggggatcgagtctgcaggctcccactcacgatgtggggggcatgactagatggcacgtaaaaatatatgtgaaaggagctattttcatttttttctgtttttttttttttttcttttgaggtggagtcttgctttgtctccaggctggagtgcagtggagcgatctctgctcactgcaacgtccacctcctgggttcaagcgattctcctgcctcagcctcccgagtagctgggactacaggcgcccgccaccacgcctagctaattttttgtattttagtagagacggctgtttcaccatgttggccaggatggtctcgatctcttgacctcatgatccccccgctgcaccctcccaaagtgctaggattacaggcgtgagccacctgcccagcctgttttattttcaataacagccttgaggtataattgacacaccagaacgtccacatttctaaagcatgccattgagtggcttttggtacagtcacagatcaatcaccatcatctacccagggagcttccacgattgtacgtcagggcctcggcctcggcctcggcccagagagtctgatggcatgaggccaacgaacctgtggtttgccagttttattttacctgctgtgcagccaggtatgagagccacagaactagcacagaggcactccactgggaccatggtggcctgtaggagacatgagcactggctgcaaacacttccgattgtcctaataagggggctgcccttggattcagtggggagggctcagggatactgctcagcaccactgcaggacaataacacagccctcaatgtcaacagtgaccacgctgaaaaagccagccctgcaggaacctcaagtctctcccgtccttaatgtgaccacttgagacccccaggcccagcccacagtggcccccagaaacagaaatgagggtggtgggacagtttccccggtattagtgacgatgtagggatgaagtgtagggacaattcctaaactttgatgtctatctggaaccaggggctcctgttcaatcagtttctgattcggggagtctgggctgcagcctcactctaacaagctcctggctgatgctggggtccgaaccatgccttgaatagtgagggtgtggttcactacaggccaccccagggctcatggtgtttaataaatggaactccccgcggggcgcggtggctcactcctgtaatctcagcactttgggaggccaaggcaggtggatcacttgaggtcagcagttcaagaccagcctggccaacatggtgaaaccccgtgtctactaaaaatacaaaaactagccaggcgtggtggagggtgcctgcagtcccacctaccagggaggctgagccaagagaatcacttgaacctggggggcagaggttgcagtgagctgagatggcaccacttcactccagcctgggtgactgagtaagactccgtctcaaaaaacaaaaacaaaaacacagcactcacgagcctcacactgtgcagagtcctggacagcgctgcctcatgcatggcgggcacgtgcagctacctcagcatgtgaggtgggagagtccaggggcactcaccccactttgcagattaccccaaaacacttctctctgcaaagcatttttcccaccactggaaggcggctatggcagtttcctgagaattttttttccatatcaaagaatcgaggagctgcaaagtaaagactcaggaggccagatatgtccccccgtctcctcctgccacgttctctccctcccctgctacccaggcaccccaggcggatgcagggggctagctggctggccaggatcacccgtcctgtgggctccgaaaggctattacaaaggcagattcctgggagggcccattcctgggaagcaagtgcggcttgagcggaggtcacagcagccagtcgccagtgccaagcagccagtgagcagctgtcccaggtgggctctgtcaacacagcctctgcaggttccaaccaggagatgaagccaggcactggtgtggcaagagcaccgaggcacgcttcctgagaggcacagtcacatccctgggagccaggaagggtcagtggggagtgtcggacgccaggggagcacgggactttcagaaagagaagatgctcttccacccagccggcagggcctccgccaggggctggtgctatcttagacagagtgggtgttgcccttgaggagctgtgagctgagtcccgtgggggtgttgcagaggccccagtctcccttctgccccaagtccaagcccactcttggggagctgtgaggctgagggtgcattctcccaaagctgctccagctcatcccaggcagcctcgggttgccagtctcctaagtgacccaacatctgtgccccctttgctggcagcactccgccccatccttgtcccctgcctcgtcctctgccccttgcaagcttccctggctctgtctgccctctgcccagaggccctgccctacccagtgtgtgctggaggccgggctcagagggtccagcctgtgcccagccactggagccgagaccgagaaaagtcctgagatgaaacccaggacaacagaaggcaggtgtgagccctgcgaactcctaactgggcgccgggatctgtccagccaagcaggggcaggggtgggccgacaggatggggacccaggccaggaactaacttcacaggaaaagccctgggtgggcaggaagattccagagcacgctgtggctgacaagggctacaggcagcagtgtggagccggggaggctcggggtggccctgtcttctgggcggcggcccccagaaccagctggcagcaagcctcgtatacaaggtaagaccacagagcctggcagtggtttggaattcgttcttctcttttgttaaaagggggaaaggaagtggatgcgggtacccccaggtgcaggggaggcatgcaggcagccccagcaggcaggcgctgggaggcggtgggaagagtcctggagtttcccacaatccttttctctgcaaggaacagcaacgctggctgacgagggggtggggaggaggcagggccctggggagggggcggcgggcagggggctgggggctcacactaacatgcaaagtccagctgccccaggaactaggttgcttctgaagagcgacacacgtagaaatacacagacacggccacgcgcacacatgcggagaggctctgcattccctagggtgggggtcgaggcctgccggcccccaaggagctccaagccagggatcagcaatgtctctgccagggtggtcctccacggcacccctgggctgggctgggcaggtgcgtcttcgaaggaaggctgcgtggtctctgaagttctgtccgccaggcacccaggccgcgctgaaccactccatgtgccggggccgctggggccatgaccttgcgtgtgggcagctgcgtgttctggcaccagacgtgtccctgcctggctagagtccgcgctctcccctccagggctccggggaacaaggggtgcagacagaaaaggggtgaagggggcccgcagagacgtcctctcccccgccccacggggtcctggcctccgggaggggggaggggcctcccttatctctctgcctccatggcagggtgggccctgggttctgaggtggcctgttggggggccaggggtggccagtctgaagccggagaagggggtgttggagtccacaggggcggctgtggctggtggtgctgtgggccccccgggggcgaggccgccgtgggccagctggaggccgcagagctgctggtggcggcatgggggaagtgtggcgggggtgacgtggctgtcgcggccatcgggctgccgctgccaccgctgtggaagctctcggaggccttgagacgggagaacatggtgagagcgtcagggaagttggggggtgtagcaggggtattggcgggggtgcacatctgtgaggggaagagaggagagatggggtgagcaccccttcctggaggggcccccactgcctcccaaggggagatgcgtggctggcccattctcggaaggctctgtgttccttccccagatccccaagcctgtccgccgcccaggggttcccagaggagaagccttgagatgaaccgacccagcctcactctcaggagcccacggtgcctggggccacgaggctttcccagcccacccctttccatcagccacagcatccccgggggctgtagggtaaggagcttcattgccccagaggccagcgccccccaggtctcagggggagctggcacaggcaagattaagtgcaggacccacggagccgggactcctgctgacccatctccaaagaggtcgagccccgcctgcaccagcgccctcgtacaccggggccaggggctgcttatacacagaactagctcggcctccttccgcccaatccagaactggggactccggggacacttaccatctggtggtgatggtggctgtaggggatgttggtctcctggaaaaaggcgctgagggctgtctgcaggaagaaaggcccctgctcaccctccaggcccccgccggccctgccgctgcccttgttcccaggctcctctgaggctggggatgaccctggctggactgctgagtgggaggggtgagtcgcggtgctgaggctcagtggcttgcctgtcacccccaaccctcactgctgtctaaggaggagccacggaaccttgggcagttggggtgggtggagaagacccttcccctgctgctcgccacctgcctcagtgcctaaggcctgcagagccctccccctgcaccagctggcaccagcaccatgactgggggagggcgggcagtacaccccatcctgggggaaaggcgcccggccccaggtagcccaaccagacctccccaccctgccccgtttcaggagattctagcctggctgttaccacctcaacgggtagcaagtctctactcttctctaagcctcggtctcctcatctgcgaagcaaaagcatcctgaaggagtctgagcctggtggtggggatcccctgctgccccacccagctctgcttctggctgatcaagggggccactgtttgggccttggtttctccatctgtaccacaaagaggttcgactaggtggctcctgggtcccctcccttgcaacagtgacctcctaagatcaccagattccagcaagcagggcctggcaccaaggagacaagcctgggctttaggctcactcgcttccccacctgagcctccctcggaacagtgcccgggaagtggagcagaaagacggccctaggatcaaagccaccacgggtttacgacagctcccagcacagctccccagccacccgcccttggctggcaccacgctaggcacgggatgctccaccgtctccctccacacccgggccgcatgccacactgagcacggtgcgggcacccagcagggctccatcccagcggggccgtggactgtcatcattaaccccacaggcagggactgctgtcttacaggcagggaaatgaaggtaggaagtgacttgctcagggtcagctggtcggcagaagacagagatgggggcgctcagaaaggccaggacaggtgggggagacagagcgagcctggagccctttcctgtgtgtgtcagctcagcaggctccagaggtccttggtgactgggaactgaggagccccagagggaggcgctgggatttgctatgtcctggctgaggccctgcaggggtggggaggcctgtcccaggaaacggaggctgctcttgcgcaagggccagtgagggagccccacaagtatttgaggggttctcggggccctgccaagtcccaggcccagacttggagcttcaagccgccgaggtgcccctaccgccacccctcaggcccactcccctaatgccagcttgacttcctggccctcccaggcccagcacacccagaaatccagcctggctcctggggcctgccctcgatcagggggtatgggtgggaggctatttagattttttttttttttttttttgagacggagtctcgctctgtcaccaggctggagtgcagtggcgttatctgggctcactgcaacctttgccttctagttcaagtgattctcctgcctcagcctcccgagtagctgggactacaggcacgtgccaccacacctggctaacttttgtatttttagtagagatggggtttcaccatgttggccaggatggtcttgatctcttgacctcatgatccgcccaccttggcctcccaaagtgctgggattacaggcatgaaccaccgtgcccggcaaaaaatattttttaaataaatgaattatgtggggaatttcctgcaggagacaccctatctgggtgtccctaaacaggggtgtgggagctcaggcatgggggccgggctttaagcaccttcccagaccccaagaccctctgtcagcagcagctgtgccccaaagcccaggctcactgtgtaaatcccaaccccaggagccccaggccacaccagaccccctctgcaggccgctgtgagcattctccattgagaaacatctgccccactagacaccggcccctccccctgcagcctcctgcccccattagcacctgaattgcagcaaatgtgacccagaaacaccgcctggtggatgcagccagcgggtggagcgtggagagggatggggtggccatgtgaacccctcactcagccccattccaaggcctgaagtcccgtcaccttcctccagcctccctggcggcccccactttacagatggcacaactgagacttgggagtggagggcacagggctcctcccatggggaccctgggagccaccagaggccccagatgctcctgcccctctgggaacagtctttccccagacattgcactcctcaaagctgcattttcaattaactgtgccgctgagggatgtggcctgggtgccagctgggtgccaggttttgagggctgggctgagtcctgcaggcagggcccgcttcccaccggacacctacctgcccagccccaggcagcgagggaaccctgcgtgcagatgtgtaactgccatgaatgcggttttgcaagttttgccacatccagcccctgacacaaacagggctgatgagggctgtggagaccaggagggaagcagggagcttcctccgggtggggctgccttggggcacagggggcagtaagctggccaacagaagctgactcatgccccccaaccccaccatacagatgtggaaactaaggccagagggacagagcagcctcccacgtcctggggtgaacaccacacaggatcagtggcctccgcgacggctggtaggagggaagtaggcaaggagagagggatgtactcatctggatgggatggccactgccttcccagactgtcccaagcttgggacattctgatccccctgcagtccccaggaagcggagcctcagagtcctctggcttctagtccctcctgcaggccctgggatggctcctcatggagaaaccaggttcccagtccccggctgggcacagatggtaccgggatggctgaggccatgaccctacccctgtgaggggcacagctcaaagggctctggcctcatcccctgataccaaccaccatggggttaatcctggggtcggtgaattagggaaagccaggtagcctctgggcagcacaagccaggagcactactgtcctatgggttaggagaggcccgggggagtgggtgccagaccggggcagcatcacctcctacccagctagcccgaaagctggtgaaccgtgtgcaccctccccattgcaccggtaaagggacagatgcccctgccagccccaggagagcacctagtcgcgcacacggagtccccaggcacacctctgaaggggatacacgctcatccctgtggtgtagtgtggggctccgacacgccacccctacactccaggccgtgtacacacatcacaccgtgccgggcacgggcggcatctgcacacccgccacatgtgtacgcgttgatcacacaccaaacgcaccagggggctgcgcgttcacacgcgcgccaacgtgcccgcaggtccgccacctccccggtgcccggccgacgccgtggcgcggtgcgtgcgtaaacacaaatgcacatggacgtgtgcgcacgccgccgaccgcccaccaggcacgcggaccctcggaccactcgcccggagcggctccgccctccggcccagctctgccgaggcctggggcgtcctccttccggccgcccgcccgactgtccgtctgcaccgcggggccgcccggccctcggccgttacccggacaaaaggggtggggggggtccccgtctcgatcccgggggactcgcggccccgcgggggcggcgtatccccgaccggtggcccggttcccacctccgcccgccgcgagcccttgggatccggacgccgggcaccgccgtcgggaaagcgggtcgggtctgcggcccggagggggcgcacagccggcacgcgtccacgccgtccgcccccgcccggcggccacgcgggacacactccgcccgtggccccggccctcgcccggctccggcgccgcgcacctcgaactgccagtgggccgcctgcagcagttgcttcgcctggtcggccgcgcagcccgccgtcagcacgaactggttgatcatgacctggtgcttgagctcgtccatgttcacggacatggcgccgccgcgctgcccgctccggcctccctcctccgcccgcgcctccgcctcacgcgtccaccattagcgagccggctccggctaatacaaatatttactgtgcggctctgactcaccgcgcctcgcctcgctccgccggcgccgcggcatgctgggatatgtagtccccacggtgcgccgggcgccccgggggagcggggccggcaccctaggggacgcgaagcccgggaaggggcgtgtctgagcaccgagcgcccgctgtgcggatgtccgggccgtaacccgagccgggcgcgtccacgtcgtcctcgttgctctcggtggcacccgtgcccctgctctggcacggatgggggtccgctggcgggggccacgtctgtgcatgggcgcaaatgcctgaccacaggatcttggccaaggcctggggaccgtgtctgaactgtgagcgcctactgtgtgtggatgcccgggccgtgaccagggttgggggagtccacgtcgccctcgttgctctgggtggcacccggcccctgctctggcacggatggaggtccgcaggcgggggcctcaggttcgtgcataggcgtttttgccaaggcccaggaacggtgtctgaaaactgagtgcctaatgtgtgcaggcgcctgagctgggaccagagccagtcacgtccacgtcgccctcgttgctctcggtggcacccacgcccctgctctggcgggaattaggagcccagaggccggggccacagatctgtgcatgggcgcaaacgccaggccacagacgtctttgccatgccccggggactgtgactgaacgctaagtgcctactgtgcgcagctgtccagaccgtgaccagagccaggcacgtccatgtcgccctcattgctctcggtggcacccgtgcccctgctctggcacgaattggggtcccaaggtggggcatacagatctgtgcatgggcgcaaacgccgggccacaggcgtctttgctaagacctagggaccctgaacccctctgtgattggcatcgctctgtgttaaatagtaggcacgcccttaagagaggggtctctaggaattttggcccaaatcggctggtctaggctgaaaggcccggcacactgtaggcgccgacaaatactcgttcagtgaatgaatgaatgagccacttaaaagctccgccgcacgtcaccgcctatagctagcctcctagctctcctcactcaatctctcatcgcccactcgtggcatgggtccttcctagcctggctctgggcctgccccactgtagccccatgaccctctggacggcgcctgggacaggctggcggggccagcagcctctggtgcttcggggtccccctcccagcagttctcccgctttcccacgcaaaatctcgtgctctttgccggaaatctcggcccttagcgggcgggcgccaaggcccggcagagccagttccggagcggccccaaactccctttcccagaatgcctcggtttatttgcatcgtttggtcccggtgacgtcagctgagtgaggtcgtgcctcgaccaatggacagcctcggggtgttaggacctggccatataaggtaaacaaagctggtcgcccaatgaagaggcggcgggggcgggcgctgggccggggaggccgggggcggagccgggggcggggcgaccgggcggtgtttacagaccggcacatggcgcttccggttgacgttgctgacagctagtgaggctttagcccgcttcgagcgcccgggggcggtaaggcgcgatcatagcagctctaggtgaccttggtccggctccttgcgccccctggccccagcctccttcgttgagacactatttgttgagtctttcctcttttcctggccctgacctagcgtggggcgacagaagagcaatagccgggtgggggctgtgagaacggctggggttgggagcgaatttcggaaacccggaggacgagtatagccttgcaagatggaaaatgccctcccgggctggcgcggtggcctgtaatcccacctactcggggtccgaggagggaggattgcctaggcccaggactttgagaacacgcctctacagagatttacattttaagaaaattagctgagttcgggtcgggcgcagtggctcacgcctgtaatcccagcactttgggaggccgaggctggcggatcacctgaggtcaggaattcgagaccagcctgaccaaaacggcgaaacccgttctctactaaaaatacaaacactagccgggcgtggtggcagtcgcctgtaatcccagctactccagaagctgaggcaggagaatcgcttgaacccaggaggcggaggttgcagtgagccgcgatcgcgccactgccctgcagcctgggccacagagcaagactctgtctcaaaaaaaaaaaccaaaaaacaaagcaacaacaaaaaaacagagaattagctgggttccatggctcacacctgtaagtaatctcaacactttaggaggccgagatgggcgcggatcactagagtccaggagtttgcgaccagtctgggcaacatagtgagaccctcgtctctacaaaaaataaaaaataaaaaaaattggccgggcgccgtggctcacgcttgtaatcctagcgctttgggaggccgaggcgggcagatcccttgaggttaggagttccagaccagcctggtcaaaccgtctctactaaaaatacaaaaattagccggacatggtggcacacgcctgtagtgccagctactggggaagctgaggcaggagaattgcttgaactcaggaggcggaggctgcagtgagctgagatcgcgccattgcattccagcctagacgacagagcaagactgtctcaagaaaaaaaaaaaaattctggagtcccagctacagattgaggtaggaggattgcttgagcctgggaagtcagaggctgcagtgagccgtgattgtgcctggggaacagcgcaagatcctgtctccaaaaaataaaaaatgccctagggaggccggcactggccctgggggtgagttaggggatactgaaatgtgtaaacagatctgatcccttggacacgttgggatcactgtggctgtggctgtgctgggatcagatggtggtggagagctccggtctgaactaggcgacgttcttgatgtgtctggttccaggggagtctgccctgccttcggaattggatggaatggagggaattgcctcaagctgcggctcctacccgggcccctcaagcctgaccaaggactctcccattgggtggtgggaggaggacagtaggggaactagtggactggacctgaaatgtcctggggtgggagggtagggtggtggggaaggcttggggcactgagatagcggagagggctggggagggaagggagtcagggtgcagtggagttggtctctgagggctggggctgggagcctggcctataggcaaggggcggacactgagtcttggcttttcccaggcaggcacttagcctcggcagaagccatctgaccacgggaaatacagtttaaaattctttcctgctgtttgcggatcacttaggggccacagtattttgtaaaccctgatggttccaagagatgtttgctcttgctaagagttgctccttaacctttgcaaagctcatatgcatgaattaatatgggcaaagtgctccacagggtaggcccacagtaaaaaccagctctgaatatgattcccgctataataattaccactaggacgacaacacagtgtggtagaaggtgggcaggttcgggagctagacagacctgggtgtcaggcttgactccgctgcttaatgacttaatgcttaatgttgagcgagttaccagagctctgggcttcactttctcactggcggggctgagttctggcctcactgctgtggaagattaatgcctgtaaaatgcagagtgcagggcctggtgctatttgcacggttctagtgctctcacctgtttgcctccatctggaccactctgggaagccctagccctattttacagataaaactgaggctggaatccagccttaccctctgacattcagaacctgtggagaagagcgggcacccatggtgcatttctggcaagggaggagggacactgtcccggcagggcccactaagggcttgccttgcatagggaggcaggaagtgccttcacccctccttccaccatcgtccaggtaccactcagctgcctgcccaggcttgcccagctcaggaggatctctctcaggccagcaggctggcaagagttgggcaggtggggctggcagagtcaaaggtcaccctactggtctccatgcaaccccctcacccccatcccctaagccagcttgtttttccacgggcaacagggaattaaaaaacaaccttgtttttagccaggattagcctggttggagaatgaactttggattccttagcaggctgggatggaacctgacagctggggccagcacctagtgggagggagaggagaaggcatttccagcagtgcccttatgtcacctgagggcccaagaggttcaaggctttgccagacttcacatggccagtccatggggggcccagggccctggccgcctcctcctcaccccattctttgatttattccacagatgtgcttatcagacacccaccgggtgcctggctctgggagcaccagaatacgccaggatcctgcccactcagggggttgagaagtctagacttgagactcaggcactcagaccaggaagccaccagtcgtctccagcgtctgtctttatgtttctttttttttttttttcattttattttatttttgagacagggtctcactctgtcacccaggctgcagtgcagtggcacaatcatggctcgctacagtctcgacctcccagcctcaaaggatccttccacctcagcctcccaagtagctgggactacacatgtgcaccaccacgcctggttaatgtttatattttctgtagagacagggctttgccatggtgcccaggctggcctcgaactcctaggctcaagcgatccacctgccttggcctcccaaaatgctgagattacaggcgtgagacaccgcacctggccctgtctttacgtttcagagagcccaatgctggctgaatgtgaggcaagatctggcccttgccttgccatctccctcacttgattctagtcctgtgccgtactcagttctttcccactatagaggttttgtatatgccattacccctacctagaacctggagcagcctaatccctcacactttgcctggctggctattaattgtatttcaagtcctggtttagcaaccggccgcggtggctcacgcctataatcccagcactttgggaggccgaggtgggtagattacctgaggtcaggagttcaagaccagcctggccaacatggtgaaaccccatctctactaaaaatacaaaaattcgctgggtgtgctggcacgcgcctgtagtcccagctactcgggaggctgaggcaggagaattgcttgaacccagggggcggaggttgcagtgagctgagatcgctccactgcactccacctcgggcaacagagtgaggctgcgtctcaaacaacagcaacaacaacagcaacaaaaaataaatcaagtcctggcttagctgtcacctcctcaaaaaaaccccttccctgactcccctgccaatagtgtcaattaattgcatctcaacgttttctgcagagcacccaccacattctggaattatatacttgttaacctttctagcgtctatttcctcacctgcctgcagcctccatgtctagcttgtcctaccatttgatgcctgttgcctggttcatcacctgtcacatagtagctgcaggataaatatttgttgaataaatcaatgaattggccaggcatgacggcacacgcctgtaatcccagcactttgggaggccaaggtggggggattgcctgaggtcaggagttaaagaccagcctggccaacgtggtgaaaccctgtctctactgaaaatacaaaaattagttgtgggtgcctgtaatcccagctactcgggaggctgaggaaggagaaccgcttgaacctgggaggcggaagttaaagcgagccgagatcccacatgatcatgccactgcactccaggctgggtgacagagtgagactgtgtctccaaacgtaaataaataaatgaatccaggccgggcacggtggctcacgcctgtaatcccagcactttgggaggccgaggcggacagatcacctgaggtcaggagttcgagaccagcctgaccaacatggagaaaccccgtctctactaaaaatacaaaattagccgggcgtggtagcacatgcctgtaatcccagctactacggaggctgaggcaggagaatcgcttgaacccgggaggcggaggttgcagtgagccgagattgcaccattgtcctccagcctgggcgacagagcgaaactccatctcaaaaaaaataaaataaataaataaataaataaaaataaatgaatccactcagatgttgataatggaacttggaccaaatcgggaagggcctgtcttccatctgggtgtgggtaagcacagaaaaatactgctgaaagggctttgaggacaccttgagtccaaagctctgttgagaagaagagttaatgaaacatccacctggtggaaatgactgctctggcacaggctccatagggaggatatgctcttagtgttgtttttcagtgggaacagctgatgctcaggactctcccttcctccccgcaaatgaggagggcagtcagttgaatgcagcgttgatacacaaatacatgtacatgtacgtgagttacgtgattcaatggaaagaaatataaaatgaagagagatcacaatgggtggggggcttcaggcccatccatctgggggcaagagcctggcaatctggcactctggagcatgcctctgtggaggcagggacgtgcccaggtaagagcagtggcctggctcaattccagctgtgccacccacctactgtgcaacctcattagggtacttcatttttctgagcctcactttactgttttgtaaattggtaatagaaatagaatctacatcagattgtttttctgtgacagagtcttgctctgtcgcctaggctggagtgcagtggcgcgatctccgctcactgcaacctccgcctcccaggttcgagcaattctcccatctcagcctcccgagtagctgggattacaggcacgtgccaccacacccagctaatttttgtttttagtagagacgggtttttgccatgttggccaggctagtctccaactcctgaccttgaatgatccgcccacctcggcctcccaaagtgctgggattccaggtgtgaaccattgcacccggccagataattgttttttaattattattatttttggaaacagagtctcgctctgtcacccacactggagtgcagtggggcaatcttggctcactgtaacctccacctcccaggttcaagcgattctcctgcctcagcttcccgagtagctgggattacaggcacatgccaccacacccagctaatttttatgtttttagtagagatgggggttttgccatgttggccaggctggtcttgaactgaccttgggtgatccgcccacctcggcctcacaaagtcctgggattccaggcgtgaaccattgtgcctggccagataattgttttttaattattattatttttggaaacagagtctcgctctctcactcccactggagtgcagtggcgcaatctgggctcactgtaacctccacctcccaggttcaagcgattctcctgcctcagcctccccagtagctgggattacaggcgcgcaccaccacgctcaactaattttttgtatttttggtagagacagggtttcaccatattggcaaggctagtcttaaacccttgacctcaagtgatatgcctgcctcggcctcccaaagtgctgggattacaggcgtgagccacagtgcctggcctgtttttttaatattttattttttaaaatttttatcctttttagagatagggtctcactctatcacccaggctggagtgcagtggcatgatcatggctcactgcaacctcgacctcccaggctcaagctatgctcctgcctccacctccagagtagctgtgactacaggggcgtgccatcacacctggctaatttttacatttttggtagagacagggtcatgacatgttgcccagtctgttctggaactcctgggtgcaggctatctgcctgcctcggcctcccaaagtgttaggattacaggtgtgagccactgcgcccggccaacatcaaagaattatatgagaggatatgtgcagagccctcagcatgatgcctggcacataatgctcagtaagtgtggatcttggttgtggggcagggagatttaatcaggctcctccaagacctggacctgcatcataatcacacaagtctcttggctgccgtactcatttggcttcccaagttcccctgacaagaggaagtctgaggccaggtgcagtggctcatctctaatcccaacactttgggaggccaaggcaggcggatcacttgaggacgggagttcaagaccagcctggctaacatggtgaaaccctgtctctactaaaaatgcaaaaattggctgggtgtgatggtgcatgcctgtaatcccagctactggggaggctgaggcacgagaatcgcttgaacacgggaggcaaaggctgtagtgagctgagattgtgccacttctctccagactgcgcgacagaacaatttaaaaaaaaagaggaagactggatcctggactgtggtctctggaagggtataagaagcatttccacatggactgtggtgaattgaccattggagactcagtctgccttgccctccctagctgctttcttggtacagcaggcttgacttgggaaatcactctgctcagaatccaagttcctcaactgaaaagtaggtaaaaagcgatctatttgcagagctgtgtgtgactcaaaagccagggaacaccttgcacactgcgaggttttcattctgaaagcgattcttgcaatcttgcccgcagcgccatttcatgcggctctctctcctctgtgcctcagtttccctgtgtgtaaaatgtgggagagtctactgccttccgtggaggctgtgaaattatgtctttaaactaattggtccagacgtggggccaaagtatcgggattacaggtgagccactgcaccgggcctcagccttgtcagggggccggaggttgcttaaccccctggatcccagcttcctcatctgtaaaacgggctgatgcctatacagctctcagaaccacacctggttcagaagtccccaaatggtagtcctcaaattctggccaaggccaaagcaggtgcttcacttcttccgtgcacaccctgcaagtgggctccgggtggcaggtgcagctacgccctctgccggtcggggcgggagacaaactcaggggagtggggagaaccacagcgactcagggagctatttcagagggggcaagtggaaggcgctggggctccaggagagtctgtaagcgaacagatgaggaaatgaccaaagagttaatatgttagtgcagcgcttggaacgcagagggaaggaccatttgccctgtggttggttggttccttccctctgaatttaggtccatttggtttgtcccggagtgcttgtcaacccgtcagagggcctgggaacggagcatcctgggaaagatagttcccagacgggcttcccgcgctgcttcccggcgccttcggcggcgagaggactccatttcccgacgtgccccgggaccgggaggcggagggccgccgtggcgtcggtccccgggccgagccgggggtgggggctcgaggcgcctccgcggccgtggacgagcgtccgtgcggcctggtccgggccatgtccgcgtgaggaccccgccgctgtcgccgctcccgttccggccctggcccctctgcccggcagcgccgcgcaccatgggctccattctcagccgccgcatcgcgggggtggaggacatcgacatccaggcgaactcggcctatcgctaccctccgaagtccggtgagcgcccggccccaggcgcggactgctaggcacgcgctggaacgcggacccggcgggcgcgggggcggggactcggggcggggcgccctgctcggccccctccgggcctcgttgctaccccgagccttcgcgcggccccacggccccgatccctaggcgtggctgggggccccggaggaacctgcccgagccgtacctggcgctgctactgcccggcttgggtgaccttggggcagtcccttcgccccgggcacctcagctccgtccttgcaacaggggggagctcctgggggaaaccccgagggcggggcggggtgctgagcgcgggtcccggcgcatcgcttctgcctagaaaactctcattgtcatcagattgacctcaccgcgggggccggctttcgctttctttagtggcttggtgtgaaggccgagccagtggtttgggcaatttccctcccatcaggacggaggctcttggtgtgtgggttggaggagtggggctgggcccaaggagacgattatagttgatcgggaggggccagggtccttgctgagaggacccagccgatactcgggcctctgtgttatggctgagggacgtaagacaccaaggaggaagtgactgccaagatctcagctggatggaagcatagttgggaccgggaccagctgtggggctcccacgtagctttgttcccagctctctttctgcctctattgatgagttatgtgttgactgggagcatctagctccaagtctcaccctccatctcctcgtggggttctttgtggtggaaaggagagaaggaagaggagagagaacttgggcatcatggggacatctagattgggtcctcagatcctggcgtctcatctgatctgatgtctcagtctcctgggtgtctccggacacccacaggccagatttctctgagtgtgggccaggtccacaagtgggggaggactgctagacatgccagggcctgcctgggaccccttggggcctgggaacctgcattttcaacccattccccatgtgagttttacgtccactcaggtttgaaaaactgctctgcccaggttttgtaaggtgtgactaggtgagggcctggggccactgggatgaagtgaggggaaccagcacagtttgggggcactctgaaggggatggactcagagctaggcagaacgcactgttgcctgcctgctggggagagcacagctgtatcccaggcccagcagcgggtcagcctggcctttgggtggttccaccctggggtttccctagaggttccgagggctgatggccctacatcagatggagcagtttgctgttgtcctctttcatctctgatattcttccagcctgcctctggctgagtgaccttggtcgaggttgcttaaccccctgggtcccagtttcctcatctgtaaaacgggctgatgcttatacagccctcagaaccacacctggctcagaagtccccaaatggtagctgctacaattgctcataaaggaagataagtgactagctaatgaccataatcatagtaagcagtggcatgacacagatatcaaaaagttgagtggcacttcctgtcacctgggacctgagctcacttgatgtccgttcttcacttgggctgaacagaataacatacatgtcatttacagcccgcttcgggatcccactgtggctgaaatgtcattgctaatcactcgtggccctccctcccactgagcatccatcgcagaacactcgcgtcagccactattggttggcactggcacccaggtgcaacccatcagctagctgcctgggtcatgttgccagtgccagcagtgttctgcgcccatccagtccacaggtcctctccagctgtgctttttccctttctcttctccatccttccctggggccttgcagatacttgttcttctctttgttcatctcttctggtccttgcctttgtgccgcactggtttcctagactccccgcctctcctgtctccttaatgagaactccgtcaggtcaagggtgggaggcaggccgggcctcagcagcattttggtgtgtttccccaagggcagaccggggaccgtggagacatttgagatgattttaggggttgcccccatggaccattcaatcacccgatgagaaagctttcttttcacatctctgtcaattttgttgattatgtcaaggagaaagagtcactgggtggtaatatatgcatttttaacacctaacactgtccatttttcttaagggaactttcagcatgttctgcagcagcgctcagcttgaatttaatatttgctttgttttcactatatctgttttactcttcatagctttattgagatgtagttcatgtaccacacaactcatccattgtaaacatgatttgatgatttttagttaaattatagaattgtgcagtcgtctggccaggcgcggtggctcacgcctataatcccatcactttgggaggccaaggcgggcggatcacaaggtcaggagatggagaccatcctggctaacacggggaaaccccgtctctactaaaaatacaaaaaaatttagccgggcgtgatggcaggcgtctatagtcccagctacgcgggaggctgaggcaggctgaattgcttgaagctgagaggtggaggctgcagtgagccgagattgcgccactgcactccagcctgggtgacagagcgagactccgtctcaaaaaaaaaggctgggcgcggtggttcacgcctgtaatcccagcactttgggaggctgaggcaggtggatcacaaggtcaggagatcaagaccatcctggctaacaccgtgaaaccccatctctaccaaaaatacaaaaaattagctgggtgtggtggcgggcacctgtagtcccagctactcaggaagctgaggcaggagaatggtgtgaacccaggaggcggaggttgcagtgagccgagactgcgccactgcactccagcctaggtgtcagagtgagactccgtctcaaaaaaaaaaaaaaaaaagaattgtgggtgggtgcggtggctcacgcctgtaatcccagcactttgggaggccgaggcaggcggatcacgaggtcaggagatcgagaccatcctggctaacacggtgaaaccccatgtctactaaaaatacaaaaaattagccaggtgtggtggcaggcgcttgtagtcccagccactcgggaggctgaggcaggagaatggcatgaacccgggaggtgaagcttgcagtgagccgagatcacgccattgcactccagctgggcgatagagtgtgactctgtctccaaaaaaaaaaaaaaaaaaggaggggacattgaagcaacaacaacaaaaaaaagaattgtgcagtcatcaccacaattgcagacatttcccttgtaaaagtttccttccatctgtttgcagagtccctaccccaacccccaccctcagcccatcagcgatctgctttcttttttctttgagatggagtgttgctctgtcgcccaggttgcaatgcagtggcatgatctcggctcagtgcaacgtccgcctcctgggttcaagcaattctcctgtttcagcctcctgagtagcttggattacaggtgcgcaccaccacgcccggctaatttttaaatttttggtacagatgaggtttcaccatattggccagtctggtctcgagctcctgacctcaggtgatctgcctgccttggcctcccaaagtgctaggattacaggtgtgagccactatgcccagccttttctgtttttttttgagacagtctcgctctgttgccctggagtgcagtggtgcaatcttggcttactgcaacctctgcctcctggtttcaagtgattctcctgcctcagcctcccaagtagctgggattataggcactggccactatgccaggctaatttttgtatttttagtagacacggggtttcactatgttgggaaggctggtttcgaactcccgacctcaggtgatctgcccacctcagcctccaaagtgctgggattacaggggtgagccactgcacctggcctgctttctgttcgtatgtgtgtgtgtgtgtgtgtgtgtgtgtgtgtgtgtgtgtgtgaaaagtgtctatttgagtcttttgtccaattttcaaaaactggattgtttatcttacggagttgtaacaaagagttctttatgtgttctggataggattctcctgtcagccatgtgatttgcaaatattttctcccagtctggcttgtcttttaattttcttaatggtgtttcttttgaagagcaaaagttttgaattttgacgaagtctcatttactgctttttaagtggatactgcttttggagttatgtttaagaaatcttgggcccaggcatggtggctcacgcctgtaatcccagcactttgggaggccaaggtgggcggatcatgaggtaaagagattgagaccatcctggccaacatggtgaaaccccatctctactaaaaatacaaaaattagctgggcgtggtggcacacacctgtagtcccagctgctcaggaggctgaggcaggagaattgtttgaacccgggaggcgggggttgcagtgagcctagatcgcgccactgcactccagcctggtgaaagagcgagacaccgtctcaaaaaaaaaaaaaaaatcatacaggcggctgggtgtggtggttcatgcctgtcatctcagcattttgggaggctgaggtgggcggatcacctgaggtcaggagttcgagaccagcctggccaacaaggtgaaacctcgtctctactaaaaatacaaaaatgagctggacgcaatggcgcacgcccgtaatcccagctactcaggaggctgagtcaggagaattgcttgaacctgggaggtggagttgggttgcagtgagccaagatcatgccactgcactgcagcctgggcaaacagtgagacaccatctcaaaaaaaaaaaaaaaaaaaaagcgcaggtgcagtggctcgcgcctgtaatcctagcactttgggagactgagatgggtggattgcctgagctcaggagtttgagaccagcctgggcaacatggtgaaactccatgtctcctaaaatacaaaaaattagttgggtgtggcagcatgtgcctgtagtcccagctaattgggaggccgaggcagaagaatcgctggaacccggagcgcggcagaggttgcagtgagccgagattatgccactgcactccagcctgagcgacagagtgagacgccgtctcaaaaaaaaaaaaacaaatagaaagaaaagaaatctttgcctaggtcaaggtcacaaagattttctcctatttttttctagcattttgttgttgttgttgttgttggttttttttgagatggagtctccctctgtcacccaggctggagtgtagtggcatgatcttagctcactgcagcctctgcccgggttccagcgattcttctacctcagcctactgagtagctgagattacaggtgcgagccaccacgcccggctaatttttggattttttagtagagacggggttttcaccatattggccaggctgatctcaaactgaccttgtgatctgcctgccttggcctcccagattgctgggattacaggcgtgagccgctgtgcccggccttttctagaagttttatagttttagctcttacatttaggtctttgatccatttagagttaattcttttttttttttttttttttaattttgagatagggtcttactctgtcattcaggctagagtatagcggcatgatgtcactctagccttgacttcctggctcaggtgattctcccacctcagcctcccaagtagctgggttttcccagctatgtatgtgtaccactatgcccagcaaagtttttgtattttttttgtagagacagggtttcaccgtgttgtccaggctggcctcaaagtcctggactcaagcaatctgcccaccttggccttccagagtgctgggattacaggtgtgagccgctgtagctgaccaaattaatttgtttcacttatggcttgagataaagatctaaaccccccttttttgtggatggaattcaattattttagtatcatttgttgtagagactatcatcttcccatcaaattgcctttgcacctttgtcaaaaattagttgacctaagccaggcattgtggctggataacaaagcaagaccatgtctcttaaaaatcaaaacaacagcgacaagaaccccaccagttaaccatgaatgtgagggtttattttgggactctccattctgttccattgatttatgtgtgtcccagaagttctcaactggggcatttttgccctctcaagggacatttggccatgtctggagacatttgtgattgtcacagctgggggcatctgttgggtagaggccacaggacagtcccccacaattaagaataaatcggcccagaatatccatagtgcttagactgagaaatcctggtctgttcttagaccagcagcacactggcttgtttacagtagtttgatagtaagttgtgaaatcaggtagcataagttctccaactttgttctctttcaaaattgttttggttatgctaagttctttgcatttccatatacattttataattagcctgtcaattatttctacaaaagcagcctgcaattttgataagtattacattggatatataaatctatgtggtgagaattgctgtctttacagtgctgactctgggaatccatgaacatggtatatctctacattaattttgatatttagcttctcagttgtttttttttttcagataactttacctatttaaggcaagtgatatttgccaatctattactgatatattgccttcccaatctagtagtgataaaaaatttccttttttttttttttttttttttttgagatggagtcttgctcttgtcacccaggctggagggcaatggcgcaatcttgactcactccaacctctgcctcgcaggttcaagtgattctctcctgcctcagcctcctgtgttgctgggactacaggtgcatgccaccacgcccagctaatttttgtatttttagtagagatgggtttcaccatgttggcagggatggtcttgatctattgaccttttgacccgcctacctcagcctccggaagagctggtattacaggcatgagccactgcgcccggctattcttaataacagttttgttgagatctaattcacagcatacgagtcacactgagaacatctagtccagtggttttttttgtttgtttgtttgtttttgagacggagtcttgctctgtcgcccaggctggagtgcagtggcgcaatctctgctcactgcaagctctgcctcccgggttcacgccattctcctgtctcagcctcctgagtagctgggactacaggcacccgccactacgtctggctaatttttttgtatttttagtggagatgtggtttcaccgtgttagccaggatggtctcgatctcctgacctcttgatccgcccgtctcggcctcccaaaatgcggggattacaggcatgagccaccgtgccgggaccagtggtttttggtatacttgtgttgtgcagccatcaccactgtctaattccagaacatcttcatcacaccaaaaagaaacccagtggccatgaaacagtcactcacggccaggcgtggtggctcacatttgtaatcccagcactttgggaggccagggcaggcagattacttgagctcagaagtttgagaccaccctgggcaacacggcaaaaccttgtctctacaaaaaataaaaaaattatctgggtgtggtggcgtccacctttagtcctagctacctggtgggctgaggtgggaggattgcttgagctcaggaggtcgaggctgcagtgagctatgattgccccactgtactccagcctgggcagcagagtgagactctgtctctaaagaataaattaataaaatttggccgggtgcagtggctcacacctgtaatcctagtactttgggaggctgaggcgggtggaccatttgaggttaggagtttgagagcagcctggccagcatggtaaaaccccacctctattaaaaatccaaaaaattagctggacgtggtggtgggtgcccataatcccagctactcaggaggctgaggcaggagaactgctttaaaccaggaagcagagcttgcagtgagctgagatcacgccactgcattccagcctgggcaacagtgcccaggctttatttattgaaaaattaataaaaattggctgggtgccgtggctcacacctgtaatctcagcactttgggaggccaaggcgggtggatcacctgaggtcggaggtttgagaccagactgaccaagatggagaagccccatctctactaaaaatacaaaatgagctgggcgtggtggtacgtgcctgtaatcccagctactcgggaggctgaggcaggagaatcacttgaacccaggaggcagaggttgcagtgagccgaggtcgtgccattgcactccagcctgggcaactagagcaaaactctgtctcaaaaaatatatctatcaataaaaaaaattattattattattattgagacggagtctcactctttctcccaggccggactgcagtggtgctatctcggctcactgcaagctctgcctcccgggttcacgccattctcctgcctcagcctcccgagtagctgggactgcaggcgcccgccaccgcgcccggccaattttttgtattattagtagagacggggtttcaccgtgttagccaggatggtctccatctcctgacctcgtgataaaaatttttttaaaaagggcttgggtttcatagtaggatgcatttgaaggtaaaagcaatcctaacaggctgtgaaaattgcagctgccattgggggcaaccctgtaggcgtgtggtgggaggagcactagcttcagagtcctgggctgatggtagcccctcctgtgccagtgacttcctcagtggccttggccagtgttttgctcaatggggccccaggtttccctggctgagccctgggggtcacctctgattccctgggcccctttcaggtctggctgccagtccatgtgagccagcagggagggacaggccctggccctcgcccagcccagcccagcttttgtttttcatgatgcccagaagttttctggaaaatgttctgtatttcctggatgaccctgaagtggtgaccactcctgcctgcccacctcccagacccggtgccgcctgggtccgacattgcctggctttccccgcgcccttccgctgtgtcccgtgaggctctctagctttgcgctttggggtcatcttgtccagtggacgacggcgtggtgtcgtctgcaccatccctgcagtgcctgacttgtgctcgctgaacagctgtagaattacccggagctcagccctttgctgcgccctaggaggggctggaagaggagcggcctgtgtccctctgcttgtttgtggagaagctgacctggagcagtgttggaggggtccctggatcctgagcgagtgttcggtcatttgcctttccatagacctgggcgaagaagcgagaggtttgaggagtgactgaaatcaagacctgaggccgttagaagaaacaccgtttgctcagtcctttcatccagctcgcgggggacttgggtcctctcacgtggtcttgggtatgtggcctcagcggggcctggcatccctgaggtgggcagaaggttgcattggctccccagggctcagcactggcgccactgctcacataactgaagctttcttctaacagggctctcgccccgcggaacagatgctctctgtgatgtctctgagagcccagactcccagggagccttctggggaatcgaaagaaagaaaagattgcttcagtgctttggggaaaaagtgtgtgtgtacatatactgcacatagacattaaaaatcagaggctgggggctggctgcaggggctcacgcctgtaatcccagcactttgggaggctgaggcaggcggatcacttgaggtcaggagtttgaggccagcctggccaacatggcaaaaccctatctctactaaaaatccaaaaaaaaaaatagccaagtgtggtggtgcacacctgtaatcccagctgctcaggtggctgaggtgggagaatctcttgaaaccaggaggtggagttcacagtgagccaagattgcgccactgcactccaccctgggtgacagagtgagaccctgtctctaaataaattaataagtcaaataaaaaataataaattgaggctaacatattcttttttttttctttttttcgagacagagtcttgctctgtcgcccaggctggagtgtagtggcatgatcttagctcactgcaacctctgcctcctgggttcgagcaatcctccttcagcctctggagtagctgggattacaggtgtgggccaccacacccagctaacttttttttctttttttttgagacagagtctcgcactgtcatccaggctggtgtgcagtggcgcaatattggctcactgcaacctccacctcccaggtttaagcgactctcccgccaaagcctcccgagtagctgggattacaggtgcccactaccacgcccagctaatttttttttttttttttttgtatatttagtggagatgtggtttcaccatgttggccaggctggtcttgaactcctgaccttgtgatctgcctgcctcagcctccagaagtgctgggattacagatgtgactaccgtgcccggcctcagctaacttttgtattttctgttttttttttttaagtagagacagggtttcaccatgttggtcaggctggtcttgaactcttgacctcaggtgatccacctgcctcggcctctgcaagtgctgggattacaggcatgagccactgggcctggccaaggctagcatacatttaggaaatgtacagctcattaatgtgcagtttgataaatgatcacaaaatgaacatgttgagaaaaatagagcagtaccggcccccagaggccccctattgtccccttctgaacaacctgcctcccccttcttccctgggaaccacccccctgacttcctccctgggtgacttctgcttgggtttgagcttgaaagaactggaaggaggcgctcttcttgctccacctcaggatgagatgggatgcaatggccgggcggggtttgtgagcagtgagtgatctggcgtctgctgtgggaccttccagcgtcccagtgctgcccgtggacgggctccgggggagctggggacatccttgtgtctggcggtggtgcccttgagcctgatctctttgggtgcgtttttatgcctggagtggacttgttggggctgttgggtgcattcagccttcgtagattttaaacttttaggagtgaacgaatttgcatgtctgcaggcaagaacaagggtgttggtcgctctgcattcatactggcactaggtagggtgaggggtgtgtgctatttttaattttttttcaattccaccttgaatttctcattgtacttttccctgatgaccagtgaggttgagcgcctttctctatgcgaattggccatctgtttcttgtcctgctgttgaagtgccttgtgaagtcttttacacattaaaacaattgagtggccaggctcagtggctcacacctgtaatcccagcactttgggaggccgagacgggcagatcacaaggtcaggagatcgagaccatcctggctaacatggtaaaaccccgtctctactaaaaatacaaacaattagcagggcacggtggcgtgcgcctgtagtcccagctacttgggaggctgaggcaggagaatggcgtgaacctgggaggtggagcttgcagtgagtcaagattgcgccactgcacgccagcccgggcgacagagcaagactccatctcaaaaaaaaaaaaaaaaaaaaaaattgagtggccaggttcagtggctcacacctgtaattctagcactttgggaggctgaggcgggcagatcacctcaggtcaggagttgaagaccagcccggccaacatggtgaaaccccgtctctactaaaaattcaaaaattagctgggcatggtgttgggtgcctgtaatcctagctcctggggaggctgaggcaggagaatcgcttgaacctgggagatggaggttacagtgagccaagatcgcgccattgcactccagcctgagcgacagagtgagactgtctcaaagaaaaaaacaaaaaaaaaattgagttatctttttttcttactggtttataggagctctttcctaagtgctttttattatggttttaattctttggaaattggccgccttagtgccgtttatggaagctagcccaggcaagaaatggagtgtattgaaggctccgagggaagtcccagtaacctcaggggaaacggacaagtggaagctgcgggaacccagagcctctgttcggctccagcctcagcgccatcctgcagtcctgcagagcgccccagctgctccggcgtgtgtgaggccatcgccacccaccaggctggtcaagggccaagtgctgccgtcgtccctggtcccattccacaggagggagaattcggatggcccagtgtgccagtgtccaccttagggccaaccagccctgtctagggggtgggggccaccctgagggtggtggaggctgtttccagaaaaggggaggacacacccccaacaaaaaaggtgactacagcttatgccccctccgtgccccagcgtctttgcttagtcagagttgttctcagctttgtgttccgcactggaagccagagccctgtatttaatatggtatcacgtttacatatgggaggtccgaaagggacttctagccagtgtgttcacacctgccggaggctcctttgtgttaattggcattttttatcctcaggacgtcctgagtttagggtggccctctcatctcaagtttgcagttaaagaaatcaaggttgggtgtggtggctccctgtaatcccagcactttgggaggccgaggcgggtggattacgaggtcaggagtttgagaccagcctgaccaacatggtgaaactccgtctctactaaaaatacagaaaattgctgggcgtggtggcgggtgcctgtaatctcagctatttggaaggctgaggcaggagaatcacctgaacccgggaggcagaggttgcagtgagccgtgatcgtaccactgcactccagcctgggtgacagagcgagagtccgtctcaaaaaaaaaaataaataaatatctcagcccatgttgacttccccagctgggtgggggactggtagtaggcagggaagcatggtaggcccagggggatcaatgcgtgggtgatacagctgggtgggacccccagagcactcgaaggctgtggggctgccaccccctctggcctcccacctggtgggggcatcctgggacctgatcttgtgcaggtctggcccacctggggtttattggcaatgcagcagctgattttgtgagactggtaagcaggaacacctgtcctgttagaacacgaggagaattttcagcaggtggaatcagtgagctgttcggagcccctgcagacacctcgtggccttcccactcccccttcctcgggtgggaacgatggctgaggcagcccagtgaagtccacccctggtgtcccgggtccctgggccgctgtgtttcttaggaggcagacatgctgggtgtcttcattcacatcctggcttacttcccatggctgacagtgcaggctctggagtctgcccaggggtcccagtgagaatgtctctcactggttgtgtgacctgagcaggtcactcagcctcaccgggccagtttccctgactgtcaaacaccagtaacaacagcatctgctttcattcattaggtgagtgttcatccagctcttaggcatggagcggggaggtcatgaggatgcggggccgtggacagttgaggatgatgcctacttttgggctggggaggacagagggaaccaacaggtacacgagataaagcagcagtgacactatgaggagaatggcggcgggagcgttgaccacgagctggcagttggcctgcgtggtggtccaggctggcctcaccgcggcatcccaaggagggaatagcccaggccgggaaggtggggcggggtgggcagggcatgtggaatcactggtctgcagagcggggagcttggccatggccttcaggtcagggtgcagcaaccttcaccattgggcatcattaggctgggggcatctggaaggtcaggaggaagcctgggctacctaggatggaacaggcaggacagttgtctccaaggcctgcctatgacttgggcatcctgtccccagatgcacagcgtctgccccctcggtgcgggaggatgaggaacgcctgcctgtggatccacacatggtccccgtattgggggtgtggaggaaaggcctttctgacatgatctgagcccggcctctttctcttaggggtgtaccagggttggtgggtttggaggcaaatgcatttcaagggtccagatcacgaacctctgacccggtgggccctgaactctggtctgataaacatgggtcagacttctccctgaaaactgtgagcgtggagttcaggcacaggcaggcggggcaggtgctttcaggcttgatagcaagaccctactttactcatctgccctccacgctccgcggctccgacggtgtttgctgcggctcctctgctgcgttgagtccgtctgtgcactcagatggcctgtgcttcgcctttcgcccgcgttcttgggaggccttgccgcgtcccgggcctcccgcccttccaaggttggcttgtttcagtgattcggaatgtccctgttttcctctcgcagatgtctggtggcgttcattgcacactgtgtaccacaagatattgacaaggtgcaagagacacaagacgggcccagaaggcttcttggctcactctgtggcctgtatggaagggacagggctgtccccctcccctggccatccccaagacagcctctgacctgtggccttgtggttttggtttttctcagctgtagagatgacaaacgtatgtatcctcctgcctggaggcatgtgtggagagcattgaggctgttcggggaatgcctcgaggcctcccacggaagggattttgcagttttcatttctgtggctgttgtctccctgtgcaggttgcccggacacctgcaagccacccagagtccgaatccctcgggcagggaggcagtgaactgctgggctccagtccccctgggggtgacagtaaaccaggggagaaggatgcctttgttttagtggtgttcgaggactgccctgaggccctgggtccttgagtgtgttggttccacatagccgggatttccaggacaaccttgggaccctgtggcgtctgtcgggctctgtgagcccacaggaggattttcagccattctgctggggaagccccttgggtgtggttttttgtgtgtgaacagtgcccattgtcactggcgatgacaccactgactcctgtccccgtggtcccccggctgcaggaggggaggtgcccagcacagagactgagaaacaagtgggctctggagtcggggtgtgcgccccagctccaccgctgatgagcttgggggccttagccaagcttcgtttcctgtatgtttgaaagtgtgggccttgtctgcccctctttccttggggccagcgggaaagggggtgaaggcgctgacctcagcaggtgtggagggagagcctggtgggtgtggttccacctgcgttctttcacctccacagctgccttcccacttcccactcacagtctccttttctttttcctccacccccttggcagcgctgcctgctcctcttggtcctgagctggtgcacatacaaatgtacacagctcatgcacgcacacaccacatgtgtgtcattcttcttgaggcaaaggaaagggcggccccgcccctaacacttccccaggcctggtcccttcctcctgccccatcagggacctagggtctccttcccgtgtttcttctccatgtgtggatacccatgtgtgagcaataggattttttttttgttttttggagacagagtcacgctgttgcttgggctggagtgcagtggcccaggggcccaatcatagctcactgcaacctcaaattgctgggctcgcatggtccttctgcctcagcctcttgagtggctggtactacaggcacataccactgtgcctggctactttttttttttttttttttaagacagcgttttgctcttgttgccccaggctggagtgcagtggtgcagtctcggctgaccgcaacctctgcctcccaggttcaagtgattctcctgccttagcctcctgagtagatgggattacaggcacccaccaccatgcccagctaattttgcatttttagtagagacgggagtttctccatgttggtcaggctggtctcgaactcccaacctcaggtgattcgcctgcctcggcctcccaaagtgctgggattacagatgtgagccactgcgcctggccactttttgtattttttgtagagacagggtctcgccatgtcgcccaggctggtctgaaattcgtggcttcaagccatcttgcccaccttggcctcctaaagtgctgggattataggcgtgagccccctcggctggcctggattctctgtgaggtgtttccagttcttcccagttggtctcgtctcctgcaggtgtgagttgttgattgtctgcgccgtgttgatcacgtagaccctgttcttgagtgctgagggtccatccggtaaccctgcactgtcatgcatttccctgtcagcatatgacttggttccttttttttttttttttttaaaaaagaccgtcttgctctttcgcccaggctggagtgcagtggcgcgatttcagctcgctgcaacctctgcctcttgggttcgagagattctcctgtctcagcctcccgagtagtggggattacaggcatgagctaatttttgtatttttatttatttatttatttttgaaacggagtcgtcttctgtcacccaggctggagttcaatggtgtgatctccgctcacggtaaccttcgtctcctgagttcaagcgattctcctgcctcagccttctgagtagctgggattacaggcatgcaccaccacggccagctaatttgtgtgtgtgtgtgtgtgtgtgtgtgtgtgtgtgtttttagtagagatgggggtttcaccttgttgccagactggtcttaaactcctgaccttgtgatccgcccgcctcggcctcccaaagtgctgggattacaggcgtgagccaccgcacccggccctaatttttgtatttttagtagaaacagactttcccatgttggccaggctggtcttcaactcctgacggcagacctcaagtgatttgcctgccctggcctcccaaagtgctgggattacaggggtgagcaccgtgcctggtgggttataatttttaacgcttgaattttttttttttttttgttaaagggtctggctctgttgcctaggctataatgcagtggcttgatcagggttcactgcagccttgacctcccaggctcaagtgatccttccacctcagcctcccgagtaccttggactgcaagtacgcatcaccgtgctagctaattttttttgttttgttttgttttgagacagtcccactctgtcacccaggctagagtgaagtggcacaatctcagctcactgcagcctctgcctcccaagttcaagcgattctcgtgcctcagcctcctaagtagctgggactataggcacacaccaccatgcctggctaatttttgtatttttagtagagatgggatttcgccatgttggccaggctggtctcaatctcgatctcctgaccttgtgatccactcctctcggcctcccagagcactgggattataggcacgagccactgagcctggactaatttttgtatttttggcagagatggggttttgccatgttgtccaggcaggtctcgaactgctgggctcaagtgaacctcccaccttggcctcccaaagtggtaggattacaggcgtgagctactgtacccggccttgcttgatttttttttttttttttttttctgagacagagtctccctcactgcaacctccgcttcctgggttcaaggaattctcctgcctcagcccctcccaagtacctgggactacaggcgcgtgccaccacacctggctaattttttgtattttttagtagagacggggtttcaccgtgttagccaggatggtctccatctcctgacctcgtgatccacctgccttggcctcccaaagtgctgggattacacgcgtgagtcaccgcgcctggcaaaaatcttgtattgatcatattgtgtgtctgcaaccaaaatatgcgcaccaattgaaattagaattttaaataattttacatcataagctgtgagtttttcgtgttttgaatggccattactaatacccaattgatcaaacaaatattccagtttttatcaataacaagaagaaatacgaaaaaacattggaaatatgtctcttgagtagatgggttcctttttctcctggttaattcatgcattcacagttggatacaagctgttgctaaaatgatttcagcctcaatgctagttttttttgtttgtttgttttttttgagatggagtctcgctctgttgcccaggctggagtggagtgaggtggtgcaatctcggctccctgcaacctctgcctcccagatgcaagcaattctgctgtcttggcctcctgagtagttgggattacaggcatgtactaccactcccggctaatttttttttgttttgttttgtatttttagtagagatggggttttaccatgttggccaggctggtctagaactccttacctcaagtgatccacccccctcagcctcccaaagtgctgggtttacaggtgttagccaccgtgcttggacccctcaattaccagtttttttttttttttttttttgatggagtttcactcttgttgtccaggctggagtggacagctggcccaatctcagctcacggcaacctctgcctcccaggttcaagcgattttcctgcctcagcctcccaagtagctgggattacaggcacacaccaccacgcctgggtaattttgtatttttagtagagacagggtttctccattatggtcaggctggtctccaactcctgacctcaggtgatccacccaccttggcctcccaaagtgctggaattacaggtgtgagccactgcacctgggttctgttttttaagttgagaaaccttgataacatcaattagataggaattagcaagatttttatgtaacaatagcatctatttccaagttacttcacaaaaattgacataaaaacctagtacaaaaattaatgattcatcacctcacaacttacgtccttccagttaagtttttttgaggtaaaattcacttaccatggggacacctttttaaagtgtacaagtcagtgatttttggtatattcagtcatgcaaccattaccttgatctaattctagaacatggtcccagttttgtgatattacaaccattgctttaacaaacactcttcttccttgtctctaatcttttaaaaataatttttcttgttttacaaatgatatatgttaattgtagaaaacttaattttaaaaagataaaggaaaaaattaataatcacttattacctatgcaggtgttttagtttgtagcatttgtttctctgaagttatttatatgtatatatgcgtgtgcatatatatatagagtgagagttggcgggggtgggggtggtggtggggggacgggaagagagacagggtcttgctctgttgcccaggctggagtgcagtgtggtgtgatcatggcttactgcagcctcgaactcttggactcaagcgatcttcctgcctcagtgagtgtcctgagtagctaggactacaggcatgcgctgccatgcccagctaatttttaagaattttttgtagagacagcgtctccctatgttgcccaggctggtcttgaactctggggctcgagcgatcctcctgccttgatcttccaaagcgcccaggcatgaaccactggcccagcttaattactttctctgaagttattgaagcttaaaactacatacagtaagatcttagagcctccagcctagaacaccaggctgaaaagtgctgtggagaagaataaggctggaaaggggagtggaaagattggttggcaagctggggtgtgggaggcttggcaagttgtaaaaggggtgtcagaagaggcctcgtggagagagcagcctgaggtagagctggagctccagggaagagctggatgagctgaggactccagggccccgaggtgtgagtgggccggggctggcagagtggccttgtctggggcctcggaggctactgggacctgccccagtgtggctgggacgccagcagagttttgagggcagtgggtccagaaacaacagacctggggacccaggggatgtggggaggctggtgaatgggcacagtcacagggcagatggtgccagaggctctaaccagtgctgtggttgtagaaatgaaatcgaattgggagtcaggagaggagaaatgacagtcacgtagaccacgtctcagaaagactcgacgtctctttctgggtgactccttcagagtgtagtggcttagcacagtgagcacttcctaccttacggtgagggtcgggattgggagcggctccgtcggggggctctggctcaccatcactcgtgagtcctcactcaggctgtgtcacggtggctcacgcctgtaatcccagcactttgggaggcaaaggtgggaggattgcttgtgcccagcagtttgagaccagcctgggtagcatagtgagaccccatgtctacaaaaaataaacaaaaatgagccagacattgtgcacactgtgatcccagctacttgggaggctgaggcaggaggattgtttgagctcaggaggtccaaggctgcagtgatcgtgcccctgcactccaacctcggcgacagagcaagaccctgtctcaaaaaaaaaaaaagctgtgggtgggctgtggtcctctgagggcttgcctgggcatggaggggctgcctccctggctcacaggcccggcatgccggtgctgggtttagcgggaggcctcaggtcctcccctcgggacctctccatggggctgcttgggtgtcctcacagcatggtggcagcttcccccagagccttagaagccacacaccatcattttcatgcagtctctgtggtcatcatttcatgcggtcacctggtcagccctgttcagtgtgggtgcagtctgcccagagacatgtcggccgggaggtgagatgcgctgggggccctcgtggaggctggccacctcgctcatcttctgcctacagcgggggcttcttggacacaaagtggttgtgccttgaaggtgccctgggaggaggttggagcaggaggcttctggaccagggacctgtctcctgcctggggccatggagtgcccagtgcctcggcctggaaggcctggcagggacaagcccgctcctgagtgtccctccagaccaaggctgcccggccttctggaccccacctcagtacgtcagcgctggggagagcctggaagggtgggggctgatcactgctaagggtgcccccgacgatgggtcctgggctggtcagcagggtcactgggcttcccacaccctcttgccgtgctgctgtggcccttgtctgccagcagctagtgcgggggttcccagcagccgagtccttcatgtggttttcatgaacatggtgcacatcttggaggagcaggcaggtggctctgggccgggccctgtctcagccctgctccatgactggggcttgaggttggtctgaggccagcatccggagaccaccgtgccctgaggcacggggtgccttgtggcccctggccccgccccgtaggctgtgtggaaaattcacctttaaagactttgtgtatttcaatgtggtggggctatgttcaaggcccaggtaatcagggaaggcatcctgggctcactgtactgcaggtgttctttctttcttttgatttaaaaccaccacataggctttgctccacccctcgtctgctctgcaccaatttccctggcagccttgtgggcgtgtccttccagaacattctctgtgtattcacaatttgtgttgcgcacatctcagtgcgtgcggtgacccctcagaaaatgatcttgcagtgtgttaacttgttttctttaacctgcaaatactctgtgactcgctccacatcggtatgtctggatcagcttggttccagcagctgtgtggtgggccataaaatcagggcgtcccacttgctgaagcagttgccgctttcttctttgtttttggtcgtcatcagctctcagtggtccctgttctgcatgctgggttaggtggggctgcggctcccaaccactgttcctggcagtcagcagccatgctgggcacctggctctgggccacctccctcaggaggagcaccctggaatcactgttggggcccggctggtcttggtggccgtggctgtgccaactgtaactggggccgtggttctcgggaaggacacagaccatgcagcgcctgaaggtctcagaattcccgctgaaggccccgggaagggcccacctggcctcaggtgggaattctgagaaggaatagggattctggggcccccagtgggaattctgagaattcccagaagtccctgcaatacgtgaggttgaggaccatgtattctgagcatccttgaaatccacaggtccctgcagctacccgggtcctcccctcggagactcttcccgtggtcacccggctcctcctcccggggactcttcccgtggtcacccggctcctcctcccgcgggctcttcccgtggtcacccggctcctcctctcggggactcttcccgtggtcacccggctcctcctcccggggactcttcccgtggtcacccgggtcctcctcccgggggctcttcccgtggtcacccggctcctcctctcggggactcttcccgtggtcacctggctcctcctcccgggggctcttcccgtggtcacccgggggctcctcccggggctcttcccgtggtcacccgggtcctcctcccgggggctcttcccgtggtcacccgggtcctcctcccggggctcttcccgtggtcacccgggtcctcctcccgggactcttcccgtggtcacccggctcctcctcccggggactcttcccgtggtcacccgggtcctcctcccgggggctcttcccgtggtcacccggctcctcctctcggggactcttcccgtggtcacccggctcctcctcccggggctcttcccgtggtcacccgggtcctcctcccggggctcttcccgtggtcacccgggtcctcctcccggggctcttcccgtggtcacccggctcctcctctcggggactcttcccgtggtcacccggctcctcctctcggggactcttcccgtggtcacccgggtcctcctctccggggctgtgtgccaggagaaatggggctggatctgggcgtcaggtcaggaatccaggggagaggccatgctctcagtgttccttggcagggctgtgagcgcaggtctctgaggatgcccagctgtccatcccctcctcataggagaagcgcagatctcatgcctaagtgtgccagggtcctgatgggcgccacctacagcctcccgccctcacgcgggagtcagactgaacgaactagcccagatccacagagacttctaaacccggctgggtgctgccatggaaagtacacagggctcagatttgggggtaaggtgacttagcctggggtcacgaaatgtgtaaggatttcttggggtggctgtgacaaatgacctctaaccgtggcttgaaacagcagaaatgtattctctcaccatcacagaggcacacgtcagaaaccgaggtgccagcagggccacggtccccgaaggcgctgggggaggactcttccttacctctccccactcctggggccccaggcactcattgtcatccctgggcttgtggccgcatcactgcaatctcttgcctccatctcttcccttggccttcccttcaagtctgcgtccaaacctccctctcctttcttctgttaagaaccagtcactggatttagagcccctcaatccagtatgacctcctcttaacttgattacatctgcaaagaccctagatccaaataaggtcacatgcacaggtaggggctgggtgtggagtaggacccgaacttcatcggaaacacagctcaggccactacagaagaaagtggtgttggagctggatgctggctgatgggctgggagcagcgaggagccgtccagggaagggtgttgaggctggcagtgtggagaggccaggaggccaccttggaaggcccgaggccaggtggccgaggcagagggtatgaggggcacccgctggcctgtctgcatcagctcccctcaggtggagcctttctcagggccgagcttcttggccgtcagatgttcccaccaggctgtgttcagcctcagagtcgataactgtttccaggctgggcgccgtggctcatacctgtaatcccagaaccttgggaggctgaggcgggcggattacctgaggccgggcattggagaccatcctggccaatatggtgaaaccccgtctccactaagaatacaaaaatcagctgggcgtggtggtgggtgccggtaatcccagctactcgggaggctgaggcagaagaatcgcttgaacccggtgggcggagcttgcagtgagctgagatagcgccactgcactccagcctgggtggagcgccactgcactctagcctgagactctgtctcaaaaaaaaaaaaaaaaaatctataatcgtgtttccttttttaaacaggaaactactttgcttcgcactttttcatgggaggagagaaattcgacaccccccaccctgaaggttacctctttggagagaacatggatctgaacttcctgggcagccgcccggtccaggtgggtctggacagggctgtctcatggggctgtgggggtgggaggcccctgtccccagcagtccgcatcccagccatgagggcaagcaggcaccaaatcacccctaaagggggcagagctcctggcaggattccagttgagcttgggtgtgggcacgtgccctggaatgggttgtgtcctggtgctgccccctagaggccagatggccaggggcaggtcactgagaaacagagcagccatactgaatgggtgcgtctgggctgcaacggctgcggaacatggtggatttgattccagccttcttggatgactttctttacaaggcaaaaatagtatttacagactgggcattgtggctcacgcctgtaatcccagcacttggggaggctgaggcgggcagatcacctgaggtcaggagtttgagacaagcctggccaaaatggtgaaaccccgtctctactgaaaaaaaagaaaaattagccgggtgtggtggcacgtgcctgtaatcccaactactcgggaggctgaggcaggagaatcacttgaatctgagaggcggaggtggcagtgagccgagattgcaccactacactccagactgggcaacaaagggagactgtctcaaagaaaaaaaaaaaaaagaatatttactttccctagaacagtgggcaagagacatggtccaaaggagagatgcagacagctggctaacatcttcccctcgttgccagagaagggcacattcgagtactgtcatagtactcgagtactgtgagctgtctgttcagcacacatgtggcacctgctgcgtgcctagtgctcttccagggcttggggtgaaagcagaccctgcctctgctacctggtgggggcgtagacaattaatacgggacaaatgggtagaagagagaaggggcagaaagggaggctctactggagaggccatggctgaaccaagccatgataggtgggaagggggcccctccagaagaagctagaaggcagggggcctgggaacagaggaagaggtgagagggtgcaggcctcaggggacaggaggccggaagagccagtaaactttgggggccctggggcgggttgctgagctgtgctcgtaggaagctttggggatggaaagggtggggactgaggaaggggctgagggtgctcggggcagtgatggatatgggaagcctgggagagcaggttggggatgggcagccccagcgtgcaggggtctggcgttgaggctgcctggctggatttgctcagggtgatttggtcctggccgttgcgtgtgctggctgcgtggcctgcagcttctacctgtaaatgagaacagtgcacccagtatagcccctcccatgggactagatcccagggataccctctggggctgtggctgctgcaccctgacccgttttctgttgttggctgctcctgagggagtcacctggggccctgtggtttttctcctagtttccctacgtcactcctgccccccacgagcccgtgaagacgctgcggagcctggtgaacatccgcaaagactccctgcggctggtgaggtaacttcaccctgcccctggggaccctgtggctctgtggggcgcagcctgtggtggaggttctggcttgatgcttgaggaaaagggcaggcgggaggggccccagtttctgcgccctcccgtgtggaatgagaggctgtcctgggctgagcgagggaaagggcatgtggaacaagagccgtttagccagggcttctcagctgtgccgcacagggaccctgggcagtgtctggaggcagccaggtggggtgcttggcatctcaggtgggtgccaggggtgctgcagacttcctgccatgcacaggacggcccccccacagacaggaatgacccagcaccagatttcagcaggttcagaaactgcttaaaccgactagacttgaggcatctggggctgtctctgaaccaaaagcacgtaccccgtcttctgtgggcaggaagaaggagaggcaagccctggaccactgggctttcatgtacaaataggaaacagcccctatgtctactggagaagcgggctgtgtccacatagccacctccacggcccctcagcctggcaggggaggaggcagcctccgcagatggggccgctgacccgctgcctttctctccaccgcctggggtaggtacaaagacgatgccgacagccccaccgaggacggcgacaagccccgggtgctctacagcctggagttcaccttcgacgccgatgcccgcgtggccatcaccatctactgccaggcatcggaggagttcctgaacggcagggcagtgtgagtcccgcgggcggctggcaccggcctggctgggggccccagactcctgggggaggcttctgtccaccttactaaccagagggagaaaaccaaaccgtgctctttgaccatactcccaggactttaccacgatgtgaggggtttctcccaccccagggactccccacttttctgcgggaaccagctggggtcctttgactggtttcagttccaacgctgcctggaggtcatgcaacccctgcactttgagggcccagtcccacaagactgccccacttcagatgccactcataagcccccgctgtcacctgaacttctcagcaaccagccataaatcaggctcccacagtcccctcctcaggcttgatgagttgctagtgtggctcacagaacccagggaaacacttggctggtgtttgttggtttattgtaaaggattcagatgaagaggttcacagggtgaggtgtgggggaaggggtggggcgcaccaccttcctcgtattcagcaaaccagaagctctcctgaaaaccccatttcagggccttttctggaggcttcatcacgtaggcaggattgatgattaactccatctccagcccctgtcccctccctggaggatggggctgggctgaaattcagttccaggtttttgttttgtttttgttttgttttgttttgagacgaagcctcactctgctgcccaggctggcgtgcagtggcacaatcttggctcactgcaacctccgcctcccgagttgaagcaattctcctgcctcagcctcctgagtagctgggactacaggcacgtgccaccacgcttggctaatttttgtatttttagtagagatgggggtttcgccatgttggccaggatggtctcaatctcttgacctcatgatctgtccatctcagcctcccaaagtggtttttgtttgtttttgagacagagtttcgctcttgttgcccaggctggagtgcaatggtgtgatcttggctcactgcaacctccgcctcctaggttcaagtgcttctcctgcctcagcctcccgagtagctgggattacaggcatatgctaccatgcctggctaattttgtatttttagtagagacggggtttcatcatgttggtcaggctggtctcaatcgctcgacctcaggtgatccacctgcctcggcctcccaaagtgctgagattacagccgtgagcccccatgcccggcccacctggcccaggtttttgtttgtttttcctcgggagctcttagacgacacttccaagtctctaatcatggcttggtctttctggcagccagccacctccaggagccaagagtcacctcactggcacataagacactcctaccacccgggaaattccaagggtttggagttctgtgttgggagcaaaggtcaaggaacaaatattagaacaaaagaggctcctagcacccctgttgctgaggaaatgacaagggttttagaggactctgtgtcaggaactggggctgggaccaaatatttattttttattgtgtcataattagatatttgtactttcagaggttttatttgagataagggtccttctggccctgaaagtttgaaaactgcaacttcagcaggagctggcaggactgcctccaggctacaagggcacatgtgccccaagtggctttagagacaggcaagagcgtgccccctgccttcctgcactggagcacaccgctcagtggtcagctttgcatctggggatagggtgtggttgagagcctaggctttgaatgctgtccccgctgagtggcttgggggcacatgactgcttgtgcctctgtgtcctcagctggaagttcgggtgggtggtgtgaggaggggaccatgtgtcctgtgcacagcccctcgcgtgacaggtgctcttgaaaggagcctgagtgctcgagttgaggggctggtggagacgacttatgtggggaggttcttagggacctgccaccaggtgaggccgcccttgggctctggccttgggctccccggcagccagggctcctcctgtggagcagcactttggggaggaacaggttcctttttctagactttgttctttgaggctctaccttgccccggcacttgattatatttctttaatgacactagtaatgcatgcctgtgtgctatgacaggcgtcgaattcttgggcgtaggagcatttggagtgaccagggcaggcccctctgtcccctccttgcaccccactgcttggggttgagtgtttgacacccacggggcctggtgccctcctcgggcctggccgacatggtggaggagctgggttgtggcgaggtgtccaggggctgccacagagagggtgtgggctgaggacacaggccagtgtaagttgtctatccgctgccccccagtgctccagctgtcaggggctgggtgaccatctcaagtgcacttgaagagagggtcccgctgctaccagaaaggctagagagagcagagagggtgccctgccagccctggctggtgtcaccctctcctagacccctgcgggctagtgatgagagaaatgccacagtccccccctctcaggacctggcacaaggccagcttcccctcccagcaggaatcacagagcaggaacagctccagtgccactgtccccctctgtcaggacctggtacgaggcctgcttcccctcccagcggggatcacagagcaggaacagctccagtgccactgtccccctctctcaggacctggtacgaggcctgcttcccctcccagcaggcatcacagagcaggaacagctccagtgccactgtccccctctctcaggacgcggtgcaaggccagcttcccctcccagcagggatcacagaaaaggacctggaggctccaggacctggaggctgtgcccaggcacccggacaccatccagcctgccagtgctccatccatttgagctgcagggcaagccaccctccctgcctcctgacaaggaaactgaggctcagacagaggggtgtgtccaggcctccgcatctcacaggagaaggctggggtccacctgagggtggcgtcttaactgtgccttttactgaggctgagcccgggcctcccctgtagtgcctccaaccatgctgggctctggcggccatggcaggcctcttctgcctttgtgtgtacagtggtggcccccccacgccccatcccatttctgagcttggtgtgcctttgtccaggagagcctgtggagccctggccacaggcaagcagggcggtggggtggaggggaggggctgtggattgtgaattgggttcctgcatggagttttatcagaaatgaaactgcttgaggcacctgtcttagggatgcactcgtgcctgtggctaagacatgcagaagggcggtccttgaagcagtgttgggaaaagtgagatgttggtgaccatctgctggtgtcccccaggggccctgactgaatcagtaaaaccaaagcgggacctgtgtggtggttcacaggacacagcccctgatgtgtgcagacgcatgaaagagcagtgttgacgcctaccccgtctgaacgttgaggaagagagacccgcgctgcatgtgggcaccattgtgcctccgccttccgggagtgatctgtgggtctctgctggggcggacagcaggcctctgggagcaggcgtgagggttggggaagatgcattttgcactgtgtatacttaagtactgtgttcatttaaaaagtaaactcaagctgggtgcagtgactcaggcctgtaatcccagcactttgggaggctgaggcaggtgcatcacttgaggtcaggagttcgagaccagcttggccaacatggtgaaaccccatctgtactaaaaataaaatattagcctagcatggtggcgcacacctgtaatcctagctacttgggaagctgaggcaggaggatcacttgaactcagaaggcagaggttgcagtgagctgagatcacaacactgcactccagcccaggcgacagagcgagactcttatctcaaaaataaataaataaataaataaataaataaataaataaataaataaacaaaccaacttagcaccgatggaaaggaaaagcacagctacactggggaggtatcaaagggattgggcaggtgtgggctctgggagaattgtagccaggcctgacctggggagagctgcatggtgagcagagaggccgtggaaggccctggaagggtgagggccacgtggccatgtaggctgtttgctgttccccatgagagagggtccccaaaagacaggtgtctgcggcccttccagctgtcggagtgggagggacgggcacggagggccctcttcctgccgcagcctcactgcttgctcctggctccctgcagatacagccccaagagcccctcgctacagtccgagaccgtccactacaagagaggggtgagccagcagttctccctgccctccttcaagattgacttctcggaatggaaggatgacgaggtaatgctggctgggcggctccttgcccttcgctcctcctgaattctctccccttgggggtggggccagcacagtggggtctgtgtgtttggcttcctccagggttcataagacctgggaacggccgccccagtctgtgctcaggtggacgtgtggatgggcgggagcaaggcctgggccatgtgctgatggggccaggggaccagaggccgaccaggcagccgcactcggaggctcagacactggggtttggggagatgtgaagaatggggcaccccctgccaggctgcagcaatgcagggtctgttcacaccaggtggcattccttcaagctttttaaccttacttttgtttaaaatcttggtgcagacatcctttttttttttttttttttttttttttgagacagtctcgctctgtcgcccaggctgcagtgcagtggcgcgatctcggatcactacaacctctgcctcctgggttcacagcattctgcctcagcctcccgagtggctgggactacaggcgcctgccaccacgcccggctaattttttgtatttttagtagagacggggtttcaccgtgttagccaggatggtcttgatctcctgaccttgtgatccgccggcctcggcctcccaaagtgctgggattacaggtgtgagccaccgtgcccggccattgctgcagacctcttttaaccaggtcttttgtaggttgcggcttgagtggctgctttgctagttgctcctcctaggcccctctccagcttttagtcaaagctgtgtcctccctccttccccctttgccttgttttccagcgtccatctggtctgcagcttgcaaagaccctggtccagggggttcctgtgtaacagtacagaccttgtgtggccgggcgcggtggctcatgcctgtaatcccagcactttgggaggccgaggcaggcggatcacgaggtcaggagatcaagaccatcctggctaacacggtgaaaccccgtctctactaaaaatacaaaaaaattacccgggtgtggtggcgggcgcctgtagtcccacctactggggaggctgaggcaggagaatatcatgaatccaggaggtggagcttgcagtgagccgagatcacgccactgcactccagcctgggcgacagagtgagattccgtctcagaaaaaaaaaaaacaatgtagaccttgtgggtcccaggtctgaggccaggaggagacactgaccacatgccctgctagcaggcctcatgagctgacttacgctggggccagtcctgtggctgtgttcctgacgtttagccactctctgtaaaaagcctcccttgtccttgcattaaaaataaaacaagccaggtgtggtggctctcgcctgtaatcccagcacttcgggaggctgaggtggaaggatcatttgaggccaggagtctgagacaagcctgagtaaaaccttgtctctatgaaaaatacaaaaattagctggatgtggtggtatttgcctgtagtcccagctactgaggaggctgaggtgggaagatcgcctgagcctgggagatggaggctgcagtgagccatgatcgtgccagcgcacttcagcctgggtgacagagcgagaccctgtctcaaaagtaagactacctgggagtgggggaccaccaggttgtctaaggaggggtgaaaaccgaacagatcaaaactcccatgctgatcagtagtgggattgtaccttggaatagccactgcagtccagtctgagccacatagcgagactccatttcttaggaaggtaaaaaaaaaataaaaataaaaataaaataaaagtaaaataaacgtctccccagactccctcgggtgggtggagtctctgtcctctcccggcatcactggcgtggaccctgcaccctgctctcacgtgtgactgtgggtgctgtgtggcgtgtgtgctgagctctggggagtgggagtttgggaggtgtctgtgtttcctgtttgtttcatgtttcctggggtccctccccagcccctctggggagccccagtctccgagccctgtgagccatgggtttgcaggtgaggtggccggggtaggggagtggtcattgtggccagcttcctgaggggtacggtgtttagggcccagagagggttggaatcacgatgcccccagttgtccttacctctgtcccggacttggcactggacccgccagggggcctttggtgagggtttgctgaggaagctgaaggagggcccgcgtgcagcatagtgctggctcgtctgtggatggccacgctgagttggcgcacataaggggcagctgctgctgcggggccttcaaggtgctatccttgtcaggacttttgtggatgcaagtgacagaaaaacatttggtctggtttaagaaaagaaaaccagagacttactggtgtagattcagagaaggctgggtggcctgagatttcttccagggcctgtgtcatcagggtggggatctctgtggcttagcctcccatctccctcagctggccctgctccagcgcgtggccatccggctgggtccggagatgcttggaggccgtgtgtcttctctttgtggccccatttggggcgggggcctcccgtcctgcagccaggccgcagagacctggagtaggagggagacgcttccccgaagagaacctgaggggctcagatgctgggccaggcatggcttagcatcaagagcgcagctgcaaggacaggccacaggggtgcccagcatggctgcactggccttgcccaggagcagagaggacatgtgtggaggggctgggggcccactttcgttctgccgctttttctctctagagtgttaggccagttctgcagctctgtgagcctgggtttgcccctctgtagactggggctggaagcagtccctcgcagggtggccacgaggggtccgtgatcagcatgcaaagggctttacctggagccgcccactgtaaacccgtctgccagccggggagtgggagagaaggctatagccaccatcttgcacgcctccccagaccgttggtttttattccacaccagtaaagcactgtcagcacctagtttctgcagtgtgatgagaaaaaaaatcacagctcactcagaggctcctcagagcacagagcggcccacgccagtgctgaggtgctggctgcgcggatgcattccaggcctgggcagaagcgaaggggtgggcaggggcgcgggggtggatgcgctccagaaagctctgcctcccccgtttggctccatcacctaaaggagtggctgccggtgcgcgaactccccatttccgggcttcatgacagcccttgtggcagcagtgtgggagcgttgccaggcaaccctgggacgatgactcctgtgtggactcagtggagtgggcaggaaacaggctcacaaggggcctacagtcccagcatgatcagccctgacaggccccccagaccggggaagggagtgtccctcactctggcaagcccaggtgtctgtggtatccctcagacggctgggagctggaggcctagctgggtcccagtgggtgtgaacatgtgccccacgtccctgcagccttttatttttccccctttttttgagacaggggctcactctgtctcccaggctggagtgcagtggcacaatcacagcttgccgcagcctcgaactcctgggttaagcgatcctctcacctcaactttcacagtagctgggactacaggtgccacaactactggctgatttttttttttttttggtagagacagagtttctctatgttgcgtaggctggtctcaaactcccgggctccagcaatcctcgtacctcggcctcccagagtgttgggattataggcgtgagccaccacgtcaggcccaccagtctgcagctttctgatgtgtgtggacgttttcacaaagccgtggcccaggattggccgccttggccacctttcgcacccttttctcctgcaccctccagccctctcccggaggaggctgggtcggctcctgttgcctggacacacagggcttcagggtgctggtgttgactgtgtgttctgccagccacagcacttggagctttgtgttaggcacggcttccgttccattttgccaaatggggaaactgaggctcaggtggggttctaattgtagtgaatgggtgaggagctagacttgatgccggcagccttgactctggccctgggccagtgccctgccagctcctggctccacccttcctcactaacagagaccacggcacttctcagccttcacagcatagcccccagcatcagtgtctctgtccacctctgtccatgtgtgcgttgttgtccatcccatgggacttgtggctggaacccctgacccttcctcgtgagatgcggggcctaggtccgtgtggacttggtctccaggcttgtggtttgttcagcagatggctgcctgcccagggcttcttgtgtggatgggttacgtgtgccattcattctggtctgaatggaactcttagctccagatggcaggaagctgcggtagccgtgtgccaggtgcctgtgggtatggagtccctgctgggtggggacatgcctgggaacgccagggtgctgccagcctttgccgtgtgtccatgtccacatagcctccctggttcgcagtcgggtactttcttgacactgatgtttgtccccgtccccttctcctgactgctgtctgtggtccgctgtaactcctttcttctcgtctgtatttttggtaggaaattcgctgtgttgacaaatgttaggaagaaacatttccctcggttccttaaataatagtaatatttggccgggcgcggtggctgacacctgtaatcccagcatttttggaggctgagttagtcggatcactggcggtcaggagttcgagaccagcttggccaacatggtgaaaccccgtctctactaaaaatacaaaaatttagctgggcgtggtggcgggcgcctataatcccagttacttgggaggctgaggcaggagaattgcttgaacccagggggtggaggttgcagcgagccgacatcctgccactgcactccatcctgggtaacagatcaagactctgtctcaaaaaaaaaaaaaaatcataatagtaatactcacaacaactgtagcagccaccacaggcagtgtctctgtgctgggtctgtcgagaggacttcatttgcgctttatccttgaaacccatgcggtagcgtggtattgaccccattttacaaggaaagaagccgaggctcggagggaggagggcctgagatgaaagccaccctggtcactggggtggggacgtgtgcccctgccctgcttccgctgcccacttcacggggggacagcaggggagaggagacatcctatgtgtctgttggttctgagcattgctgttcaggggcgggtgcttggctgcgggctcagggttcccttgtgctgggccaggagtagtcccacctggacatccgtgggggtggttgctgcagacatggaggggcttgtcccttcctcatgggtcttagtcagtgaggcctgtggtcggtcttgggaggcaggaggctctcccctcacccaactgcccttgcctgggctgggcctgccaggcctttcctatttgatgtttcatccatattttgtttttgtttttgagacggagtctcactgtgtcgcccaggctggagtgcagtggtgtgatctcggctcactgcaatctccgcctcccgatttcaagtgattctcctacctcagcctcccgagtagctgggattacaggcatgcgtcaccatgcttggctaatttttgtatttttagtagagacagggtttcaccatattggccaggctggtctcaaactgctgacctcaggtgatccgccacctaggcctcccaaagtgctgggattacaggcgggagccacggcacctggccttgttttttttttttttttttttttttttacacctttattgtgttataattaccatctcctgcagctcactcgtgttaagcgaatgattcgctggcttttagaatgctcacagtggcacagccagcatctgttctttcagtaaatcttcattgagaaataaatgattctttttcttcccagaataaacagatgcatgtgtccattgctgttctgtgccagacaccgaggatgtcatggtgactggagaggcagggtccctgccctctatggagggagtcagggagcctgatggtggccggtggctttcctggttgccagggtatgagcaatagaagcccaggggcgaagtgcttcctgaggcccagagaaggacgtggcctgtagagagtagggcgagacccacagagcagtgctggggagcaggggtctgagaggatggcactgtgctgggctgactgctggggccctgggggccgtggggaagagggtggccttcagcctgtgcacagcagggggtgggatgaacgcaagaggaagcttctctttggactcaagccagcctcgtggtctcccttgcttgccttttgtgtttgctggggccaagtccggtgccttcttcagaaagttacagggagttgcccagtgaccagcacttcccctcagaggcacgcacccgggagaactgaaaacgcggttcaggcagacacttgcgcaccggtgtccagtgcagcgctgctcaccgtagccaggacacaggcccagcccggtgtccgtcgcaaaggaacgcgtgcacagcgtgtggatatccacacagtgcctgttatttggccagaaaaaggaaagcagcaccgatgcgtgctgcaccgtgggtgaactttggaaacatacctagacacagaaggtcacctgttgtgcaattccatgtaaatgacaggtccaaaaatggcaaatccctggagacaggaagcacatggtggctgccgggggctggaggaggggatggggagtgtgtgggtgctgatggctacgtgtggggtttccgtttggggtgatgaaaagttctggaaatggatggtggcggttgcatgacattatagatgtactttactcaacgctgttgaaacgtagttaaaatggcagattttgtgttgtatctgttttaacacacacataaaaaaggtgccaagcctggcatccgccttccctgccatctcgaggcgtgtcctctgagctctgctgctgcctcctgctcctgcctgctttgtccagctcatttgttgaccgactccaggcttccaggcttggctgtgtgggtcctgaccattcttggcaactctctcctcagctgaactttgacctggaccggggcgtgtttccagtagtcatccaggctgtggtggacgaaggagatggtgagtgcgtcctcttccgtcctcctgggcgtgcaggccgtgcagggaggaagcacgtcttgagggaggagtgcttgcagcagtgatgaagcaggccaggcatagggccttgggcttcccacagggcagggtgtgagcagcttggagtcccgggcaggtgaggaggtggaaagtgcaggagggcaggtcccagaacaggctcaggactctatggactctgtgcaggctgagccctcggtgccgcaggcctaccagggtcggggaggtgagatgcctgggtggggcaggccccgactctgactactctgcccctctctccccagcagtggtggaagtgactggccacgcccacgtgctcttggctgcctttgaaaaggtaagtgccatctggccatcactttcccggggacctgggagctgggcagggggtggccttttgagacgagaagcctgagcaggggctggggcttggtggggtggctgagtgtcaagggccccggggcaggttggggcgtgtctgtggcttcctgctttctagcattctggtcctgaggccgagtgccgctgtcaggaggcttagcatttcctttttttttttttttctttcctgagccgggctcactctgtcacccaggctggagttcagtggcgtgatctctctcggctcactgcaacctctgcctcctgggttcaagcgattctcccacctcaacctcccgagtacctgggagtacaggtgtgcactaccacgcctggctaatttttgtatgtttagtagaaacagcgtttcatcatgttggccagactggtctcaaactcctgacctcaagtgatccacctgccacggcctcccagagtgttgggagtacaggcgtgagccacgtgcccggccttttttttttttttttttttgaggcggagtctcaccctgtcatccaggctggagtgcagtggtgggatctgtgttcactgcaacctctgcctcccaggttcaagcgattctcctgcctcagcctccaagtacctgggattacaggcccatgccaccatgcctggccaattttttttttttgagacagagtctcgctcttttgcccaggctggagtgcagtggcatgatcttgtctcactgcagcctacgcctcccgggttcatgccattctcctccctcagcctcccaagcagctggtactacagatgcccgccaccatgcccagctaatttttttgtattttcagtagagacagggtttcactgtgctagccaggatggtctcgatctcctgcctcttgatccacctgcctcggcctcccaaagtgcttggattacaggtgtgagccaccacacctggccatctcttttcttttttttaaacagggtctcgctctgttgcccaggctagagggctgtggtgtgatctcagctcgctgcagccttgacctcctgggcttaaggagatcctcccacttcagcctcccgagtagctgggactataggcatgcaccaccacgtctgtctaacttaaaaaaatttttttgtagagaagaggtctcgctatgttgcccaggctggtctcaaactcctggcctcaagtgatcctcccaccttggccttccaaagtgctgggattacaagcgtgagccaccgtacctggccaagaggcttttcaaagggtacttggagtgtgttgagggagaacattgtagactgaggccagccctgtagaattctgtagagcctgctgccatgccacgggctggggctcccacaaggagggctgtctgcggtagactgccttcgccctggggtgtgcagagatcagcaatgttgttacctcctcgggctgtagctttttcctaccaggctcagtgtccttgggtgtcacctggcacatgtcacagacccccagtcctgctgctccttccgccacctgcctgcggcactctgaccctgcaggctgggcaggccctgcttcctacaggagccttttcctgacaccactcaggacaaacatctgttgttcccacttgatgttcacgagggcagcactgtcctcttgggtgtcttggcatccccagagctgagtttgatgtctggcacagagcagacactcagaacactggcaggatggacgaggggttgctgcccacctggcatgggtttctgctgagaacctggcggaggtggtgggacgcacgcttgtttgatagtgccttggtgcctcggtggccccgcccccagtgtgcactgacgttcatcagcaccctgccgttgcaggtctgcgtggcaccatcctgctgcctaggagtcggagggggaaaggatcccgtgtgacaaggcccagcctgcctgctgcgggcttcacgctgcctctgggtcctgcctagcccaggctctccacccacctccagccccatgtgcagccgcagcccctgagagctctaagtgcagagtccagctcttacctgtgatctgggtctttctagagcaccccagggtcgggggttctgttagctgggtagaggaccctctcctctgtgtgtcctgtggcgaggctgggtctgttctctcccgggtccaggaccacagactgtggtgacacaagtgccctgggcagagggcagccttctgcctttttagtactgggctccccagctgctctccccggcccggactcgtcagaagccacggtgactattgacacatctgcatcctctggcagaggcagatgggacatctctggcaaaatggtctattctgtgcttgaagtacagaacccagtgggaaactgctttatttttggagtccaacattctggaaatttctgttagaacccaccagcctcactggaaaattctgagtgctgatggtggttgactgagaagggataatgagtgttgttgcgaggtctccgatctcaagccgtaattaaccttgttgaactctgagcggtggtgtgtttccctggataccgccgggtgtgcttgttctatttcgttcctgcgtttttagagctttgcggttccctgtgtgtgcaccactgtgcgtgctcccgctctgtctttctaactcagccgggcctgggagagcaggaagctgttttgtctgtcttgattcttgctgccaggtgatacttctcggtgtgcaggaggcccttgtccatcatctgaacttggctgattggcattcagcttgagtgtgcttgagaccaaccgaggagagttgggttctgtgggtcagcagagggtccccgggctgtgtgttctggaggcctcagatagttgcacagccaggcctgaggccgtgttttcagaaatcccggctctttcgctgtcaagtggccccacccttttttttttttttcttttttctttttccagctgtgggcatggattggctggggcagggtggccaacccaggcggccacgcaggggtgctcagaggcgccagcttgaccaccttaacctctttgtctttctcccctgcagcacatggacggcagcttctctgtgaagcctttaaagcagaagcaaattgtaagtcatcagaggaaatatgacgtgcttgaattaaaagacacacatatacaatcactcacacgcatactcatacatagacacacactcatacacacgcacatatactcatacacgctcatacacactcatacacattcacttgcacatatatacggacacacatacataccatcagacactcacattcacacatatatagacacataaacacacagacacacacatacacacataaacacactcctactcgcacacactcatacagacacgacactcatacacacatacactcacactcacatgcagtcattcagatgcacacactcagacacactcatatactcagtcacacacatatacatagacacactcgtacacatacacacatacactcacactcactcacatatacatagacacatactgatacacacacatatacccattcacacacacatagacattcatacacatatacacatacacacacgtatacagacacacactcatacacatacccacacatatactcacacacataaactcacatgtatactcatacacatatacatagacacacattcactcgcacacatatacagacatacatacacacaatcacttgcacacatatacatagacacactcatacaatcactcacgcacatatacaaagacgcatacactcacatagacacacacacatacacatatgtacagacacacatatactcacacacacttatatatagacacacacacacactcttcagtagtcttcatgcactggtcttcctaggctacccttgctgctgcctttgaaataactgtgcaggggctgggcgcagtggctaacgcctgtaatcccagcacttcgggaggccgaggtgggcagatcacttgagcccaggagtttgatatcagcttggccaacatggtgagaccccgtctctactaaaaataaaaaaattaaccgggtataataacacatgcctgtaatctcagcaactcaggaggatgaggtaggagaatggcttgaacccaggaggtggaggttgcagtgagccgagatcatgccactgcactccagcctgggtgacagaggaagactgtgtcaaaaaaaaaaaaaaaaagctgtgcaacagcctgttgacttccctgtagagctctaagctctgggacgacgggtccctgtcttgggtgagcatatatgttttgcgtgcccgccatgtacagggacgcctgcaggccctgagttctgtccagtttgagccattgtgtctggaacatagtgttaagtaaatatttgccgaatggatggatggaaaaggaaggaaagagaccagaaacaaagtctgcaactccttctcctcttccttacaaattgtccaatatgtcagtattggacagagacttagcttgacttcatcaatacttgaaaagaaggattaaatagttgagaataaatggagctatagagcagtacatctgttctctggggtcagcgatcctgggatgctgcattgggaagtgttattcctggtggcctcacaagtaggcaccgagaatttagaggatggggtgccctaaacagcagtgttagatcttgctaatgagatgtcctaggccacagctaacagttactccgtgtgtactgttggggcgcataagacctgtttcaagccaccacttgggaatgatttttgttagtttttaattttttaaatatttaatttaattttaattttaattttattttattgagacaagacagagtctcgctctgttgcccaggctggaatgcagtggcgcgatctcagctcacttcaacctctgtctcccaggttcaagtgatttctcgttcaggctcccaagtagctgggactgcaggtgtgcgccaccacagttggttaatttgttttgttttattttgttttgtatttttgagatggagtctcactctgtcgccgaggctggagtgcagtggcatgatcccagcttactgtagcctccacctcctgggttcaagtgattcttctgcctcagcatcccgagtagctgggactacaggcacgcgccaccatgcctggctaatttttgtattttttgtagagatgaggttttgccatgttggccaagctggtctcaaacttttgggctcaagtgatccaccagcctcggcctcctactaaagtgctgggatgataggtgtaagccactgcacccggccatctgttagctttttagaagagagtttgtccaggtgcagtggcttatgcctatgatcccagcactatgggaggtggaggcaggaggattgcttgagcctggggattccagaccagcctgggcaatgtagcgagatcctgtctatttaaaatgtaaatcacaataaacaaaagagaggtgcagcaaactctagcaggtccaggtccctgcaggtaccaggggaacaggagaccccagtgatggtcagggccttgtgttgagagagctgaccagcaggccctgggctccctggagtggtgctcctggcccatggtctctgggaaacccagcagcacaaaccgctttgcaatgtggtcagcgtgaggctttttggttgcaagtgggtggcaggacagaatcagcttggagacattgctttggcgtctttgaaaccagagaggcttcatgccttttggaaggaggatctggaaagcagtgggaacttaggctgctgtctggtgccttcaggcgtcagctcctgctttcctcgtggggctggtggtggtggagccaagtggtgttgggggtggtgaggcggtcagggggtggtggttgggcctgtgggttggcttcaggcccccagtagtggggagagccaccggctccagccctgttccaggtgctgctggttgggtgggggcaagcagcaggttttccctgcccttctcctggcccccaggggttgagctggactgacccctggtatggaagcctggtaagttggaggcagggctaggccaggtgggtatggaggagccctcatatggcagttggcgagggcccagtgagcccctctctgctctccaggtggaccgggtcagctacctcctgcaggagatctatggcattgagaacaagaacaaccaggagaccaaggtgtgtatctgggtgaggtttccctctgccattacagaagcccacaccaggagcagccgcggacagcaatgcttgccggttcccttccatgccttcccctggagtcctagacccgctagacaacatcatttttccttaattttttttaaagctaacagtttagggaacattttatcctttctccagcaaattcactagcttctgatgtaaattgccatccaggttccccagggcagcccaggaatgggggccagtgtctcaccctctaggctcaggtgtgtggcaccctgctgcccggctcctgcccgcctccccagagacagcacgtccctgcagctcctgggggagggatgcttattctgtatgtccatagaaccagtcctggtgcctgacaaataagccgtggtgtaccccagtcagggaatgtagcaggggatgaaattagttttttttgtttttgttttttgagtcagtctcactctgctgctcaggctgtaatgcagcagggagatcttggctcactgtggcctccgcctcccgggttcaagcgattctcctgcctcagcctcctgagtagctgggaccacaggcacgcgccaccacacccggctaattttttgtattttagtagcgacggggtttcaccatgttggccaggatggtcttgatctcctgaccttgtgatccaccctcctcggcctcccaaagtgctgggattacaggcgtgaaccaccgcgcccagcctaatttttaatttttgtatttttagtagagatggggtttcactatgttggccaggctggtctcaaacttctgatctcaagtgatctgcctgcctcagcctcccaaagtgctgggatttcaggcctgagaccaccacgcctggtcgatgaacttgttaaaaggcacactgacatgagtgaaactcctgcctcttaagatctcttggaaagtctcacaggcccgcttcattatggcatctgggcccaggacaactggagcagctccacgtggcgggagcggagcacctggccgggcctcgcctcaacccagggaagtcagtgcattcatgtttcataccagggggcggcccactttgagaaaaggttcagagagggaatgttttcagccgcccgggcatatggtctctgttgcactgactccacgctgccattacaacaggagcagcggggactgtataaaaatgagtgggtgtggcggtgttccagtaagattttatttatagaaacaggccacaggcctagtttgtggacacctgttttagatttttggctttctttttgtccagttgctaatgtggtttctggtagctgccattaatgaaaatacttctaacatattaacttgttttttgttttttttgtttgtttgttttgagatggagtcttgctctgttgcccaggctggagtgcagtggcagccatcttggcccactgcaagctccgcctcctgggttcacgccattctcctgcctcagcctcctgagtagctggaactacaagcacgtgccaccatgcccggctaattttttgtatttttagtagagacggggtttcactatgttagccaggatggtctcgatctcctgacctcgtgatctgcccgcctcagcctcccaaagtgctgggattacaggcgtgagccaccgcgcctgaccattaacttggttttttttaaaccaaagataacgggtaccctgaccctcaggaagatgtgtttcttaggtgcatctgttcctcattttttctttaggtctgaagaacagaaagagaccatgttctcatgatttgggtgggtgaggggcacagaccctccccctctgccaggtgctgagtttgcactggatttgagcctggtgattctgctctggggcaacctccccctcccctctggacttctctttgtcatgacagcccccagggtagggtggagtggggtgggacagctggggacaggaagcaggagccgtactctggcctttgggaggctgctgacccacaagcccttgtcccggcagccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcgtgagttccccggccggctgttctgtggaaggttctggaaattagggactggccacaccacggtggtcctgggatagggggccacaggtccgttgatggctaagaaagaagagttgtcattcatctagtctgtgctgaacgtgggcgtgttggctgtcggagtcagtcaccgtgagagagctggcagggacgctagcacggggcattcagatcttcacgtctgcctccagccaggcaaggcttgcagaacaaagggctacagaggcgctccagggcagatgaactgaacgaaaattgatgagtgaatgaaatctttattcttattttatttttattattttttgtttgagacagtttcgtgctgtcgcccaggctggagttcagtagcgagttctcagcttactgtaacctctgcctcctgagttcaagcaattctcctgtctcagcctccctagtagctgggattgcaggcaactgccaccatggccagctaatattttacttttattagagatggggttttgccatgttggccaggctggtcttgaactcctggcctcaagtaatctgcctgcctcagcctctcaaagtgctggtgttacaggcatgagccaccatgcctggctattttattttattttatttttttgagatagagtctcgctctgtcacccaggctggagtgcagtgttgcagtctcggctcactgcaaactccgcctcccgggtttaagtgattctcctgcctcagcctcctgagtagatgggattacagccctgcaccaccatgcctggctaatttttgtgttttaagtggagatggggtttcaccatgttggtcaggctggtctggaactcctgacctcgtgatctgccctcctgggcctcccaaagtgctggaattacaagcgtgagccaccgcttttttttttttcttttcttttctttttttttcttttcttttcttttctttttttttttttttttttttttttgagacggagtctcgctctgtcgcccaggctggactgcggactgcagtggcgcaatctcggctcactgcaagctccgcttcccgggttcacgccattctcctgcctcagcctcccgagtagctgggattacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcctggccgagccaccgctttttaattaattacttacttttatttatttatttattttgagacagagtcttaactctgttgcctaggctggagtacagtggcaggatcttggctcactgtaacctctgcctcccaggttcaaatgattcttgtgactcagcctcctgagttgctgggattacaggcatgtgccaccatgcccggctattttgtgtatttttagtagagatggggttttacattgttgcccagtctggtctgaagctcctgacctcaagtgatctgcctgccttggcctcccaaagtgctgggattacaggcagagccacagggccctgccttgtttttaaaattttttttgtagagacagggtcttgctatgttgcccagcctggtctcgaactcttggggttaagtggtcctcgtgcctcctaaagtgttgggattatgggcatgagccaccatggccagctcagatctttattttaaaggtaaaatagaaaatatttcaataaatttttagcataacgctggttgcagatcacacctataatcccagcactttgggaggtcaaggcaggaggatcgcttgagcccaagagttcgagactagcctgggcaacatggcgaaaccccatctgtacaaaaagttaaaagttagccagatgtgttggctatagtaccagtgacttggaaggctgaggcgggaggatcggctgagcctgggaggttgagggtgcagtgagctgtgattgtgccaccactgcacccccgcctgagagacaggggaagaccctgtttcaaaaaaaaaaaaaaaaattatagcgaagtgaaaacaaagtatgctgggtagaaaattgaccaaggaattaaattgggttttctagagcattccagacatttcctcagtgaaaagccgctcgtagggccccgttctgagtgtcttccagtagagggaacaacctgaatgttctcagggtgaaaaaacgaccaggtcaaagtgcacatcccactggtaggcccttgccctggatcctgggatccctggcctgggtcctggcggtggggccggagcatagttggggatttgcctgcgcagctgcaggacacatgcgcttagtaggccagcagacctccaagccgggcgtggggctgtgcgaggatgctggtctgtgcagtcaggccatggggtcactggatgtgtccagatcccaggagtaagtgaagaggctgctggggcctggagggagaggccggccgcccagcctgtggcagatcctgtagcagggagggccggcccaggctgtctgtcggcctctcctgtctgaaagccacagagttgcgggggcagggaccaggaagtgggggcaggggtgggctgtctaggaaggttctctgtgcctgcccaggaggcaggcagtgttgaggactgagcctcagggtggctgtgtggctggagatacagcagggctgctttccagggagggtgccctgaaccgagtccaattctggaatcttcaggtgtgtggggtcagtgggtcggggccatcagactggagttcagagctcccgtgtggctttgagcctcaaggacgtggcggtagaggggcccctcacaggcgcccgagggcagagactgctgttctcagtagaaattgacacagaggaggcctgaggccctgtccctgggctgacggcagatgcattggtttgttggaggtggctggtttggtggtttggtggttcggtttcctggcctgcacacgtcactaaaggtgtctcaggaacattctacagcagcctgtggggcccttgtgtgagcaggactggcactgtgggatgacagggcatcctaggtcctggtttatcttctctgctcccagtggctgctgtctgtgcccctcagcttccccagcgtgatgtttttgcctcagtttccccagcgtgactccccacttcagcttcctcagcatgatgtccttgtctcagtttccacagcatgacatccccacctcagcttccccagtgtgatgtccccgcctgccatcctgtcctgcagccaagagctcctctgggctcagccaggactgctgatttgcagtcacgtcctgtctcgggtgcagcctggagcttcaggggtgtgacgctttgggggtcatggccaccagcctcttggaaacaccctctggagccccgccttgggcagcactgcatggccttgctgtgtttcctgcccggggccatttcattaatactgtgtttgcgggagttctgtctctcgtctttggagcgccccctccctctatttctgtacaggggagctgcttctttctttcttcccccatctttcctgcctattaaattcctgctccttaaaactaaaagaaaaaaaaaagaccgttgtgatctggaagcggggtcaccccaggacccctatggtgtggggggggtgttgatccctggggctgggagggtcccctcggggctgggtgtgtcgcctgggcctgatctgagccctccttctgccgcagctttccgggccctcctgcagatccgggcggtgcggaagaagccaggagccctgtcccccgtgtccttcagccccgtcctggcccagagcctggagcatgatgagcactctgtaagtgccgcctcctgcctgcgggatgggcgggagaggggcatgagtgcctgggccaggcgcaaggcccagacggtccagccagcagccccgtgttctcttctgtccagtgggcaggcatggcccccatggatggctgtgaggcatgaagggggtggccaggctgggccctggggtgccgctgctgggaacagcgctgctgccatcagtaccagagcctgcgacaaggctgagcgcggtcgaggtctcggtggagccaggtgcttttttttttttttttttctttttgaggcagggtctcggtctgtcaccgaggctggtgtgcacccaaagtggtgcaatgtcagctcactgcagcctcgacctcccgcctcaagcaattcccccatttcagcctcccaagacgctgtgaccacgggcgtgtaccaccacgccgagctaatgttttgtatttttagtaaggtggggtttcccatgttgcccaggctggtctcgaactcttgggctcaagtgctagtcctgcctcagcctcccacagtgctgggattacaggcctgagccaccgcctccaccccgtggttcttagtgaatgagccatgctgtttcccccatgcgctgctgtgcaaggggcactggtgaccctcctcccacgctccaggcccaccaggcgccctcagtggggaccttaagggcaggccctgcttcagcaacacaagggaggtggaaccctggcttcaaggacccaaagacagacagagacatggagagagatgcacagagaaacacagagacagggcgagagagaggtggagagacacagggagaggcagagacaaatgtggagagacacagagacaggatgagagagatgtggagagacaaagggagagacagagaaagatgtggagagacatagggagagactgatggagagataggaagagacagacagatgtggagagacggagagacagatgtggagagacagggtgagagagatgtggagagacacagggagagacagagatggggatgggtggcaggggctgtggtgggcagggagcagaatgggggagttggacagtgactggttgggcccgggtcttaggccccctgctccccactggccacgcgcattgtcagattgagtgcctttcttggctcttagctgtggctgttatgagccgttggttcttccaggctctgctgcctctctaaacagaaaagaggagcagagccctgaggactggcgttcacagacagcgcctttgctctagaaggctcctcccaagcccccttgatcagggccttgacctgggccctatgggcctccctggcagcaggtgcaatgtttctgaaatggggtcaatgtttaaaagtctggaatttcccttaaaacccagattttgggtttgtcttttaaaatctgacatggtcttgatgctagaggagaaacatggcttgggggtccctgtcaacccaggccctctaggcccctaccatcgtggggctcctggcaccacgctctccagcacttttgatgttggctttgattcggaaacgctgcgtgtgctcaggtttttggtggagagagaagcagcccctgagggatttgcctctgagagggtttcacctagggagtgatcgatgctcaggcgtggctaggtttattgtcccttgtttttgcccctccctgtttgtgttctggtggctgaggatccagtaggtccctccatgtttgtccctcttatgctgagtgagctgggcggccggggtccgaggtgtgaccaggcagctctgacctccacatgccccagaagggctggcacccagccagggagccgccgtcctctctgcatggagcaaaagcaaacgctcctcctcacctgccaggttcctgttggagccccttccacgtagtgacagaaagagccaccgtgggtgttctctccagcgagtgcctaaagatgatggtggggtgggtgggtctggggctgactcttctccccagccctcttgaggggttcatggttggtgataagtgagcggcggtgcctgggcaccggctggctgggggactttgaccagtgtggcttcaggatctccaccctgcacccagcctgcattaggcagcgttcagctgccctcacgtccaccttggccaaatctgttgccccaggtgacccagactgcggggggacaggcaatggggatgagattgggctccacagcctccccactgcagcagcacagctcccgggagctgccgagacgcacacatggcccacccagacccgagtcaaccctcacttaggacagtcccgagattcacgtcccccggaagcttgtgaagttctgcgccacggtgtggcaagaggacagccagtcagacctgtccagcccactccagggccgcgtgggggtggtagttgtaaaacatatgatttttatcttgacagtgtccctttaaaaaatcaaagccgcaccccgcctccctggccagcaagaaacctaaaagggaaacagtaagtgtctggtcctccggctacgtttttttgcccccgccctcatttttaaacccacgacaagtaggggagatcgtttccgccccaggctagtgtctgattcatataacccgtcagctccacttgcccagtcccggcctccctgcccagggagtttgtggaaccggaaaagctctcggtccgtgggcgaaacgccaggtgcgctggccccgccgccctcccctcagctttgcctccgccccgcgtggcccccgtgccgtttcccttttttttcttgctggcagtggaatggacgttgcaggcggaactaacgtcgctgctgcgttttgcaatcgcgccccgcgcatgcttcttggccccgtgtcccgctcctttaccctgcgggttcgagctccttgggctgagctttttggtttccttgggcttcccttgtgccccagggagcaggcagggggaccagcacacaaccacctggagcctccgtggcccaggcagacccagccgaaaccctgtgtgcgttggtgtagaaggtggaggccactccggagccacccggaccgtgttttcctttctagaggggtgaggggattctgtgtggttatttacccttaacttggaggcaggtatgggagcaaatgtggggtacacagaggtccagaaaagcatcccgggctcattgcccgggccgtgcccgctcccccatttctcccccacctccccgtggtctccaggcatcccgcacccatctcactttccccttccttccaggagctcggtcaggcaggccggggtctcccgaaaggagcactgacgagcgttgtgcccctcaacctggttttgtggggacagagcaggggcccccgcagtctgacttccgttccccagaacctgggcattttccttcttcctcagccttgttgattctgtctgctcccagtgagggaagaacagtggctcttagccagggtgcccgttagaaccacctggagcaggtcagcccccagaggcccgggcagggcacagctcccaacagctcagctctccctggtccaggacgcccctgaccgtgtctctcgcctctggcatggctttgctctgcccccgctcccagctcctgtctgtcactaacccttcactctccacctggggccaggcgggactgaaagccagggaggggctggttgaggccagggctggggcggttcttggcagatgccctcgtgcccgtcatcccaggcaccagcgtgggcatttgggcatccagccccgtgctggagctgatggctgaggcagggagggcatcggtgctgccagggagctcttggccaccctctgagggtgggggagtctcaatcccccaaagaacagagtggacaggaggtcatcaggaggagcgtctggggagcaggtggtccctgggcatgagccccctcacgcaccctgtccctacagaactctgacagcgtcccacctggctacgagcccatctcgctgctcgaggcgctcaacggcctccgggctgtctccccggccatcccctcggcccctctttatgaagaaatcacctattcaggcatctcggacggcctgtcccaggccagctgtcccctcgcggctatcgaccacatcctggacagcagccgccagaagggcaggccgcagagcaaggcccccgacaggtgagcagcagccaggccaggtgcatggcagggtgtgtggtggcgcgcgtgcggagcgggtgtctttgtggtttcaaatcagtttgtgatgtgttctgtgtggcgattccccagaaggactcggagaccccgtatcaggttagactcatgggtaaagtttattacggcaaagaacgcagcagacgaggcaggaagagcgtccgggcagctggaggctttgatcccccgaccagggccacaccggcgtgcaggcgcatacgtgctctcgagcaggaaactgcaggggtcggtgctgtgtctctgctgaggggagcccctttgagcctctgggttcccagacttcattggggggctggccacgtaggcccactctgccggtgaccagccagggcagccgaaactcaggacctgacagtgacccaggcacactcactgctcttgccgttcgcccgtgacgagccacggggcacggtccctctccaggcgatgagtgcatcatccatcactcatacgacagccttcggagggcctggctcctggggttggccacgggtcattcgtggttcccctggagccttgcggtgtatagagcggcggctgccagggggactctgtgcctcaggcctgtcggttctcgtagaagagtgtcaggaaggcgcgggttctgcaggcccgccctgggcaccctccatgcccacgaggaggcagcgccaaagctcagagaaacgggggcctctgtctcctgctgcttctcctccccaggaaccaccagcggtttctcttctccttctagaaagaaaaggaaggctaggcccgtgccagtgtgtcgggagcccctctgtcgggcgggtctgtggtggccgctgttgcctgttggccgtttgggttggtcccggtggctggtgatgcccttctccagggagtgtccttgcgtgggtcctggcaggcgtgtgcaggggcccccaggtgccctgcatggctttggcagggttagccttccttgtcgttatcctctcacccctgcccaccctctcctctgtccccagcaccctacggtccccgtcttcccccatccacgaagaggatgaggagaagctctccgaggacgtggacgcccctcccccactgggtggcgcagagctggccctgcgggaaagcagctcccctgaggtgaggcccccccggggaagctttgcgcacccgcccgggccagccctcctccagcttctgtcgctggaatcagaccccatcccactgcccgcctgggcgcccccgtgcttgttggctcttgctgagctgcgcggctccttagcctcggtctgtggaggcagcaccccctggtggagcggctgtgcggtcccgggagggccgtgcctgatggcggcttgtcctggagcggtggccgcggctctctgagctctaggctactttcccctttgtttcctagagtttcataacagaagaggttgatgagtcgtcgtcaccacagcaaggtgagcgcctccttccatgggcacaaaccgcatgcagggaccaggcagccctggcttactggggccttagggctccaggtggtgttgggccagcacctcttctgccccaggaaccctcggccaagaggcccccctcggcggcactgggatcccggctgggagggactgaacgggtgactgggtcaggctgcgctgttgaccctgcagggctgtctgcctgggatggggaacacctgccagcattcagtcctggttttgaaacatgagcgtgtaatgtttctatgaccaaaaaaaaaaaagccctatgctctgaacatccaggacacagtgtaaaaaaggggaaaaaaaagccccatgctgggggatgggaaggagggaaatagaagggaaacacccagctttggggtccctggagagcaggtggggtcacggtggagtcctgctggagcacaagcctggggtccccacagtggctacagagcccttgggtaagagagacggcctcctgcccagagggacctgccgggacctggcccctgcctgtaggtccctaacctcaccctctgcctgcagggacccgagcagcttccattgagaatgtcctgcaggacagcagccccgagcactgtggccgaggcccacctgctgacatctacctgccaggtaaggggctgggggtctgggggtgaggggctgggtgcctgtcttagtccccagggagggggccctgctctgatggtcggtgcatagcagcagaggctgtccattggagcctggttctctccctggctctcagccatgcccctgctattgaccgtgaagcaggatgcgggccagggccatggccacaaagcagcctcaggcagggcctggctcttgggagcggaacctgcaccaaagccccttccctccctggggccacattggccacaggaggtgagagacgcgagagaggctgcctgtgagaggatggggtccttttccctctgcctgctgctcacgccaggagggcagatccggccccactgggatcaccacatgttcccccactcctggtcctatcgtgggcccacaggccccatgctgggtgccacgtgcgctcctggcagtgcctgagagctgcagacagagcaggagcaggtaccacacgctgtgctgggtagcgggggccctgggccacagagcgcaggggcagtgtcttctgggtcaccctgccccgggcctgacagaggccacctgatgcagcagcacatcccaggccaggcacagaggacggcgggggcgccaggcgccagcggggaacagcaaggcagcaaggctgggacagagggttgctcttctcacctttcccggaggctcgggccccagaccccatcagccaagcaccttcgtgctctgctctgctgggataagatcctcagtttcgaatcctaagctctaaagaccgggagggaatgggggctctcagactagtgtctcagcacctgccacgaggctgtctgcggctctggaactgcgataaacagccacggtgctttcagacatgaccccagagccactgcttagggagtgtggctcttccctcgcggctgccaggcttcacccgcttcctggccccagggcccaccattgctcaatcctcctgagtcacctggtgacctgggcctgacattgggtggttgtgacgtgctttagttggaaaggggctcttgtgcccccggactctggctgagcagtggcctgtgctcatgggctgggcgtgacaggtcgcaggtgcaggagcaggcactgcctctggtgccctgatgaccacagcggcctgccccgaacaactcacagcagaaggtgtgtttaggaccagcttaccttaaagtgacacagaattcgagtaaggtctttcagaggatctcaaatatttcattctgattaaaaacttggggggtgatcggggaagaggccagaaggacctcagcttctgggagccacgaacatgatatctgatcctgcagggtggccctgtgggggagcatctcagaggctgcgcctcccctctgtggccaggcctgggaaggattgggacagctacagaggaggcccacacagaggaggccaggactccgagtctcatgccccacccacaggggagggtctcgggccttcttcaggcccacagacgggggcaggcagtcgtcatctgtggaggcggtagaggagaggccgagtctacatcggggcagcctgaggtgaactcctgggccctgggccccgctcttggagttggctgctgctgaatgccagcaggtcagcctgcacggcctcagttctgagccacggagagcacatgtgcctttgggggctgtttggcgccatctccgtggctgtcagccttgtcagcacaggtttctgtgtgtttttaaatccatgtggtggcccctctgttccactgactttttcacatcacagagcccttgactgtctatccgtgtctgtgcgtaaggcatgaacacacgccagagcctttggtttctcataggggtgcagccgctgcctggcggggtgggcggcatcactgaaccctgctgtccctgtagatgggagggcccatgagatggtgaacactgggggccctggtgtcttggacttggccctgagctcggtcctgtctagcctcagccccccacccagggccttcactcctgaaaccagaggtggactgcgcccgttaggtccttcatgcgcccttccctaggctgcggcagcgggaggtatgggagggaggggcagggccagtgcgctcctccgcgttgaattctggctgcgctctgcctcccagctgtggttctccttgtggttctctgtggttgcagcagagtgtttgtttctagacggcctcgaccgtgtccccaagctggtgcccttgctgtggctgtgctggctgctgcgcgcttgctaaccgagcttccgtctgtctctccccctctccgcgcagccctggggcccgactcctgctctgttggtatagacgagtaagccggtacgtgacctcccagacgcgcttcgggggctctgacgcgcgtccttggagagaggagccctcccctgctctctggcgggggttccttctggtttttgggtcttcgtccgcatccgcatcttcccaggggccctggattccgaatccagagctctccagtggctgctgcaccttcccccagaaagtggcctcctggggggtcctgactttcggggccagaggtctctccatctggactaggcggccggtcaggctcttcttccagccttgaggggccctggaacagtcccagcccaggcagggagacagacacagcccaggtgcgccagagccactgtccactgcgggaggcaggagcttgagggatgagggcagcaccgtggagggaaccccagggagacatggggtgagcgtcccaaggggagaggcctgggcctggccttgttccggatggtcccaccatgagttcgcatcggtcctgcagcagacacgttaggacgctcagcaggtccactcccgtgttccggtcgtggctttaacaattcatggggaaagaatgcgccccgattgggagagcccctggatcacgtcttcccaagctcagtccctgtctcttggagggagtccgtcctcgaggggccctctggtgcccaggggagagtatcttgcgtcctgtcctgagggcgtccgctcacacagccacctgctcccccgctccctccttcccttgtcagcatggccaccgtgggcctggcatcaccatgggcctggcacacagtccctcgtgggctgcctttgtgccatgagcccactgctgccgactcacctgtccctcccagtactggaaccttctggaacaccagcactaaaagataggaggccctgtgaggttggcatcccccatcccccccaagaggcgccctctaccagggtggcccaggtgagtgttttacagaaggcggctctgtccaggcagtggttcgcacctataagcccggtactttgggagaccgaggggatagatcacttgagcccaggaattcaagatcagtgtagaaaacatagaccccctctctatgaaaaataaaaaattggcttgggcgtggtagcttgtgcctgtggtcccagctactcaggggtgctgaggtgggaggattgccggagctggggaggtcaaggcccactccagcctgagacgctgtctcaataaaaaaaaatacacacacacccacccacccactccagcctgagaccctgtctcaagaaaaaaaaaatacacacacacacacacacacacacacacacgggggagagagagaaggcagctccaggagtgccaccaaaatgtaggcagacggattggggaccctctgccttcccagagggtcttggcacacaagctgcgtgcagctctggtctgccgaggcccatgcagcctgctgggaggtgcctggccgggggtgcaggctctaagaggccctttccccttgggtggacttgagccgggtcagggagaacttcgcttcttttgactgcgctctgcattcccatgaacctctgtcttcttgagcccagcgagtccctctgttgacccctgtcctgagccattatacccctagattgaaacagtcagcacctttcagacggccccggcctgcgcatcggtggaaggtgccgtgcgaatgtcacgattcaggtcaagcttccggagctggggagtgcaggtgtgatctagaacagggctcacagcctcggaaacctgctctcgccgcggcccccgaagaaaatagacgcccttcaccggagagtggggcctgggccgtgtctgctgggagccatgtgtcagggctggtggctgggtgtcaggcagccctgaggccatgctggccccgtcccaggctctgcaccagcaccattgcccaagccccagggacgccagacccatctggggacagcgcccggcggcgtcgtgcaggccacagtctgggcattggggctctgtgggaggctcctctctttgccttgcagtagccatccgggggctactctgagcacgggcttgttctcacccagggccgctccccacccctgcaccctgggttgaccgagttccaccctaacccagccgtaagaaccttggcaggacagtggctggccacatcccaggaaaccggaaccagggcaagggcaggaggcccagagggcatccaccgcggtgccgtgtcgcgctctgactcggggctgcagatctgctgtgggtgtccggggatctgggatcgtctgtcccaagagggacacagcgtatttggcacagttagggagtccccgggcccttggtgtgctcacatctgagtgaatgctgttgtggccacaggcggcgggagtgggggtgctggatggcccagcccctctggggctccagatcggtaggagcgggtggcgtggcaccaggcatccgagtgtgaccctcctccctctgctcccacctgcaggacggcccacctccatggagacggcccacggcctcgccaccaccagccccacctggcctccacttggtggccccagccccgatcccagcgccgccgagctgaccccactctgagagcctggccgagctggcagcatggagccctcggctccccagactttgccgaggggctgctccggaccccgttgtgagccggcctcctgtctgcatgccccctgtggccaccaggctccgaggggccgtggtgactcttgatcaaagagcacagtgaactgtcccttctgagtctcccttttctacagttgatatatttgtaactggtacaagatgaaggacagcagctttccatccctagttcagagcccccgttccccagggtcctgtgggctgagcggctggggctggggctgcccacgtgtggcctccgctggctctgcctgctcctgcaacagtgcggtccctgcccggagaactcaggaggcctgcagaagagaactgattggtggtcgaagcaccatcttcacagatgttcaggggcagtggggggctccaggcacggtcaatgaaggaaacagtgcctgtccacccaccctgcgtgtcactgtggcggcctggctgtcgctgctttttgtcctctgccgtgtttgcgcggcctcagtgccctccctggtgcgtctgcgctggggccctcagtgctcggggccttggggtgcatgggtgccgccctgggcagctagagtgtctcagcccggtgctgggcctggccgaggggcggaggcacagctgcttccagcagccagcattcagtggccttgtcaccaagctccacacctcctcctggtgctggctttggtgacatcacaaggcccctccaggtgcaggggcttctgtttggcaggcccctgccagggaggacctggtggcctcctcattctcttttgccattggaatgtccccttgcagttctcttctctttttttttttttttgagatggagtttcactcttgctgcccaggctggagtgcagtggctcaatctcgggtcactgcaacctccgcctcccgggttcaagtgatcgtcctgccttaggctcctgagtagctggggattacaggtgcctaccagcatgctcggctaatttttttgtatttttagtagagaagggatttcaccatgttggccgggctggtctcaaactcctaaggtcatccacctgcctcggcctcccagagtgctgagattacaggcgtgagcctccgcgcccggcccccttgcagttctctctgatttggtttgttctgtctcaggcttctgtggcaggactggcccagggaggaggaagccagcagcacacctggggaatggggtcccggccgggaggcttggcctctgggcgacctcgtcctgttttttttgtttgtttgtttgtttttttaaaggtaaacctcctgggccgcagatggcaaagggagtgcctgggcctggtgacccagggctggatccacccctgcggagccctgggccaggcaggtgtctgctgctcacctggctctggagggctgccctgcagctgggcctggggacaggtcggctgtggggcagctcagtaccctccctgaggctcacggtggctccgagcatgaggtccgcctcctgggcgagacccagcagtggacagcatggtcctcacacccagctccctgcacacccaggccagccacccctcccgctcgtgcacaggcacgcagatgcgctcacacgtacacacacacaaatgcacgcccacttgcacatgctcacgcacatgttcacacatgcacactcacgctcacacatgctgtcacgcatacacacacgcacatactcctgcacatgttcccatgcatgtgtgtgcactcggaccgagcatctcccacgcacctctaccccaccccaagcacctctctccccccatgcacctctccccaacaacacacacagccccctgcaccgcccgccccccgcccccaccaaggccccagcctctggccatcagtcctggtgccagagctttgcgtgaagttcgggccgcagagtggcccgctgggactcccatgtgctgccgtctgatgtgctcagatgggctcatcgttggttcgtttttactgtatatttatagtaataaaatcatgcagcaatatcctgtctgctccttcctccgggtgcagccctcaggattgtggctgtttcctgacccggagttttgccgctgggtggttggcggtggctcccgcaccgtggcagctccacggcctctgcctggcttccctctggggtcagggcagtgagcaaggtgagggctaacgagaacgggcagctcccagccatccctgtcagggctagttgtctggttggagggaagccacaccctccagattgggctctctcgtgaacaggtggttggggagcccagggcctccaggtttgtgagtagtcgctccggtccccatctctagtcctgatcatctcaaggcatttgctgagcacctgctgtgcgtcagtggaggcagaagagctgaggccccggccctggccccgggcgcctgccttccaggcagtgagatgcccagcagctaatcagaatcctgccaggtttggttactattaggaagaaagtcagcatggtggtgagatgaacccgtacaaggtctcatttaaccgggtggcagggagggcctctctgaggagacttaaacagccctgagggctgaggaggagctggccctggaagagtgttccaggtggcaggagtgagcctgatgtgtcccctggggacggagcccctggctggagtgaagggtgctggatagatactgaagagcttgtaggggctgctggagtgtttttataagggggagtcagttttaaaaacaggcttccaagcggagaagcagtgctagcaccctgcggctggcgtgtggaggccggacggtgggagcaggtctagctgcccatggttgtgggctcgcaggctggagcccggccccaggcctctgcacagcccccgctcccctgcccagggagtggccagtgccccagggcacccaccacaccactgcctaccactcagggccccagctcctttgcgtgcaggtcaagctgccaccatggcccttctttgaagactgtgagggtggagggaaagcccgtgttctagcccatcagtccctgccccgagaaggctgccacccatgggccctgcagctgctctgacctgcctgggtctggccccatcccagtgtgggtagaggggtgcccagggtgtcagacgggtgcttgcatgggccagatgggctccccctctgtacctcccagaagagccagcgcttgtattgatgtctggtctcggggaggggctgcagcaaggggagcctctcctcctctgcccctgcgtcccacgggccctgggcgctggctgggcttggctgcctaggggtggggccctctttgggtgagaggacccttcccctcgctgccctctcgccttctcacatggtcgctcactctggaatctggacttcccctgctgcttgcagctgtcccatgtgacccctgacccactggtggccacaggaggagagagaggtgccctctctgggtccttattctccacatctgaggccaccacggacctaacaggtgagtttccaatgcccaccctctccctctctcttctcctgcctgcctccactgaaggcagccttctctgtgccagcgagctcggcctcactgcacggctctcccgaggctgtgccccagccctgggcacccatgctgtgagtgcaggcaggggggttcatgtgctcagcaaatccattcccctggtggggaggaaagtggccctgggccctgctgctggtgaggtgagccttgccatcatggagttcagggcacctcgctctgccttgggctgtttcggatgcttctgagccccagagacatctccagtacaaacacaaggtaagtggtaagtacctcaggcccttgtggaatcgggattctgcctctgtcatcaactgccagttgtacttaggcaagttatgtccctctctgagctccaagttcctcatcgtaaattggggaaacccctcttccccccacagtacctggcacagggtgcccggcttggaggatgctggaaaggtccagccccggaatttaagtcactttctgcccagcaagctgggtccacagagccccagagctcccggtcgtccgccctgacccagcgtggactcggggactggggcactcaagccctgccaagccctgctccccgtgctgtcctggatcgagcctgccagcagggtggctaggtcgggacagctgtcgtgcatggcaggcgaaggccatctccctccgggcttgggtccggtggcgctggcggagcaaggctccggggcatctctggctcgtgtggtcgtgccaagggtgccattgcggatggacggggccatgcgggccgggtcggcctcctggggagaaacgggtgggcgcaaggggatcggcgccatcgagggtggagaaaccgcagggaatttcggctgtccgctttggggcgccaaggaagatgttcgtcgcccacaatgtcaaccttgagccaccacggcaccgaccagtcgtctaggctctcccgtcggaggcggggccgccgcccagggtgtgcgactattgggtgacggctgacgcgcaccgccctcctttgcacaccgcccgcagcacctctcgacgacgcaccgcggcgctgcgaggggctcggtcccggggcgcgccggcgattggcgggggaaccggacccgggggcgcggccgcccgcggattggcgaggcacggcgggggcgggctcgcgcatgctcttaagtggcagcggcggggacggggtcagtgccaagatgtcgacggcggcggttccggagctgaagcagatcagccgggtggaggcgatgcgcctagggccgggctggagccactcgtgccacgccatgctgtacgccgccaaccctgggcagctcttcggccgcatccccatgcgcttctcggtgctggtgaggacgggcgagggcgcgggcgagggtgccggcgcgggcgggcccgggcgggggcgtccgtcgaccccgcggctgtgacccgcgctcccttgcagatgcagatgcgtttcgacgggctgctgggcttccccgggggcttcgtggaccggcgcttctggtcgctggaggacggcctgaaccgggtgctgggcctgggcctgggctgcctgcgcctcaccgaggccgactacctgagctcgcacctgaccgagggcccacaccgcgtcgtggcgcacctgtacgcgcggcagctgacgctggagcagctgcacgccgtggagatcagcgcggtgcactcgcgcgaccacggcctggaggtggggccgccgcccgggccccgccccccgccccggggtttggctctggccccgtggaaggcaccgatgggtaacacgtctcctgagggtcccctggccgggctgggtcgggtgtcgctgtctccagcaatggggtggggagaggggtctggggctgggaggccgggaaaggaggggcgggggtgggggccggcgctggggctccctcagggctgtgttacatccgccttgctgcctgccattgccaatcctgggagtgggggagtgggatcggtggggaggaagggatgggggaggagcggggattgcttggggagttgggaaacttgagcacagcgggggttgtaaaacttgggaacctcatgttgggcgtgaaggctcttgggatttgtactttgtggtctggaagggctggactgcgggtgttcaggcttcgttgggtggacggggggagcatggggtgcggaccccggggtggggtggcctgggtacgaggggggggagtgcatggggtcagcctccacacttgcttggggaggagggggctgcactgctccgagggagctggctggcttctgccaggccctgcgtgggtctcccattaagtccttggcaaagctggctgctcataccctggcctcatagcttccaggcccctcctgctggaggtgccattgtgtggcaggcctggccccaacccctacctcctgtctgcgcaggtgctgggcctcgtgcgggtcccgctgtacacccagaaggaccgagtcggaggcttccccaacttcctgagcaacgccttcgtgagcacggctaagtgccagctcctctttgccctcaaggtgctcaacatgatgcccgaggagaagctggttgaggccctggctgcagccaccgagaagcagaagaaggccctggagaagttgctcccggcctcctcttgagggctgcctgagctggtggcaccctcccctgggccggaagactgggaattcctgctaagtgtggcttctagagtgtttgtgtgtaccccgcttctgactgcctagggcgagtgggcatcctgtcatcatctccactgtcccaagcagtcactaggtggcggccgggccagctggaacccagcccatcctctcaggcagagcagggtggtccgggcacactgggcctgcctctccagcctcaggatgctcttgtttattctgggctcagaccctcctcttgtacgtctcatcacagctggtagagacccaggagtgcctgattgtcccacaggggtggcgcacagctctgggaccactcagaagatgggatgtgtgggtggaggatgccttgtctcggtcagctcattcctgcctccttcctgagccagttcagggcctgggggagagccagcttggggtaggaagttaataatactgttaatttgggttgttgttggatttactttgctagattttctctttcaccacgtgtgaactgtgggtgaggtttcaaagtagcttcaccccacgtggcttggttcccagggacagtcagggcctcgggggcccagctatgtacaacgaagctgtcgaaggagaagacaataaagtcgctccgcagctgctctgtgtgtttctcagctgccctgtgtgtttgttttggttctggatggaaccagctcaggccccctgccctaggtgggggagggaggagctgccccagccaggggcacgtttgttccccagtgtttactgggggcactcccagcatgaatgctgtgcccatcagccaggttggggcgtctgggccgagaccttcagggcaggctccccttcctgatcctggtggccctggctgcacctgggctgacctgctttgctttgcaaacccaccattccccactgtctgcaagcagctccaggggatggtgtagaagtgcaggcttactgtgcagaaggacagcagcagagccatccctcgtggtctcctacagccccacatctggaaagactccagcggcatcgtcagaaaatttgcacagcccatgcctggcccggtgagggaggcagtgtgcccagctccatctcagagctcggtgtgagagcagcatgtcccgggggaggccctgtgctacggcgggctggggatgttcttggctctcaaagccttatcttgagttgtctgggctccaggagcaaaagacacacccctgaacagcagaggacagggcagtcagggttgctgcattggccagtgcctcatgtcatgtgaccagaactgagcccttcactagctgttcttaaattttattttccaaaaaatggcattttccaggtgccccagtcctcattcctaaggtcccacctcagttggcacctgtgcgtgtatatggatacactttccccccagggccctgcctggtatgggccagggcagcccatgaactctgggcctcaccacgaggttctgggtgaggccctcgtcccgcctcagtgctggcccgagctgccgagccagggccgcagcccccgtcttgcctctgtctgccggctgctcccggggcctgatcctctggcccccactgggcctgggctgcacatggcagctacctgctcactgtcctcctcactccctggcacacagcttcagggtggaccaatcacccaacgtcagattctgaaagaaaaagccccggtgagaagggagggggacaggtgggtgcatacccacacctgcagccgcccagacaggccctgctgctcccaccacgcgggatccaggctggcagacactcaccggcccgcaggctaggtctcccgccacttcttcccgttcagcacctgcagcttctccaggctctgggtcactaagcacagtgcttgccctgaggaatgatgaccttgagcctctcccggccaggctcaggagggctgggtggtgctgccccggggtctcagctgcaggatgtgacctgcccctcacccgttatggccccagccccgaggtcagccttggggtagagagacacaaacccgctttccctggaaaggggtccctttgcctccctcggaaacaaaaggagcgctcagtcgtctggtccccggagactcacccatctcacggacacggtcctccagggctcccgagagctcggggaggctcatggcctgcagggacgcttgccagcccttggagtctgtggtgcaggtgcagggaccgagttagctgggggtctgcgtccccacaggccctgctttattctgagcccatgcaaccaggagaacctgcttggatcagaacctccctacccgcctgacagtgtctaagcaacctcccaaggccgaggcagggaagccctgttgtgcccttcctcccacaggctgagcaaacactacgaggcccgggtcagcccgagagaaggcaaagctctgccggtggggacccgggtctgggccctggctggaggctacagaagtcactggcggtctcagcacagcacagccagccaaggcacagggcctttctcgagtacctcctacccctgggggataggcagttttcctgtcacaggtgaggaagtgggcttgggtccccagggccccctcttttccttggactctgggatcatgtgcacacagggacctgggagagtggctgccggccggagaaccaggccaagcccactgggtcaaacctggcttcagggctcccccaccttcccctctgcccagtgcggagtcaggccactgctcttaccagctggggggacggctaggcccagagtggctgcaccagggggctggtcctgcctcactcgagatgacagctcagcttgacaggctctgccagacacagaaacaaatattggtgagagcagaggcctggccgctgcagagcccccacctcagaccttctaggggagggaggggctcagccctgtccttgcagctggccctcatgggctgggccagtgccccatgaggctgcactaaagagcaggagggcgaccggtgcagattcccggacccaactcctgcctgggtctgcctgcaggaaggaagggcctgatgaaatgggggtggggtggctccagaccctgaaatccacccctcagttacaaaatcaggaggaaaggatgtgtgggggcccaggggccaggtggctgaccactggagacccagcccagggcagctcagagccactcaccgcagctggtccaggacgagggcagcatcccgggccagggcccacgtctcccgcagccgggcctggaggtcctcgcgggcgcggtcctgctccagcaggcagctctccaccacggcgcgcagctcctgctcctgacacacctggccccgcgtggcctctacctcctcgcagcgctgcaggggggtggggggcgcggggaggctgggaggtggccggtcaagccagacccttggccacggccctgtcctgtgtgtggggccctctccccactgcatccacctgacccctccacacagcacccaccttttctgtcagagatggagccaactcacgggtgtcaccctgcccccccatcccccacccagccactcaccttgtgcagctggatggcgagctcctgcatctcagcctccagccggtcggcgtaggccagctccagggcatccccgggtgggcgggcactgctgtgccagcgggcaatggcggacgtcatcttcctcttgggcccaaacagcctgcggggggaatgtgaccaggatatgcctcagcgtcccaagagcgcttacatgagtgggagtttgccccaaccccgggctgagggccagagcggcccttctggacgcacgtgatgccaatttccttcaggtcgctctcagtgagggtcagaaagatgcggaggtccacgtcctgctcctcaaacacctgcaggtacttcagacacccgatctgctccagcagtgcggcaaggtcctggcaggcacaggggacaggttgggggaggtagtggctgacgacgaagcagagacgttttcctccactcggagccccaccacttccccaggctcagaaccaagacagtgccttgtgtgtggcgcccaggctgtcccctcctactctggtggctcaggcagggcaggatgttgcaggcaggtgagtcctcacactatggtcggccacgtggggacaatgtatgttcatcaccagaaactggcctcctcctcccacacatgctcagttctgtgaagggaccatggagctgctgatctcgacaatgctttgtaggcggagagcgctgccctctaattctagagtctcagtgtcggatgttctgatttccacttgtctaagcgcagctcttctccgagttcacctgtctggagttcaccgagctccctggatgtaagatccgtgtttctgatccactgagatggtcaggctgtttctcacccatcgtttctgctctccttctggaatgccactgtatggggtggtgtcggtgtgcttgaggggatcacagatttctgttaattttttttactcattctttctgttcctcaagcgagatgatctcaggtgacctgtgttcacaagttgtctgactcttctgcctgctcaattctgctgtgagctcgtctagtgatattttcatttcatttacttttcaactccagaaatcctacttttgagagtttattgcttttaatggacaaacaaatgttactctgacattttcttcaagctattttctgaaagaaacatacttaggacactaccctgaccagactccactcaacgtatgttgaagggaccgagacgtgtgcctgctcactgagccaggggctgcagggagaagccggcaaatccaaggctctactgaacagcaaagccagtgctttaacaaataaccagccaggccgggcatggcaccaggccaggtgtggtggctcacgcctgtaatcccagcactttgggaggtcgaggcgggcggatcacgatgtcaggaatttgagaccagcctggccaacatagtgaaatcccgtctctactaaaaatacaaaaaattagatgggcatggtggcgggtgcctgtaatcccagctacttgggaggctgaggcaggagaatcgcttgaacccaggaggaggaggttgcagtgagccgagatcgcgccactgcactccagcccagatgacagtgcgagactccgtctcgaacaaacaaaccaaataaccaaccagagcttccctctgcctctcctctccgtgcctcttctgcccacacagggtaggagaactcagcagacacaggtgagacagctgagctgtgagtcacacctctgatccctaaggtaatgtgtggtcagagggaccacagaaaggaggaggatggtggcagctgtaaccatcaccaagcacacactgtgtgtagttcctgtctctgcttcaaccacatcttgtcagactcctgcaggcagctctgaggtcaagtgtgcttttcttctccccaggctcagggaggccaactccagtatggaaagcagggagacaggtcctttccgtggagaggaacagagtagaagcgctgcagcggggctgccagccatggagccggctgtgagcctgtggagcctaacaggccatggggatgccaccgccattctgttctcctagcagcgcctggcacgtcatatacacaacacatgcctcctaagtcacaaaaagtgccgtctctgagtgtaacctccagtttcacaagcggtcttacctggggtcctgagtagggggccctctgagtctgggggctggactcagcgagaaagccttccctgtcagttgcagcgcggggaggccactggctgtcaggattcttggtcttcatgtaacttttagcttgtttgcgagctgagcttttacaggcatgatccgagtcctgcagtgagaggcgtgcatctgaaagagtgcgcgggctaacttgagagccttggtgaaacccccacccgccacacaggggcttgagaggcttcgtgaaaccccccacccgccacacaggggcttccggtgcgttcgctgtcgtctgagaagccagaccctggacacagcacgtcccagtgcagcacacacgtgcagcagctgcttcttacatacatgctcatcttaaagtaactgggggatgtcaggcatcccagccagggaccggctatgggagaccaagaaagaaagaatccgtacctcgttgctctccacagaagcttcgctgctgagcccctgggctctggccaggccctcgctgctgctgctgctctggacgggccccaggttggcacagaaagcatgttcctctgagggcgggaagacagggcgtccgcctgcagccctcaccgaggtgctgcgcatgggcgtgccccgggctgagccgcctccaccagggcactccttggggcctgcagcggttgcttccttatatttcaaacttcctgcctgtcctaaaccctcccctctatacagacgggcagggcttctgtcttttttgttcactgataaatcccaagcacccggagcagtgcttggcacacggtgggcactatggaaacagctgctgcacggaggtgcagttataacagacattcctactggggcctgccctgaaagcctcaggggctcccaagcaaggagctaaacctgttgctgtggaacggctcccttaagccgcacggggatgctggaccagaagcttctcccattcctcacaagaaccagggccgtccacacctacccctttcctgtcctctgctggatggctgtgtccagcgccaggcccaggggataagtggggatgggcacacaggagctccaggacctgcctgagccacgggccggatgggtgggggtgcacgtaccccgactgctgctgctgctgctgctctccacatcccgctcattgatgggggaggtgacatcccggcagcagaggccctcttcttccagggggttctcgccactgctgttgaaggtgacatagccacggggaggagcctgctctgtgtacagaatggggcccataagcccagggaactccaaagtgaaacctcctcagaggccgaggcccaggatggaggcaggtgacttcccagtcatgacctcacctacttgcccctgcgacctggcatggctctatctgtggtgtgtgggtggaaaagatgctctgagggtcagtcagtggcccaagcaagtgcctggtggggcgagggctggcagccaggtcaagcctgggccctctccatttcttttccaaggggaaaacgtagcaaatggtcagctgtatttacagatgcctgaccagagaaaactataccatgagtgttccttttagcaggaggtagctaatgacctcacacagacacccatcgaccacgtgtctttatgtccctgtgacctttaaccacaggcgcttagcgggcctcctctggtcagtcaaccccggcgaaaaagagacctggctgagcaggaaggaaaaaggccttgaggtaaaaattaacaacaataatatgaaattacctaactctacctgcctctaaaaccaagcagaaaaaggggcatgtataccaggcaatttcactccagttttgcccctttacataaaaagactgacttgaccagtcacggtggcacatgtctgtaatctcagctacttgggaggctgagacaggaggatcgcttgagctcaggaactggagccttcagtgagctatgatcgtgccactgcactccagcctgggctacagtgaaaccctgtctcaaaaaagaacccaaaggactggttgatgggaccatggggaacttactttcctctttacgtattttcctagttatggagaagtttttctaatcagcacatgctatttatcattgccccctaaactgtttttgagacagggtcttgctgtgttatccagactggaatgcaatggcaccatcatgggtcactacagccttgacctcctgggctcaagcaatccttccacctcagcctctcatgtaactggggctacaggcatgggccaccatatctggctaattttcaaaattttttgtagagatagggtcttgctacattgcccaggctggtctcacaactcctgagcccaagcaatcttcctacctcagccttccaaagtgctgggattacaggtataagccactgcacctggcccccccaattttttttttttttttttgagacggagtcttgctctgtcaccagactggagtgcagtggcacaatctcggctcactgcaacctccgcctcccgggttcaaccgattctcctgcctcagcctcccgagtagctgggattataggcacgtactaccatgcccagctaatttttgcatttttagtaaagatgggatttcaccatgttggccaggatggtctggatctcttgatccacctgcctcggcctcccaaagtgctgggattacaggcgtgagccactgcgcccggccccaaatttcttaattactggcaaataaaatatatgcacttatagaaaatttaaatttcacaaggtatgagaaaacaaaaatcccctgaaataccacacctgagaccaccaccatgattacttctctgtggatacatacaaagaaccgcacacaagcggcttcagacatgtatgattttgttaaagcatttgttgtacagctatatagattaattaccaactcagccccaggatgacagcttccttcctgtccccaccacacctcaggctgtagcaggtggcagggaccttttggaaggaagagactctgccactcagaacgaccagcccggtgtcccagagccagtgctcacagctcagcggacgggacacgggcgggccctcatgctgtggtggggctggccagcagctcgagagaggccttcccagtggcccagtcagctcacccttcccaggatgatgggagaaggtgggtctccagttcccaacccagcacccaggcttgggaagacagaagtctgcacatctgcttgttcctggggtctagaagggaattcaattactggtggacccctggctgaaacactgtctactctcactcttccaagtcctggcctcaaagaggccttgctcccgagaaggaccagccaccaggcctgtgagaccagcagccttggcctggctatgagtgggtgacagccatcaaaggaagacataactcacacctccagctgagctctgggacagaccacagcaatagagagtaggcaccaaacccaactcccctaaaaagaaaccccagcactccccaagagcaaaacgctcaacaccctggggctgggaatctgagaatgaacgagactggaaaacccaaaggctaggattcttcaccagcaagtcaacaagcgggccctctctcaggagggtctgagtacaacttcatcgccctgagaaaacagcagggcctgttttcttggcctcctgcccccagcagcgcacccgacccagctggtatgggcagggcagggaagtgaacttcacgctttgcctcctccctgtatgagccaacccacctatgtgatgaatgaaatctgaccttagctacatttctgctgcaggagagaaagttctattcctaaatttaaccaacgaaaaggaaactccaggagataaagcaaaaaacaagagctagtccgtgaccaatgcatttccatcacaggactcaatcctgagtctccctgagcatgaaagctgggccacctgtcccgctgccacctgaggtccagcgacccacatttcaggagcctaagagctattccattcttgccaacacaaaatcctggtatgcaatgagaaagagccctcgggaaacgcgggccactcaccatagcgaggccgtggggctctgccgcccaggccaatgcctgtgatcctggccagggctcgcggtccctcgtggatgctgacacccttcttccggcaaggcctctgtctctgaggagcagggcaggactcgtcagaagagctcagatcttcgtacttttctgtgatcaaacaccaagattaagatagtgtgttcagtaatggactcatttactaatccttacggcaaactgaaagaaagtgactgtcgccggttttgttaaattaaggagaagggtatctgccagggcatcacttctgagaaatgccctaacaggccggggcgctgctccaatgggccacagggagctgcaaagttagtgaggatgggaagtttcatttttcttgagacagagtctcactctgtcccccgagctgaagtgtaatggcatgatcttggctcactcactgcaacctccgcctcctgggttctagcgattctcacgcctcacccttccaagtagctgcggttacagatgcgtgccaccatgcccagtgttttttttcttttctttttcagtagacacaggcttttgccatgttggccaggctggtctcaaactcctgatctgcctgccttggcctcccaaagtgctgggattacaggcatgagccaccatgcccagccaggagtttattatctctgttggggtttgccaaattgttcataagtctgtattgttcataatcagaaattctgttctaatttgaataagtaaaacccatctcttcattaaaatatatggtaatataagtcacaactactttttcctaatcccttcctttggaaacaacttttttttttttcttttgagaaggagttttgctcttgctgcccaggctggaacttccgcctcctgggttcaagcaattctcctatctcagcctcccgagtagttgggaattataggcagatgccaccatacccagctaatttttatattttagtagagatggggtttcatcatattaggctggtcttgaactcctgacctcaggtgatccacccacctcagcctcgcaaagtgctgggattataggcacgttaccactgtgcccggctggaaacaacttattaagcaattctgtattttcttttttttttctttatttttttgagacggagtcttgctctgtcacccaggcaggagtgcaatggtgcgatcacggctcactgcaagctccacctcctgggttcacgccactctcctgcctcaggctcccaagtagctgggactacaggcacccggccaccatgcccagctaatcttgtttttgtatttttagtagagacggggtttcaccatgttggccaggctggtctcgatctcctgaccttgtgatccgcccaccttggcctcccacaaagtgctggcatcacaggagtgagccacagcgcccagccacaattttgtattttctaaagcatggcatgtgtttgctatgattataaactgtttcaaatcacttcccagtctgagctttcagagctcaaaccagagcttttattattttgtagcttttcagtttttcatatttgatttgtataaggctctgatctgattctacttttaagagatacgtgagttgtatacaggaggaaatgatgagatctccttgtggagtgggtaagctggggcagaaatgaagggaaaggtcctttgcattaccacctgagctgtgtttattatgaaacaatcccaatgccagggaagaggctgggctgagcctgacactgagaaaggagctgctcgctcaggtgcaaactgacaggacaactcagggcaggccagcaaagagggagagctcaggccctgaacgtgggccactctgtccttccccatgacgaggctcaagctctggcgactgagctagccatatggacacacacctcctcacactcaaagatctatagcactccagggagactgtgcttccatccaagctgaaggggagggagctgtaagacaaatgcaaagaggcagcaataagcaagggaacggcagctgcgtgaatctcagcacccaacacaccctcagagcagcttaaaaagaacaggcagatggaaaccacaaaagagccagggctgcaatcctgctatcaacgtggaattcagggcaaaacacattaaatatgacacggaaggacacttttttttttttttttttgaaacagagtttcactccgtcacctaggctggagtgcagtggcacaatctcggctcattgtaacctccgcctcccgggttcaagtgattctcctgcctcagcctcccgagtagctgggattgtaagtatgtgccaccatgcctggctaatttgtgtattttgagtagagacaaggtttcaccatgtaggctggactggtctcgaactcctgacctcaggggatctgcccgccttggcctcccaaagtgctcggattacaggtatgggccatgcccagccagaaggacacttctaatactaaaagccataattcacagtgaatctataacaagttatgaaaatctgtcaccaaaaaatgcaccaacttccttcataaatcagaaacacgctaataggtaattttgtagaaaatgaactaagagtacataatcctaaataagatagactcacagatatgctaaactgtatacagataatagagaatacaacttctcaagcaaaacacggaacactaaaaaatattgatcagggccgggcgcggtggctcacgcctgtaatcccagcactttgggaggccgaggtgggcggatcacttgaggtcaggacttcaagaccaacctggccaacatggtgaaaccctgtccctactaaaaatacaaaaaaaaatgagccaggcgtggtggcagatgcctggaatcccaactactcgggaggctgaggcaggagagtcgcttgaacctgggaggcagaggttgcagtgagtcaagatcgcacttgggcactccagcctgggtgacagagtgagactacatctgaaaaaaatatatatatatatagatagatcagtagatgataaataagatgacaaggaagttatgtaaatgtaagaattataaacactctctgatcagacacattaaagttaatcagaataacatgagaaattaattgcaagatcaaaaaggcccttccatctagaaattaacaaacaaaaacaatcataatacttctattagacaactcctgggtgaaggagaaaatataaataaaaattacagaatttctaaaaataacaaggaaagtattaaatacagaacccccagaatacacttaaagcagcaatcagcaaaaattcacagcctctaacatttagcaacaaaagggcaacaatgaaaatgaaagaagtttccaactcaaaaaactagaacaacaaagtaagccaaataaaaataaaagcagaaattaaacagacaatcagtaggtctcattaataaatcaaaatccgatgggtttttcttgtttttccactaaacagacaaagtactagtatttaacttaagaaaaaaaggaagaggctgcgcacggtggctcacacctgtaattctagcagtttgggaggccgaggtgggcagatcacgaggtgaggagatcgagaccatcctggctaacacagtgaaaccctgtctctactaaaaatacaaaaaaaaaattagccaggtgtggtggtgggcaccctgtagtcccagctactcaaaaggctgaggcaggagaatcgcttgaacctgggaggcgggggttgcagtgagccgagatcgcgccactgcactccagcctgggcaacagagcgagactctgtctcaaaaaaaaaaaaagaacaaacacaaatattcaaaataagaagtgaggccgggcgcagtggctcatgcctataatctcagcactgtgggagactgaggtgggaggatcgcttgggcccaggagtttgagaccagcctgggcaacatactgagacactgtctctattttttttaatagaagaaatttttgccgggtgcagcggttcatgcctgtaatcccagcactttgggaggccgagtcgggtggaccaccttatgtcgggagttcgagaccaccctgaccaacatggagaaaccctgtctctcccaaaaatgcaaaattagccagacgtggtggcacatgcctgtaatcccagctactagggaggctgaggcaggagaatcgcttgaacccgggaggtggaggttgcagtgagccaagatcgtgccattgcactccagcctaggaaacaagagcgaaactccatctcaaaaaaaaaaaaaaattaaaaaatataagaaatgagatccagcaattccactactgggtatttatccaaaagaaaggaaatcagtataccaaagagatgtctacaccctcatgtttactgccgcagtattcacagtagcctagatagagaatcaacctgtgtccatcagtggatgaacgaagacagaaaatgagtttatatacacaattgaatattattcagacataaagaatgaaatctgatcatttgtggcaacatgaataagcctggaagagactatgttcagtaaaataagccagacatagaaaagaaagacaaatgccagctgttgtggtgactcacacttgtaatcccaacactctgggaggccaaggcgagaggatcacttgagcccaggagttcaaaaccaacctggtcagtatagcaagaccccgtctctacaaaaaaataaaacattagccaggtgtggtggtaggtgcctgtagtgccagctactcgggaggctgagataggaggatcacttgagcccaggaattggaggctgcagtgagccaagattatgccaccacactccagcctgggtgacaaagcgagaacctgtctcaaaaaccaaacaaacaacaaaaaagactacatgactacatgatgtcacccatttacaggatttttaaaagctcatgtcaaacatgtagagtagaatagtgattatcagaggttgggggtggggaggtagtgggagagattggtcaataggtgtaaaattacagatcgaagaaagaagttctggtgttcacagtagagtgactatacggaacaacagcttatacctcaaaatagctactagaagacatgattttaaatgttctcacctcgaaatgataaatgtttgaggtgatggataagctaatcaccttaatttgatcattacacagtgtatacatgtatcaaaacatcacacactgtaccccataaatatgtagttattttgtgtcaattaaaaatgagataaatattttccaggtcaggtgcagtagctcatgcctgtagtcccagcactttgggaggctgaggcgggtggattgcttgagctcaggactcttgagaccagcctggtcaacatggcaaaaccacctctctacaaaaaatacaaacgtaagctgggcgtggtagggtgcacctacagtcctagctactcgtagagctgaggtagaaggatcgttttgagcctgggaggcggaggttgcattgagtcgagattgggtcactggactccagcctgggtgacaaagcaagaccctgtcacaaaaaataaatcaatattttccatgccaaaaaaagataataacaggagaaaataaccactgaaacagagtattttattttgttttattttatctatttacttttctttgagatggagtctcgctctgtcgccaagctggagtgcagtggcgtgattttggcttactgcaatctccccctcccgggttcaagtgattctcctgcctcagcctccagagtagctggcgcacaccaccacattggcttatttttgtatttttagtggagacggggtttcaccatgttggccaggctggtcttgaactcctgacctcaagtgatccacacgcctcagcctcccaaagtgctgagattacaggcatgagccactgcacccagcctgaaacagaattttttttttttttttttttttgagacagagtttcgctcttgttgcctaggctggactgcaatggcacgatctcggctcacctcaacctctgcctcccgggttcaagggattctcccacctcagcctcccgagtagctgggattacaggcatgcaccactacgcccagctaattttatatttttagtagagatggggtttctccatactgatcaggctggtctcgaactcccgacctcaggtgatccgcccaactcggccttccaaagtgctgagattataggcataagccaccgcgcctggccctgaaacagaatattttaaaaggagaaaaaaattggccgggtgcggtggctcacacctataatcccagtactttgggaggcccaggtgggcagaccacctgaggtcgggagtttgagaccagcccggccaacatggagaaaccctgtctctactaaaaacataaaattatccaggcatggtagcgcatgcctgtaatcccatctacttgggacgctgaggcaggagaatcacttgaacccgggaggcagaggttgcggtgagtcaagatcgagccactgcactccagcctggggaacaagagtgaaactctgtctcaaaaaaaaaaaaaaaaaaagggagaaaatattatcttgtagacctctgcagataagtctgaaatcctagatgaagtgatctctcaggaaaatataatttaccaaaactgaccccataagaaaagaaagtatgaggaggccaatctctatagaagaaatagaaaaactgttatcgaggaaccacctcacagaaagagaccagatggtttcatgggaggattctatcaaaacttctaagaccaggtagcactaatgctacgtgtattgtcctagaacacaaaaaaggaaggaaaacttccaaattatttttatgaagtaaacactgatacccatacctgatagacagaacaaaaatagaaaagtatagaccacgccgggagcggtggctcacgcctgtaatcccagcactttgggaggctgaggcaggcggatcactggagatcaggagttcgagaccagcctggccaacatggtgaaaccccgtctctactaaaaatacaaaaattagctgggtgtagtggtgcacgcctgtgatcccagctactcgggaggctgaggcagaagaattgcttgaactcaggaggcggaggttgcggaggttgcagtgagctgagatctcgccactccagtccagcctgggcaacagagcaagactccatttcaaaaacaaaaaaaaagaagaaagaaaactatagaccagtatcacttatgactgaatatccatagaaaaatactaaatattaataaacagaattcaaaaacacattaaaatagtacaacatgtgggatttatgccaagaatgtaaggttgattcattattaggaggttcatgaagacaatctaccatatgaaaattcaccatcgtctccaaagatatgggaacacaattcaatagttactcctgtaaaacaccactcaggaatagaagaactgaggaatactttgttaataagctaaaataacatatgccttcccttttacagtcagcctctcatgtaacgtggcatttccactaagatcaggaccaaggtaaggaggctcactatctccactatgttgaacaatgagctagaggtgttagcaactaaacaaaagaacggtgcaattcaacaaagtcagagtcatgagaatcagcaggaagcagtgtatccatcgatacttaaagattatatgttagtacacctgtaaagccctaaagaatcaataacaaaactaacctgaacaatgtaagaattctgtaaggtagcagaatataaaattagtttgcagggctgagtgcagtggctcacacctgtaatcccagcactttgggaggctgagatgggtggatcacctgaggttgcgagttctagaccagcctgaccaacatggagaaaccccatctctactgaaaatacaaaaaattagccgggcatggtggtgcacgcctgtaatcccagctacctgggaggctgaggcaaaattgcttgaacctgggaggaagaggttgcggtgaggcaagatcgcttcattgcactccagcctgagcaacaagagcgaaactcccgtatcaaaaaaaaaacaaaagtttgcagaaatccactgccttcaaatgcactgacaatatgcagtgaaacgatataatgacaccactaaaggacttattcacgtatccaaccaccacctgttctccaaaaacctactgaaataaaaaataaatagcactgaataattaataccctgagagttggggggaaaaaaaggatataatgatagggaaaaccccatttacaatagcgacaaagatgatcaaacacttaggaataaacttaagtcacatgcaaaatgtagatgaagaaaaatttaaaaccctcctgcaagacccaaaagtacattggaacaagaagtcatcccttgttcttggataagacaacaacacaaagatatagttaatttatacattgtcacaatctcagtaaaaatatcaatactgtttttaaggagctagacaagttgatattcaagttcatatagaagaatgaacaagccatagctcaggaaacagtgaaaacagaaaactaagaggggcctgcccctactcggtagtcaagcatactacagaaagcctctacattcacaacagcctggttttgtaccactctccatcgtaaccatccttatctcctgttagagcaggggcctcaaccttgacatgtaagcagctgggggaggcagagccaaatctcagagaaggtgggagccggggaagcgggggacatctttctctgccaggtcacctaaagctcaaggcaaccagagaccccagcagggcgcggctggcaggtgtgggtacctgggctccgatagaggctcttgggcagagagggcgagtaagtgtccatcaaggccacgatcttcatgtgtccgtactgcttggccagcatccgggctgtggctccactgtggtctctcgcgtccaccttgactccctgtgaatgtccgtgaaagggggttaggggcctctccttcaaagcacctgcccttcctgggctgctggctgggaagacagaagggcatatgctggtttctgactgcctccctgtgtgggaaacatcacatctgcatgagaaagaggcaggcttgtctgcaccgcagccacaagttttgctctcactctcttcttagggacaaggatgaggagggctgggggctggggagtcatctcccacgctcatgacctcccttgcagggggctggcagccaccatgcggagatcccagccttcaccttctgcgcctgggctgtgtcccactcacttcgcttgtcttcaaagaaagcagccttttaaaccagtcagaatgaaagcaccatcctctgaagcagaattcgtaactttgatccaaagctctataatgtatttacaggtcttgcagcgcaacaattccacttccatgaccctaaggaaataaccctaaatacagaaaaggctttagtgcacaaagatgtttggcacaggccgggtgcggtggctcatgcctgtaatcccagcactttgggaggccgaggtgggcagatcacgaggtcaggagattgagaccatcctggccaacatggtgaaaccccgtctctactaaaaatacaaaaattagccgggcgtggtggtgaacgcctatagtctcagctactcgggaggctgaggcaggagaattgcttgaacccgggaagcggaggctgcagtgagctgagatcatgccactgcactccagcctgaagacagagtgagactctgtctcaaaaaaaaaaaaaaaaaaaaaaaaaggatgtttggcacagcatattcacaataatgaaaacctacctagagaaaacttgaatgctcagggggataagcagtcagttctgttattgccatagatggtgatatttacaaacagctgtatgatcaagttgaaaaaggatcatggccaagtgaggtggctcatgcctgtaatcccagcatttgacaggccaaggcaggtggatcgctcggctcaggagttggacaacaacctgggcaacacagcatgaacccacctctacaagaaaaaaaaataaactataatcaatacagcatgtttttggtgtcactgtacactgtaactgtccttctctcctgtcagaccaggcagctgggggaggcagggaagccagagccaaagctcagaggaggaggcgggaccccggaaagggggagcatctttaataaaaaattagcagggtgtggcggcacatgcctgtagtcccagctactcaggaggctgaggcaggaggatcacttaagtcccagagcttgacgctgcagcgagctgagatcgcaccactgtactccagcctgggcaatagagcgagaccttgtctcaaaaaaataaaaaaggatcatgatacaaaactacatatacattacaactccggcaaaatgagaccaaaaaaattacacagaaaacaatattggaaggtaacatacccaaaatgttgctatttttaagttatttactatttttgatggggatttttccaattttccaatcttctatgtttttaaaatgtactaccataagcatgtttgcttttttttttttaataggatcttgctctgttacccaggctgaagtgcagcggcgcctaaggaaataatgcaggacatacactacaatttagaattttcactgtggcattcagcatagtgagaatcagaaggaacttaaaataagagattaatgagctacgtgagagcatatccagaaaacagagcgcctcccgcccatttacgtggtgggtgggagtacctgcggtgacacggactagggtgcacaaaacatcattaagagaaaaaaggcacagccaggcgccgtggctcatgcctgtaatcccagcactttgggaggccgaggtggacggagcacaaggtcaggagttccataccagcctggccaacagggtgaatcctcatctctactacaaatacaaaaagaaattagccgggcgtggtggtgggcacctgcagtcccagctactccggggggctgaggcaggagaatcgcttgaacccaggaggtggaggttgcagtgagccaagatcgcaccactggactccagcctgggcgacacacggagactccaactcaaaaaaaaaaaaaaaaaaaaaaatcacaacccttaaggagttttgctaccacccatacggcaactgtctctcccgttagaccagggggcctcaaccttgacccccatatgtagttggtgggggaggcagaggtggtctctgggcagggatacaggacaaaaaactgtgttttcacaaagtataaggagttttactttctagagtgccccccatcctacttttgactctgattaaaaattacctatgagactttgtgccttaaaaaataatttataggccgggcacagtggctcacgcctgtaatcccagcactttgggggaccaaggtgggtggatcataggtcatgagttcgagaccagcctgggcaatgtggtgaaaccccgtctctactaaaaaatacaaaaattagccaggtgtggtggtgcgtgcctgtatcccagctactcaggaggctgagggaggagaaatccttgaatccaggaggcggaggttgcagtgagctgagatcgcgccactgcactacagcctcgacgacagactgagattccatctcaaaaaaataataataaataataacaataatttataagctgggcacggtggctcaagcctgtaatcccagcactttggtaggccgagacgggtggatcacctgaggtcaggagttcaagaccagcctggccaatgtgggaaaacgtggtaaaaccccatctctactaaaaatacaaaaattagccgggcgtggtggcacacgtctgtactcccagctactcaggaagctgaggaaggagaattgcctgagtccaggaggtggaagttgcaatgagccaagatcacgccactgcacaccagcctgggcaacagacgaagcaagactctatctcaaaaataaaaaataatttcttggctgggcacagaggctcacacctgtaatcccagcacttttggaggctgaggtgggcggatcacttgaggtcaggagtttgagaccagcctggccaacaaccagcctggtcaggagtttgagaccagcctgtatctactaaaaacacaaaagttagctgggagtggtggcacacacctgtaatcccagctactcgggaggctgaggcaggagaatcgcttcaacacgggaggcagagattgcagtaagctgctgcactccagcctgggcgacagagggcgactccatctcaagaaaaaaaaaaaattctagtttaagtttgatagaaggaaccctaaggtttaaccagaataaaacagtagcctctttactgtaggattttaactcgttatatatttttggttttgtttttgaggcagaatctcactctgtggcccacgctggattacactggctcattgcaaccctgacctccccagctcaagtgatcctcccttctcagcctccctgggattacaaacacacaccacaactggctttttttttttgagacggagtctcactctgtcacccaggctggagtgcaatggcgcaatctcggctcactgcaacctctgccttccgggttcaagtgattctcccgcctcagcctcccaagtagctgggactacaggggcacgccaccacgccccgctaatggggtttcaccatgttggccaggctggtcttgaactcctgacctcaggtgatccacctgccttggcatcccaaagtgctgggattacaggcatgagccaccatgcctggccaattttttttttttttttttttttaatttagagacaaggtctcactgtattgcccagactggtctccaactccagcctcaagcgatcttcccactttggcctctaaaagtgctgggattactggcatgagccactatgcctgatgtgaaaataaatttttaactacttaggctttaagagacttttttttcctattttataatgtccatattactaaagagacacatgatcaaaactcattttaacatgaaggtgggatcagaaagtttagaaaccctggaacaagactatccggaaggcacgaatcaactttctcttaaagagagaggcccagacagatccatatcctcttctcctgactgagctgctggggcttggccccactggcagaagggaaatgggggacaaggaaagcagccacagccctttcctcccctagcaaagagcacaagatgcccagacttgccccattctctacctccagaaatggagcccagctctggagggacaggctgggaaaccgggtgggccccctcctctggctccaggtggtctaactactgggcggcaggaaaaacgtgggagagaggagcttccaggcagggcttgcccaccagcatcgctggcaggcaaaccacccaggccatcgggccacctgctgccagtcctgccccatcccccaaagcagtcactaaccaacactttgattcttgtcaagtgctggaggaagaactcagtgttgagttcctgagtctgataattttgtgtgactgggaaagagaacatttttgcttttaggaaatacataatgaaattcttactctcaggaaatacatatttaggggaaaaggggcattatgtcacaatttacatttaaatgattcagaaaacatatgcatgttatacataaagagactgataagaaaatgaggtgaaatgttaacatttggggaatgtggtaaaggcatgcaaattgttggccaagcaccgtggttcctgcctgtaatcccagcgctttgggaggccaaggtgggaggaccacttgcagccaggagtttgagaccagcctaagcaacttagtgagaccccaactctacaaaaaaatcaaatcagctagtgtgatagcatgcgcttgtggtctcagctactcaggaggctgagttgcaaggatcccttgaacctgggaggttgaggctgcaacaaactatgatcgcgccactgtgctccagcatgggcaaacagagtgagactctgtctcaaaaagaaacaaacatacaatcaaaaattataagagtacatatctcttatgatctccagttctaccttacttaaaatgactctaaacttacaagtagaggctctttatggttctgggctattgattctatgatgtgtcttaaggaagtctagttcatgtcagcaggattatctgtcaaagaattatctggccgggcatggtggctcaggtctgtaactccagcactttgggaggccaaggtgggaagattgcttgaggccaggagttcaagaccagcctgggcaacatagtgagatttttgtctctacaaaaaaaaaacagccaggcgtggtagtgcgtgcctgtagtcccagctactgaggaggctgaggcagaaggattacttcagcccaggaggttgagactacaatgacccatgatcaggccactgcactctagtgtggtgacaaagcaagaccctatataaaaaaaataaataaaaaatacaaaaataattatttgcagaaaaagaaacccaaatggccagggagccaaaaagtctaacatcctggccaggcacagtggctcacgcctgtaatcccagcactttgggaggctgaggcagacagatcatgaggtcaggagttcgagaccagcctggccaacatggtgaaaccctgtctccactaaaaatacaaaaattagctggatatggtggcacacacctggaatcccagctactcgggaggctgagccaggcgaattgcttgagcctgggagtcagaagttgcactgagctgagatcacaccactgtactccagccttggggacagagcaagaccccaccccaaaaaaaaaaaaaaaaaaaaggccaggcacggtggctcacgcctgtaatcccagcactttggaagaccaaggcgggcgggtcacaaggtcaagagattgagaccatcctggccaacatggtgaaaccctgtctctactaaaaatacaaaaattagctgggcatggtggcgagtgcctacagtcccagctactcgggaggctgaggcaggaaaatcgcttgaacctgggaggcagaggttgcagtgagccgagatcgcgccactgcactccagcctgggtgacagagagagactccatctcaaaaaaaaaaaagaagtctaacaccctaaggggaggggtgtgaaccaggaccactatggaacaaagcaagtttacactacccactaccgactgaacccacctcacacaacaaagactctactttgaagaacacatcctaagctcctgaagaaattcccatatgtgcttaaaaagacgtgtaagaaatgtcaacggtaggccaggcgcagtggctcatgcctgtaatctcagcactttgggaggccaaagtggtagatcacttgaggtcaggagttcaagaccatcctgaccaacatgccgaaaccctgtctactaaaaatacaaaattagctgggcgtggtggcacacgcctgtaatcccagctactcaggaggctgaggcaggagaatcgcttgaacctgggaggcagaggttgcaatgagccgagattgcgccactgcactccagccagggctacagagcgagactccatctcaaaacaaacaaacaaacaaacaaaaaaactctgattcatccctacagggaataccatgccaccataaaaaaaaaaaaaaaaaagagaggccaggcacggtggctcacgcctgtaatcccagcactttgggaggccaaggtgggcggatcacgaggtcaggagatcgagaccatcctggctaacgcggtgaaaccccgtctctactaaaaatatgaaaaattagctgggcatggtggcgggcgcctgtggtcccagctactcgggaggctgaggcaggagaatggtgtgaacccggaagtctgaggttgcagtgagccgagatcgtgccactgcactctagcctgggcaacagagcaagacgccatctcaaaaaaaaaaaaaaaagagaggggctgggtgcgttggctcgtgcctgtaatcccagcactttgggagaccgaggcaggcgaactgcctgagctcaggagttcaagaccagcctgggcaacgtggcaaaaccccatctctacaaaaaaaatacaaaaattggctgggcgtggtggcacgcacctgtaatcccagctacttgggaggctgaggcaggaggatcacttgagaccaggaggtcaaggctgcagtgagctgagactgcaccactccactccagcctgagggacagagcaagaccccatctctttattgatttattgatttatttatttatttatttatttatttatttagagatagtctcactctgtcacccaggctggagtgcagtggcaacatcttggctcatcgcaacctctgcctcccaggttcaagtgattctcctgtctcagcctcccaagtagctgggattacagcgtcagccacctgtattttgtatttttgtatttttggtagaggcgggtttcaccaccttggccaagctggtctcaaactcctgacctcaagtgatctgtctgccttggcctctcaaagtgctgggattacaggagcgagacaatgcacctggccccgtctctttatacaccaatatagaaaaatcttcatgattaagttttttaaaaaatgcaagatgggagcagctgcacatggggcaggaccatgagcatgtgtgggtgtattcccagagtcgcccgtggggagggtgccaaggagacgcaggcagggtgggggacaggcctgcggtgcacccaccttctggtctgcatgtgtaccatgtgcatgttgtgtcccaaaattctttgttaaaaagagataccatgtgaatttttcactatttaagaaattcccaccaataagtgagaaaaaaacaaactatccaatagaaaattgggcaataaacatagacagctcgtaagagaaatacaaatggccagccgggcacagtggctcacacctgtaatcccagcactttgggaggccagggcgggcagatcatgaggtcaggagatcgagaccatcctggctaacacggtgaaaccttgtctctactaaaaatacaaaaaattagccgggattttttgtatttttagtcccagctactcgggaggctgaggcaggacaatctcttaaacctgggaggtggaggttgcagtgagctgagatcatgccactgtactccagcctgggcgactgagtgagactcagtctcaaaaaaaaaaaaaaaaaagaaatacaaatggctaagaaatcaatttaaaaatgttcaactggctgggcgcagtggcttatgcctgtaatcctagcactttgggaggctaaggtgggtggattgcctgagttcaggagttcaagagcagcctgggcaacatggtgaaacctcatctctactaaaatacaaaaaattagccaggtgtgcgggcgggtgcctgcagtcccagctactcgggaggctgaggcagaagaactgcttgaacttgggaggtagaggttgcagtgagccgagatcacgccactgcactccagccttccagcctgggcgacacagcacaagacttctgtctccaaaaaaaaaaaaaaagaaaaaaatttcaactactctaacaaggacaaactaaaatgagacgctacaattcacccgccagattgacaaaaggttgactgacatcaggactggtgaggacaagagaaaatggacacctttgtctatgactggtgggcaggacaacagacaaccttggtagtgggaattcatcaggaccgcctgcacttccccccattgggtttaacagccttataaagatataatccacataccaacaagtcacccacttacaatgtacaattcaacggcttctcgtatattcacagttgttcaaccatcaccacaaacaattttagcacatttttatcaccccaatcttcccattccccaagacccaggaaaccactcatctattttctgtctatgtatttgcttattctggacatttcctatgagtgaaatcacctagtgtgtggcctgttgtgtctggcttctttcactgagccgaatgttttccttttctttttctttttgaggcaggatccactctgtgacccagaatggagtgtggcggcgcaatcatagctcactgcaacctccaactccagggctgaagcgaccctctggcctcagcctcccaaagtgttgggattaccggcgtgcgccaccgcacccagcccagcctaacgcatcagggttcacccctgccgcagcatgcagcagtactgcattactttgtagggccgaataatatcctgctatacagatatatattttgtttatcaattcctcagtagatggacttgtgggtttttctactttttggcaattatgaataatactgctatgaatatttatgtacaaggttctgtgtggacaggcttgcacctgtgatcccagcactttgggaggctgaggtgatcgcttgagctcaggaattcaagactagcctgcacaacatactgagacccccaactctaccaaaaaaaaaaaattaaataattagccggggcatggtagcatgcacctgtagtcccagctacttgggggctgaggcaggaggatcgcttgagcccaggaggctgaagctgcagtgagccacgatctcgccactgaactccagcctgggatacagggcaacaccatgtctcaaaaaaataaattaataaaataaaacagaaatacaacatacagaaataactgcaaatgtattaaagctatgtgtaaaaggatattcccggaacactgtttataattgcaaaatgttaaaaactaagtttctactaataagaaactcattaaattaactgaggcagattgtacacggaatactgtacaaagataagatgtctataagatgtctctaagttacagactatacgtagaatcccactttgttcaaaacacaaagcaatgtgcacacacttgcctacagacacatctttccacagcagaggaaaagtcctagggcagctctttctcaaaccaagtgggcatcagggaggttgaaaaagagaggaggatctctgccttcttattctatataatttttctaagtgacaggattatgagtgctatttacttttaaaatatttttccataattttcagatagtattttcaaaattattacaggaataggtgtctatttctactcaccactgtatccttaatgcctaagcaccactcaacaccgggcgtcaatagataatgaaaatgtgttgaataaatgaatgaaagttatttctgtgcaaaggaaaattctgtaatagcttatacttcagtaatatgattcctcatttgccgtgactacattacatgctaataatcagggtcacttacgtgattcagaaaatactgcacgattatctcatggccagcagcagctgcttccatcaagggagtaaatccacatatcggctccctgcaagatgtgggccacagtcagatgattggaagagacaagttccgccaggcaaaaactccctgctgaagataaaccctgagcagtgcacgagtcaccgatccctaagcgtagaacactgtccctttccagaattaacaggtgacatgagaacagtgaatataacacatcagctccatttactcttctggtgtctgtccccagggctggtctttgtcctaaagacagatgtctgcctgtcgtcccacctgttggctattcccactggctacctctgaaatctccacctcaatcatattcaaaaagctgttctaattcctcacagaaagccagcatctcccatccattcatccaaatcctggcttcaagttcaacgtcctccatgaacccactctgaaaagttcaagtactaatgatctaagctatctttgccacgcttagctcctgaagcttgcttttcatgcttggttatgctaactcggcactgtcttcagagggcttccaaatccctccttgtctcatgctggtttggaagtcaggaaccatgcatgggaaatgctggttttcatccatcttaagacacacagtgttcatattttaacatctctcaagtcagaaaacatctttaaatcaacaggcgagttgaatgttaattagtagcatattttttctttcttagtggcatacaaaattatcaggtgtcttagaatgaatgacagccagggtgggtgctgcattggtacccgctgcgtttgttcaaaggtgattattatcatgacaagctttagacaacaatcccacttccaacttataaaactcatgactggttttttgtttgtttttgagacagagttttgctcttgttgctcaggctggagtgcagtggcacgatctctcagttcactgcaacctctgccttctggtttcaagtgattctcccgcctcagactcccgagtagctgggattacaggcacctgccaccacgcccagctaatttttgtatttttagtagagacggggtttcaccatgttggccagactggtctcgaactcctgacctcatgatctgcccgccttggcctcccagagtgctaggattacaggtgtgagccactgagcccggccaaaactcatgactgttgtttttgtttttttttttttgagatggagtcttgctctgtcacccaggctggagtgcagtggtgcaatctcggctcactgcaagctccacctcccgggttcacaccattctcttgcctcagcctcccgagtagctgggactacaggcgcccgtcaccatgcccagctaattttttcgtatttttagtagagatggggtttcaccatgttagccaggatggtctcgatctcctgacctcgtgatctgcctacctcggcctcccaaagagctgggatcacaggcgtgagccaccacgcccggcctcatgactgtttcaaagcatcacctcacctcatccatacaaaaagcaagaaaatggaaggaatttgcatgtaatgtatgacatttaaatgccattcagtatgttaggcccctggcatacaataaaacatgtaattcttacaactgtatgacccaggtgggtttcagataaagaaaaggaagctgagagggcttgaagagatgcatctcacagatgtacgaaaaggcctgtgcctggaaggactctggtcctacccctcatcttgagcctctcgtgccgaagcagggtggccctaaactctggttagctgcctccagagccaccctccttagagtcagatgacacctaggccactcctgtggccactaaagatgtggcaatcacctcacgttggcattggctccactgtccaagaggaacctgaccatgtgctggtgcccggcgctggtacagtggaagagggctgtccagccctggatgtctttcatttctagctctgcaccttgcttcaagagaacacagaacgtgcgttacggcctcatctcctctgcgtggggcgggcgccctccaggcggccatgctgcaagaatcagaagtgattacacgagcacacacgaacaccgtggcctgcagtggttcgcatctctgtcagggtggccacggagcccctcaggtttctgggcctgagttccctcgtagctcacctggagaagaaagtaggcgatgctctcgttgccacagctggaggccagcatcagtggagtctgcccttctggggtcggcacattcacactcacccccgcctcaagcagcaggtgcacgattgtgtcgtggccaatgtaggaggcatacatcagcggggtccagccaccaccattcttcttattcaaatctaactctctcctaaacaaacgcaagatatgctagacatggccagccgcctcgcatgtggggttcaccaaagctggtggcgaggctaggccaggcgggatgagttgacaggaagcagaagttatctgccaccctggacgttgtggggattggaggcaggcaggcagaaaaatgctgacagttgctcgtacactgccttgtgaggccctgagccttcgtctccttgctctgatttcgcatcctcctagcccaaggccagctatgctctttcacaccaccagataggcagatggcactcaaccagggaatatgtggcaatgtgtgaaggcatttttggttctcacaactgggcagggaagggctgctggaggccaaggctgccgctaaacatcccacagtgtccaggacagcccccacagcaaagaatgatccagcctggattgtcaacacagccacagttgaaaaaccctgaccaccacaggcctggcatctactagcccactgctgggtggagaggagcagtgaggaaagaagggactccaccgtggacaagtcccaccgccactgattcatcctttgtcacctcaccttaaagaaacattcttgaaaaatctgtgaccaaagaatcccatctttctcactgattgctgttaaaattctggcaatgcattttcccatgggaaaaaactgtgggcttcctagctgcgactctggggttgggacaagggagtcacatttaaaataatacccacttgcatggttacctgggatcctacatggttaacgcccacaggccttctttcccttccccagttcttgcctgcagaggggataacaactggtgactgaaccccaggatctgtcccttttacgggattcacttttttgttgtttttttgagacagagtctcgctctgtcgcccaggctggagtgcagtggcgcgatctcggctcactgcaagctccgcctcccaagttcacgccattctcctgcctcagcctcccaagtagctgggactacaggcgcccgccactacgcccagctagttttttgtatttttagtagagatggggtttcaccgtgttagccaggatggtctcgatctcctgacctcgtgatccacccgccttagcctcccaaagtgctggattacaggcgtgagccaccgcgcccagccgggattcacatattagaccacagcaggcaactaccttccattgcctggcagccctcagtgactctgggatgcacacctgggcagccattccagaaggtcctgataccagggttcagtggcagcccctggccaggggggctgcatggagatgcctctgcagcagggctcgaatgcacccagctcgtcctaacactatcttcctttacacaacagcagagcatctccctggggctctcttaccactcctcgttcagccccaccccttccttctgatgcccccagctcccctcaggccccatcctgtgcttactatcagcaagcctccacctcagctagtgtcaaaatcccatcacaacacaaacgcctccccctgctcctctatggagcggttatggactctgcatcttaacaggacacccaaagacttaagagcctgagaattccaaacgtgaccctttgaggggccgtactgactgcatacccagctgcctatgcctagagcctcctgtggagggagcgcaacagaccaccctgtaccaaggtgcaccagcactccatgggctgggtatgtctaagtgagggccacaacttgggaaccggagacctggggcttcagcaatgctttgctttggctcactgggaactggaagaggcacgcagagagaggaagagaggtcgctgcaccacaatatcaaatgagaaccaggagacagagttaggctgtgtgtggaacataagggggtggaagtgaggagacgacccttttccaaaaacaagatgatcacatcctactatgggcaagacgcagccatggaccctgccaggggctttatattgtctctaactattgtacacagattagcaaagggcaggtgggcagtgacgtcgggaggtcattccccagaggcactgaaagcccagcctctctcctcctccatggcagaagctagaggggaacagggatcacagggatcgaatgaaccctccgggaaaagaaggccagggatcactttcttttttcttttttttgtttttgagacagagtctcactctgttgcccaggctagagtgcagtggcgcaatctcagctcactgtaacctccacctcccgggttcaagcgattctcctgcctcagcctcctgagtagctgggattacaggtacatgccaccacacccagctaacttttatatttttagtagagatggggtttcatcatgttatccagaatggtctcaaactcctgacctcaagtgacccgcccatctcagcctcccaaagtgctggaattacaagtgtgagccaccgcaccaggccatcactttctgtctttatttttattttgcttgtttgtttgggcatttctgcaattagtgaataaaattagtctggttaaagaatgactgtttataagcttctgatcaaagtttactccctctttttcttcctaggaataaaaacggcctctttgtcagggctcagcatcaatacttactgacagctgcctgagataagcaggttaacctattctacacgcattaaacatccacaactgtgtgcaaagccccatcacgtgggatcgaagccatcactgcgctgctcaaaatgtgagaggaagttccccgagatctcttaccgctgcacacactccttcaccacttcatactggccaatggaagcagctgtgtgaagatccagggggacatccagctcctccccgctgacctgtgtcccgagcccgtgccacatggacaagctgcggttcaggagttccggctcgctggcttcatcgctgagctcggacatcactgaggaggaaggcccaagggttagatctttcctggctggttgttccagggcatgaaacaggctggtcctgcccctgctacaccactgcactagcagactgataacccagtgcagtcaaccccgggagtaactcagacaaatttatttgctgaaataatgtatgctttgggcagtcccaaccatgctaaatctggtgagcctgctatcacaccagtaaagaggagcacatatggtgaggcattaactgtggagtacctgctcctccttccaaccgcaggcaccaggtaaaagagaattctccaccaactctaggaacctgacaacctcttggatgggcagtgaagaaatgctaattgggttgtttaacccaatcagttccttgatgtggtggggaagaaccctggatttggggtttgatcaaaattcagcttggacccggtgcggtggctcacacctgtaatcccagcactttgggaggccaaggtgggcagatcacttgaggtcaagagttcaagaccagcctggccaacatggtgaaatcctgtctctactaaaaatacaaaaattagctgggcatgaaggccagctactcgggaggctgaggtaggagcatcacttgaactgaggaggcggaggttgcggtgagccaagatcacgccattgcactccagcctgggaaacagagcaagactttgtctccaaaaacaaaacaaaaaaaaaaaacaacaaaaaagcagctctgctacttagcaactccaatccctagtgcctcactgtctaacggggacatatctaaaaaggctgctattatgatacataaaagaatggataaacaaacggtggcacatccatataatggatgctactcagcattaaacacaaggatccaacagttgacatgcaacacgtgaatgaatttcaaatgatttacgctaaatggaagaagcctgcctacagtataatttcacttacatgacattctggaaaaggcaaaattaaagggttggaggttggggcagagagggaatttgggggacgatagacctgtatgactgtgacggtggatctgtgactccatgcctttatgaaaccacagaactgaacaccaaaatgaattttactgtatgtaaattttatttatttttttgagacagtctcgctctgttgcccaggctggagtgcagtggcatgatttcagctcactggaacctctgcctcctgggtttaagggcttcttgagcctcagccacctgaatagctgagattacaggtgtgcgccatcatgttaggctaatttttgtatttttagtagagacgggggtttcaccatgttggccaggctggtctcgaactcctcacctcaggtgatccgcccgcctcagcctctcaaagtcctggaaatataggcgtgagccactgcacctggcctgtaaattttaaatataaattaatttttctggaatggttatgaaattgaaaatttcaaaaaagtaaaaataaatttttctgaaaaaaatagaaagcaattccccaacagacaaaccaggatgtgactggtggcacgcagcaaccgtcaactgaataggaatccacttaggcatcctttgaagagagagctatggggggaaatataacaggccggtgaactggtgaggtaacactttccccgagatgggcctacatgggtaacggcacaccaggaatccccaaatcaaggcaaggtcatcagcttcctagtagaatccttaggtacaagagtgccaggaaacaagggtaggaaagggagcaaaggcgaaaacaaaggccttgtcaggttgtgatgacctacaggtgctatggtagttaatagatgcgatgaggacctcagtttctattaaagaatgcttccaagccccaggtgacagccaagatggctaaagaaacaagccaccaatgtgggagacgaacacttcacagacccttggtgaagagtgtgtgtaggtgcggtggggcaagcaaagccctccttcctggagccaccacctcttcagctagcagagcccaagatcgtgcagtgcccttccctcactttgcaggtgagaatcccaccctaacagccctggccaacgaagcctggataagaaaccaaacgagctgagggtcagttcagagtcccttccatacctccctcaagccttcactgggcatgtctcttccacgccaaaggcctcctgcagggtgaggccgtgttctctatttactggagacttgcatatctgacatccccagaggtctgaaggacaatgagaaccagaccaagcgtgacggaccacttgaggccaggagttcgagaccaccctggccaaaatggtgaactcccatctttactaaaattacaaaaattagctgggtgtggtggtgggcgcctgtagtctcagtactcaggaggctgaggcaagagaatcgcttgagcctgggaggcgattgcagtgagccgagctcaagccactgcactccagcctgggcaacagagcgaaattctgtctcaaaaaaaaaaacaaaaaaaaaacactaaagtgaaaactaaaatgtcccatcccgagtggtgtggtgtaaagtagcattagagataagacgttttagttttcattcaactttttggttctgtccattctgaaaatgctaagtatctgttacctttacagtgaatcctaaagaaaatgtggtacttagacacaatggagtactattcagccataaaaaaagaatgagatcctatcatttgcaaaaacatggatggaagcggagatcgttatgtttagtgaaataagccaggcacagaaagataaatattgcatgttctcaattatttgtggttatctaaaaatcaaaacaactgaactcatggacatagaaagtagaaggatggttacttctagtgtaaccaaggctgggaagggtagtggagggtggggatgcttaatggatacaaaaaaaacagaatgaataagatctagtatttgatcaagccactgcactccagcctgggcgacaaagcgagactccgtctcaaaaaaaaaaaaaaaaaaaaaaagatctagtatttgaccgcacaacagggtgactatagtcaatataatctaattgcacattttatttatttattattattttttttgagacataatctcactctgttacccaggctagagtgcagcggcgtgatctcggctcaatgcaacctccgcctcctgggttcaagcgattctcctgcctcagcttcccgagtagctgagattacaggtatgagccaccatgccagcctagttttcgtatgtttagtagagacgaagtgtccccatgttggccaggctggtctcaaatccttgacttcaggtgatccgcccgcctttgcctcccaaagtgctaggattacaggcgtgagtgagccaccgcgcccggctgcacatttaaaaataattcaaagagtataatcatattgtttgtaacacaaaggataaatgcttgaagggatggagacccccattttacatgtgattattacgaactgcatgcctgtatcaaaatctctcatatacgccataaatatatacacctactacgtacccacaaaaattaaaaaatttttaaaaatcttaacaaatgtgatgctggtggtaactgtcacgcccacagaggaggtctgtgaaagcacccaggcaccccctctcgccccgtggaaccgcatcgcaaaggtagctcactggccccggggcgggtccctggccgacaaacccgtaactcacagcagtgacgcttcccgacgccccccggccacatccccacaggaacgctacggcgcacagggcattactgtgcccccaccacaaccacataaagaaaatgtgggggctcggtcctccagtcacgcggcgagcaagtgcagcgcgggacgcccgagcgccgggtctaggcgggctgcaggtgccggcaagtgctggggccgggccgccgcggaacccacctgtgctgggcctcaggccttgcgccgccctcgggctgccgtcgccaaccccccccaaacagctcgccgccacgctccctcgccggggcaccgcccccggcacccgccccggaagtagttgcgggagggcgcggagcacgccgggaagctcgcgggtcggcaccgggacagctcccgggcgccgtggaatgcacacgtcccgcacccggaccttccggtcagcttcccggctcgctgtctgatgcccgcggtagccaatgagctagtggtgtttgtcctgctccgtccccgccctccaggggaaccaatcccattgcaggagaggcaggacgcgcaaaggcccgaaagaggagctgggcggggtggggggaaggcggaggcagtctagtaatgtaaagctccgctgagagggagagtgctgaagaaggggacagcctctgtacctgcggcgcggcccgaggggcggacgcgagcggagtgacgcgctggaggctgtttatagcgctgtcaggacagcgcggggagtggaggcagaggcctgaggtgaggggcctcgggcctgctgcgcctgcagggagttgaacaaaacgcggggaaatacgggctgggggtgggtgagaggaggagcgatgggctttccacttccacagctttaaaatttaaaagctcgacccgggaggctgttggcgtctggttgccataacaaccggcagcctcgtggcaggccggctgggggcggggctctgagaaccggggcggggctgtggcggggctaacaggctgcagctgagaaacccaccccgagacggagccggaaggccgttattcagaggcggctccgagcctccccttcgccttctggatgctctgagctcctcaacttggcgttcagggccctgcattgtctggtccgttttcaccggagagtccagcaactgacactttcttcccttaaacctgttgggcggttcattcctttgagctactgtacatgctcttccttctgccggtaatgccgttccctcccctattgtcttgtccgcctgaagggtttatcagagtctctggaggccctcttcatcccgacgattctgttgccctaagaaatactgtgccctgaattgcggaacagagctctagttacaaaaaacacccgctggctgtgtgcaccagatgcgtccccaacccgctgctcccagttcagagtgcaccaagcacctgccctattcccagaagtacagaggaagcaagcagcccccaattcacatctcctgccgctgccctgattggggatgaacgggcactgactgcagggccaaagccacagcggcctctcgagctgcagagttctcctgacactggctctagaggaccctcaccccccagctctcaagctcaagctccccagccccctgaataacaggaccatctcctttaagactctaagatataaatgcaggggctggtcagagtagtgactccaaaaaaaaaaaaaaatcacttagtgactccaaactgtcagccaggcgcgatggcacatgcctgtaatcccagcactttgggaggctgaggcaagaggatcacttgaggccaggagtttgagaccagcctgggcaacagggagactccatctctacaaaaaataaaaatgttagccagatgtggtggtacacacctgtagtcccagttattcaggaggctgaggtgggaggatcacttgagctcaggaggccgaggcttcagtgagctatcattgtaccactgcactctagcctgggcgacaaagccagaccctgtctccaaaacaaaaaagcaaggtgtcttctgttccttggtaaagggcagtaaagggtagtaggacttgaaattccccctgattcagagtccactgttgctatttactaaacaccctgagcctatgaaatgaagagaatagttatgctatatggggtatatataaaatatacctatatatcattatatatcgtacatatggcattctatataacatgtacatatatctacataggtatatttatatcaatacatatatttgtatattattatgtatatatcactatatacattatatacctgcaggctccacatgtgtgcatgagtgggaacacacacacacacgtacacacacagtgcctggcactaacaggagcttgcataactagaaggaaactgaggcaggtggtgaggcctgccagcctgtttggtctcctacagctggtagagcagcccctgctctcctgaccttcagtggcccggaccctcttccatcaccctgtgtaccccacagagctccccggattatggtgcactgagaaggcatctggaagcctgggccctcatggcatccaacgataaaggcatggcaccctcgctgggctctccctgggcctcccagatggggccctgggatgccatcctcaaggctgtcaaagaccagctcccgtctctggactcagactcccctttggtaagcaagaactctctccctggatgccttgtccttcctaccagagcaggcatgacgctggccaggacagctttggagcacttctctgaagacttttcctgctgacctgtgcagtttgttgtcattttactttaaatcgcatggccagactcaaagttgtgttttctgggtgcctatttccttctttactctttcttctgccttgattgtcatctctgagcatgggtattggtgctcagcatcttgggagaccctttcagtggagtttttggtgctgacttggaacccaggtcaatttgatgcagaagctctgtcctttccattctgctattctccactctctcgtgccaggacagggccagaacacccactgagaatgcacaattccagtgcattgtgataagccttcgagggattctgcatttgtggtttggggtccctgaaatggctctcaaagacgctcagaccaatagccctaggtgcaggcataagaccctgctaaagatgctcctggcgggggctgctcagtgcacaggttggcactgggcgttaagagacagtatgagggttttaaaaggaacgggcagggtttgggtcctacctgggcaccagcaacagagcttcagggacctcagacgtcatccagtgcatgacgaggctaaggagaacctaaggggaccccacgcctcagtgctcagggtgttttcacaccttcagtctcatttgagagtatgagccccaaccccttcaagaagacaaactaagctgtgtaagtgatggctcagggtcacaggggatggggagggctggaccctgctctttcagctaccacctcactgccctgttcatgtcacgaggcattaatgaagcacctgctgtatgcgaggtacttgcagaaccaggagccccagtctcacctccacgaggttgtgctgccaagcccatttctaaacggtggcaagaagccgcgcacagcaaggctgactgggagagaaccggatctcccccaggctcctgagcagcagggctggacgggctggatgggctgggcgggctgggctggaagtgagagtggagagtggagagcgggggtggctaggccctcagggctctgcctgctgccttgtcctccaaaagccctctcatttgtccacagtcggactatggggaagaggagctgttcatcttccagcgaaaccaaacctccctgattccagacctgtcggaggagctggctgaagatcctgccgatggcgacaagtccagggcctgggtcgctgcagctgaagagtcccttcccgaggtctgtgggacacagaagagtatacgcctgtgtgtgtgcgatgttagtctaaactgactggtctaaaccactgttctagcatttccacgatatgctagaacatggtccttttttttttcccccatgtacaacccaaggtattcagatgcccaacatctaacctccacgcacctccctctcctggggagcccggcaccttagggctggcatgcacgcttgattttccatccgattttgacccttctcttcttcttgatcgctcctatcctgttctctaccatggcatcctgaatagcttctggccattgtcacaactgcttgtcctaattgtctctcccttaacccagctggcttcatggctacctggctcatcccagcacctggcgagtacacaggaactctggtttactaaactgctaaactacactgctacaggctacagtggggagtgggagggaggaagatggcccatcagtgcctgagcaagcacacaagctggacctcgtgggagggacaacccaggagacaatgagcaaatgtggactaagcgtgccaacgcaggcctgtgttgccagtgctggaggctgagacagaggttcccatgaggccaggagtttgagaccagcctgggcaatacagcaagaccccatttctggctgagcacagtggctcacgcctgtaatcccagcattttaggaggccagtatgggtggatcacttgaagtcaggagtttgagaccagcctggccaacatggtgaaaccctatctctactaaaaataaaaaaattagctgggcatggtggcaggtgcctgtaatcgcagctactccagaggctgagacaggagaatcgcttggacccgggggagcagagatggcagtgagccaagatcacaccactgcacactccagcctgggcaacagagtgagactccatctaaaaaaaaaataataataaagaaaagaaaacagtgtagaggcactaacccacttccaaaatggagacggggcctagctccagcgtaacttctctcaggtgttctgctgagaacaattaacctactgaatgggagggcatgggcaccgaaccagatcatctcccagaaccaggacatgcacccacccatcaccttgaaggaaatctcccatcagcccagccattcctagacctaggtttgaaataaccccacacaagagagatccccagggcagctaagaactctggtgggttcaggtggaacaatttgcatgtgattttattttgctgcttcatttttacaatcaattacttcagaaactcttctggatgattttttcttgtttttttttttttttttttttgtaatgtgggatctctactaaaaaattagctgggtgtgatggtgtgcctgtggtcccagctactcaggatgctgaggtggaaggatgacttgtactctagcttggggtatgaatttctgagccccaacattatcatgattgataatttaaatattgtttcattgctgtaacagtgcattccactctagccttgtatttaaatagcaggatgcctcagtggtgctgtctttagccagcccatattcaacagtagctttccaacttttttttttttttttttgggacaggatcttgctgtgtcacccaggctggaatacaatggtgccctcactgctcactgcagcctccacctcccgggctgaagcgatcctcccacttcagcctcccaagtagctgggattacacgcacgccactgtgctggctcatttttgtatttttagtagaatgaagtgtgcagttaaaaatggttaaaagaggtcaggcacagtggcttgtgcctgtaatcccaccactttgggaggctgaggcaggaaagatagcttgaggccaggaacttgagacaagcctggaagaccaactatgttgtagagactctgtcactacaaaataatattaaaaaaaattaactgggcctagtagtatgtgcctgtcatcctagctacttgggaggctgaagtgggaggatcgcctgggccagggaagtcgaggctgcagtgagctatgatcgcaccactgcactgcagcctgggcaacaaagcgagacttcacctcaaaaaaaaaaaaaaagtacatatttttctatgaaaaacattccctgaagcatgtttttgaggatgctaactgaacatacctgttttcttgacagccagttctggtgcctgcagaattggccacagaacctgggtgcagacagaacacaaggacaaaggatgcatcctctcaggaaggaagagaccctggcaggccttttgaaagctctggtgaggtcagcgctcttcttgggatggccgaggagccccccaggtggctggaaggcgaccttggaagcctgtctttcaacaccaaaggatcccagggtcctccctgggacccacaggccgaagccactctctcctgccatgaaggagacccaaaggcagagcccctcagcactgcctcacaagaatctgtgaaccgccgggccctccgacaggagagaaggaagatgatagagacggacatcctccagaaagtcacccgggatgcctgcggcccgaccagcagtgacaaaggtggggtgaaggaggcgccctgccacgctgcggagtcagctcccagatccaaaatgcccctcgtggagcctccggagggaccaccagtgctctcgctccaggtaggcgcctccccgtgcctggctgtttctcaggcctgttacctgtggcatggctgctgttcccatgcactggagctagaagcagcttgagggctggcccactaggaccttaggcccattatccaccattctgtgtacctgtctcagtagaggggtggagggtcccagcagagcacatcctgggggagggttaacaagaacaaagaacaagcagggcctgccttccttaaagagagaaaaggaggccaggcacagcggctcgcacctgtaatcccagcactttgggaggccgaggcgggagccccggagttcaagaccatcctggtcaacacagtgagaccctcatctctaaaaaaaaaagaaatcatcctggctaacacggtgaaaccccatctctactaaaaatacaaaaaaaaaaaaaataattagctgggtgtggtggcgggcgcctgtagtcccagctactcaggaggctgaggcaggagaatggcgtgaacctgggaggcggagcttgcagtgagccgatatcgcaccactacactccagcctgggtgacagagcgagactccatctcaaaaaaaaaaaaaaagaaagaaagaaagaaacaaagaaagaaagaatgtataaatttaaaaagagagagaaaaaaggaattccactcccgaggatgttcataaatacatatagccatatctaaaatatagaacctggttctgtcaaagcctgatctcaaaatatgaaagccctcattctcataaactagtgagcacctgttaaaaagttgtatttagtgcattaatgagggaaccagcaggatgacagtgccggtttaatgagatcataagaaactgggattttggccaggtgtgatggctcacgcttgtaatcccagcactttgggaagccaaggcaggaggaaaatctgaggtcaggagttcgagagcagcctggccaacatggtgaaaccgtgactctattaacaatacaaaaattagccaagtgtggtggtgcgcgcctgtagtcccactatttgggaggctgaggcaggagaatcgcttgaacccaggagatggggatcacgcccctgcactccagtttgggtgacagagcgagactccatctcaaaaaaaaagaaattgggattttgtaaaacactggggaaaaagagaggaatgcagagatacgcttgtcacattcatgtcctagaggagttatcttgtctactggacagaaaagtaaccatcacaccgtctcggttttacacattttggataatttttcttaacaggttagagaaaactggcaccaggtatacacagaagtcatctttactactgtttaaatcaaccgttctttctgctcacctaaaaacttatttttctccacttagagggctgcaaagagttgaaaggtcatatgataaacatgaattcttgattaatttcctccctcctcctcagactcactctgcccctaagcactcactgccaagccttccagttttagctcctgcctggaacagcttgattcttaaaagaacaaaattttttaacctccaaacattgtgaacctgtatgaacctaaatagtgtttctgaaaacaacacagggtttggctgggctcggtggcttatgcctgtaatcacaacattttgggagacccaggcagatggattgcttgaggtcaggcattcaagaccagcctcgccaacatggtgaaaccccatctctactaaaaacacaaaaattaggctgggcgtggtggctcacacctgtagtctcagcactttgggaggtgaaggcggaggtggaggcaggtggatcacctgaggtcaggtgtttgttcgagaccagcctggccaacatggtgaaaccccatctctactaaaaatacaaaaaaaaaaaaaaaaaaaatgaagggtgtggtggcgcatgcctgtaattccagctacttgggaggctgaggcaggagaatcacttgaacctgggaggtggaggttgcagtgagctgagctcgcaccactacactccagcctgagcgacagagtgagactcggtctcaaaaacaaaacaaaatgaaacaacaatacagggtttccttcgggtcagacaacgtctttgtgccaaaaacaaaagtgaagtactgatccccaagaaagcataggaaggaggtggcaaagtgcaggcccaccttaacggaggcgttcaatctgtaatggaaaggcggggtcagcctatttgcaaactctgtcatgcactgaattcctgatttctacccccaacatcctgtgaccatctccatgggtcacagcagctgtgaagcaggtacttgtgcctctgggacccctcagcatcctcataatcactggttttaatgatttcagcaacttgaagcgtgggatttggatgacatccttcagagtctggcgggacaagaagacaaccagggaaatcgtgcacctggaactgtgtggtgggcagctgaccaccgccaagttcaaggtctgaccttgaacactggagcccacgtgaatccccacaagcagcaccttcctgggcccctcagacacagagggctgcaggctggtcacagacagtcctgcagcccacacaagtcttccctgctggccccgccctaaacactcatgctgccagtccccaaaagacttcattcattcaacatatatgtgaccgcctgctacgtgccaggcgtgggccaggtcctagggacaaaggagaggcctccgcaccccaccccatgacccatacctcctcttccccacctccctgggccagcctgccttccttctccctcctcctccttcctgggggaaggaagccccaccttctgtgcgcagtcagctcctaagcacgctcccgcttcccctggcctccccatttaaaaagggaggcaaaggatgtcaccactgtcactacactcatggctttgctctgggaagtcctgcaaataaaatgaaagttctccaacccctccctatccactcgggccacaaaggcgaggggaggcaggtctgaggcagaggagccagggcaggtgcggcgcttccgcctctggtcccaaagcaaagactcccctgtgactgacagcccgtgttatgttaaatacattttgttggtttgtaattcaaatcccataaagcaggaggtagagagccaaccattctggaggacatgtgtgtgcatgtgtatgtgtgtgtgtaactggcactccctttgtggaggggagtagggcagaatgtattcttttttttttttttttttttttttgagacagagtttcactcttgttgcccaaactggagtgcaatggcacgatctcggttcactgcaacctccacctcccgggttcaagcgattctcctgcctcagcctcctgagttgctgggattacaggcacgtgccaccacgcctggctaattttttttgtatttttagtagaaacgggatttcaccatgttagccaggctggtctcgaactcctgacctcaggatccgcctgcctcagcctcccaaagtgctgggattacaggcgtgagccaccgcgcttggccgaatgtattctctgttttaaaggcacataaccctttaatcaagctattgcaattagaaaatctgtcttacactctgactctagtaggtaaagatgtgtgttcagagctgtttgctgcagtgttgtttaaaaatctgaaaagctggaaacaacccatattcaggaggagtccagctagatcgttttagcacagaatacactgcggctcgatgaggggatctccgtaggttaacgtggaagcatgtaatatacaaagtgaaaaaagtgaagttgaaaaaaaacctatagaggatgaccctattttttttttaagtcaacacacagaactgttcattatgatcacctgtgacaagtgggaccggggtgtgaggaagtgggataaacttaaaaatacgtcactcctacttcaccaagcccttgtgccacaggccctgctcataaagattctgcccccctcagccctgctgagctagaggtggagtcctcagagggctgagtagggagagggctgggcgggggcagtggaggagcctgaggtccattcacatgtggagaccccaggggtcctgaggctccagctgctgtaagtcacaagtgggccaagtccccactaatcagcctctcctttggccatcctcagaccgcatggtgccgagcgcccacaacaggctcatggaacagctggccctcctgtgcaccacgcagtccaaggcctctgcttgtgcccggaaggtgcctgccgacactccccaggacaccaaagaggcagattcaggaagcaggtgggacttgtagccaggcccggctcctgtggtcctttagaatggccccatggttttgtagcactgactgggcctaccaagggcggggcactccatgtgcattttctcagtcactctcaagcatctgatcaggcagtcgctccagtcatccccattttagagatggggaaaccaaggctcagagaggttgactctctctggccataaatggcagggctgggactcaagccctcaagtacctgctctttccccaaacccaacgggaaccctcctttcaatgggaggccatgaggcctccctgagagtaggaaggttatcatgtgaccctgcccctctggccacagctgattggtccagctctgggcatgtgaccccagctgcgggatttttcaatctctgtgtctctgtgtaggggtggaagggcaacagccacctgtcctgccacagggagaaaggcaagctgcagtgaagctgggagaggcagaggtggaggcagggccccagggtcccgtaaggcccctctatatgcctgccctccccacactttggttgctccgcacttgaggaatctgagaaccagtgaatcccttttcacctgaccagcagtgggtttctgtgtctggaaaccaaaagtacctaacagaagtggctacacctggctgggcgcggtggctcatgcctataatcccggcactttggaaggccgaggcaggcagatcacctgatgtcaggagttcgagaccagcctggccaacatggtgaaaccccatctctactaaaaacacaaaaaaattttccaggcatgttggtgcatgcctgtaatcccagctacttgggaggctgaggcaggagaaatctcttgaacccaggaggcggaggttgcagtgaccaagatcatgccactgcagtccagcctgggcgacagagcaagactctgtctcaaaaaaaaaaaaaaaaagaaaaagaaaaagaaatggagagaactgcagtgttaaccatggcagccattagccgtgtgtggctactaaacacctaacgtggtgaatgtgactgaggaactgaatgttttatgcattggatttaaactggcttaaatgtaaacttagccacttgtgccaagtggctacacttaccacagatagagagcatgtccatcatgagggacgttctgttggccagtggtggcctaaatctcgcatgctgttctgaagagtaaaagagcaaatgtgtttaatgtgcccgtctgtagagagtgggcactcactgggtggcagccacgagcactgtgactggacaaacccagcgcaggtcacagagttatcacagagaactgactccacaacacctgcttttctcatttcagatgtgcctcaaggaagcagggctcccaggctgggccaggcccgcagctggcccagggcatgaggcttaacgcagagtcccccaccatctttattgacctgcggcagatggagctaccagaccacctgtccccagaaaggtccggagggcagtgactaccccataccagcctctactttgcagagttgcctgttgaccgcacagagcctctggtggatcctgatggggaggaacagggacttcaaaaggcttggatcaattctcaattgaaaagtgctggcctacagtccccctgggtccctgcagggagggaagaggggcatgaggcacacctcctcgggctgggctctatgcaatagagcccaacacgtctaggctggagggcatcacccacacctgtcctcacctcctggcaggacgtccaccggcctccagtgtggctgctgacctcttgcattgggtcaccagcaaagcccgagtgcttcaagccccaacaagagttggaacaccaggtggagtgggcacatccagaaacccatttctctccctgcagctccagccacagctcctctgacagtgaggaggaggaggaggaagagatggcagctctgggagacgcagagggggcatctccttcctccctggggctacggtaaccacccaggggcctctcgccacctgcagatgtcccacctctgctttctgcagcaagccctccacctggcacatttaccgcctgtggtgaggtcttgctgcacccaccgcacagggtgagggggacggcacagctttcatcatcctgcccacgtccactgggtcccagcagtggcagcagtgatgggctgcctgaattgcattcttgctctgaaatgggagctgggctcatctgcttttctcctgtttcagtaaggagggctgggaggggcggcccccacggggttgagtgaatttggtctcattgtgtcacaggacctgtaccgggaaaagccagcttctccagcagctcagggcctttcagaaggggacagcccagcccgagctgcctgccagcaaggggcccgcgggtgggagggctcaggcccctgaagacacagctggatcacgaactgggaggaagcaacacatgaagctctgtgccaaggggcagagcgcccaggctcgactcccaagaggcaggcccagagccctgggggatgttcctgagccaggggcagccagggaggccctgatgcctcctctggagcaactatagctgcctcaggtagtgggatcccaggagtgggcaggggcgggctgacttgccatggaccctgggccccggtgtccccttgttgttcctgcatttccactagcaggggcattccagaggcagggaccctcagactttggactgttgcccaccctgttagagctcagtcacaggtgcatgaacttagaggaaggatgcagatacaaatctgtatgtaacctgtgacaacagctttgggataaaggggcctggtcctctgagggagatgggcagggacagcaggaggacggggtgctgctctctgcgggactctgaggctcttcatctttctccagttctgcatttttttaaacaggcatctattatttccatcaataaggtctttttaaaaaccaagtaaaacgtatttagaggattttagggttgaaagagacctaagccttattttctggcttcctgcatacttgctattttgggcacctaaattaacacacgacacacacatgcctacccacacagatctaatacacgtggttttttctcttttcgagacgcagcagctgggactacaggtgcacaccaccatgtccagctaattttttttttttttttttttgtagagatggggtctcacggtgttgcccaggttggtctggaactcctctcaatcctcctgcctaggccttccacagtgctgggattatagcactgtgagctgccagcctggcttttaatgaactttttgaaagaggagtaacgagaatttgctttctctttctcttctttacctaagatagaaaggcacacatagattctcaaggcctttgacctttatgaatctagacagaatactggaaacccctggaaatgctgtcctgtgtagaatggagcagcggcctcacttgttgatcaccagcaaaaactggggacatctgcttgccccctgccaagacccggcccctccacaggacaagcctggtcttcctgggtcctgttcctttgccagcaccgtcttgcagccccgtcttcacgggatgcttttgtaactgctgtgatcagccctgacctgggcacctgtttgtctccccaaccttgtctccaggatgtgtcctgctgtctgccccgtgggaagagcagagaaatcatcaccaccttgggccccacggtgccacgggctcaggcagcacagtagggcgccgggcctttgggacagtgtcccagcttcccctggggttcacccctggctgccaggccactgaggatgggcaggggtctcttctcatcaagccttgtaccaggcaaaagacaggccctgcttggccgtggtcactggccgccaagatcagggctacagatgtctgctctctggaccccacgtgatctggccactggggacccccacccgaccccactcccaatgatgaggggcattttcattgcaagtcaaaggcaagacaggcttccataaagtcccaggaggtccctcctgtagggcacaaggccaggctgcctcccagcccccaggccctctcccacctacagagaccctcccctgccccctccactccggggcctgtgccgccagaaccgggctctgcccccatacgctgccctcgcagcctggcggcctccgctgtggctgcctagctgtcaagagcaaaggctttttttttcttcaaccccattttcttccatttctcccacctttttaatgccagtaacctcactgagaatgttttacagtgatggaaaataaactctgttccaagttcaactctgaattactgtgtctgtcaaggcaaggggagtgaggtaggaagtcagacctgcgtccaaagctggctctgccacctgggcaaggttttcacgctcccagtgcccagttcctccacccacagaaggagaatcatggccgggcgcggtggctcacgcctgtaatcccagcactttgggaggccgaggtgggtggatcacaaggtcgggagttcaagaccagcctgaccaacatggagaaaccccatctctactaaaaatacaaaaattagccaggcgtagtggtgcgcacctgtaatcccagctactcaggaggctgaggcaggagaatcacttgaacctgggaggtggaggttgtggtgagccaagatcgtgccttgcactccagcctgggtaatgaagtgagactgtgtctcaaaacaaaacaaaaaaaggagactaatgggagtcccccctcactggactgcatgagataacatcacagcacacgcaggcacctgggactcacagctcctacaaaactctcccatcacgtgagtgctgaggatgacgcccatgagatggggccaagcagcaggcagcgaccatgagatggggccaagcagcagccagtgggaggccacagcctcggcagggggagggaagtgggcagaccccaaccacactcccccagaggccgccacctccagcacaggcctggatatgagagaggggcctgggggctcaggctgcgctggggagatgggtgtcagcaacgctgggtgctttgctagctcctggagtgtggcctggccacatctagctgggtacctcatgccccatgagagatcccagagctagtctagaaggtaaaagccgtccctcaaccaggcagccccattctgcagacacaggacagagcacacaggggccagaagcaatgacttaaaaaaaaaattgtttattttatctgagacaggatctcactctgtcttccaggatgagtgcagtggcacaatcacagctcactgcagcctcaacttcctgggctcaagtgatcctccagcctcagcctctcaagtagctgggactacaggcacaccccatcatgcctggctaattttttttttttttgtgtggagtctcgttctatcaccaggctggagtacaacggtgcgacctcggctcactgcaacctccgcctccctggttcaagtgattctcttgcctcagcttcccgagtagctgggactacaggcacgtgccacgccaccatgcctagctaatttttgtgtttttagtagagatggggtttcaccatgttggccaggatggtctcgatctcctgaccttgtgatccacctgcctcggcctcccaaagtgctgggattacaagcgtgagccactgcacctggctttttttttttttttttttttttggtagggaagaggtctttctatattgcccaggctgctcttgaactcctgggctcaagcaatccacccgcgttggcctcccaaagtgctaggattataggtgggagccactgtgctcggcctctgacactaaataatgtcagttaagggaatgagaaaaagggcaggtcacgcacctggaacctgggctgtgccaaaaggtcaaatgtgcacgtatatacagtgactaggtgacaaatgcaatggagcatcccaggctgggatgaaggccaaggccacctacctatgaggaacaaccactgcctggctggaacgttccagaacccagtggtttccatagctgccctacgacttccgagatgactaaacccaccaaggactctatcacactgcttgtcttggccactcacccaccgtggatgtgcacagaccagtggctcccacgcagcacaggccagacaaaagctggaaggtgaaggcttcttaccttagaaagacaaagtggggcaaccgtggaaggccacattccagacactaaggggccaggagcaaacgcagccctgggccccggccctggggagatgtcaggcccgtcacatcccaggcaacatgtcaggaagatggaactcaggggtgctttcccgccccaggtgtcttccgccctgcagagcagctatggatctgcaaaggggactggaatgctgcagagccccgggctccatttggaaactctggcaggatgaagaagctggagaccacgtcctgggaaggctggggtacagcagggctccctgcagcagacgaggggtccctcaaattcatgtgcacccagacctcagaatgtgaccttatttggaaacacgggttttgatgatataattagttaagatgaggtcacagtgtattgggggaccctaaacccagtgagtggtggccctaccaaaaaagagactgggcatggcggcacacacctgtaaccccagctactcaggaggatgaggcaggaggaacacttgagcccagggattcgaggctgcagtgagctatgatcatggcactgtattcccgcctgggggacacagcaaggccccgtctcaaaaaaaaaagggggggggagcaggtggggggtacacacagagacagcgcacagggtcacagacacacaggagaggggttgggacgtggggatgaggctgtatgccagcagccactggatgctggaggcagctgatggaccctcccaggcccttcaggagccagccccacgaacaccttgagtgtcggcttctggcctcctgagtgtgtctctgtggctgaagcccctgctctgtgtcacctgttctggctgccactggacactcagagcctgtccttgcccttgttctgcacccagtgcccagcttcctctgcggcctgggcatcccaaatgtcccctgctggcctcatactgggccatgggaggaaacgggcagctggcaatgctttcggaccaggctgtctagcagtttcctgaattctgtgcccagggatgagagtcctggaaagggagtttcaggcctggtgatcaggctttggcaccggggcctccaggagccaccggctggagcgtcggcaaggagcctgcccccatgtgggtccgctggtgcttgtgcaggtcggtgccccggcggaagccccggccacaggccgggcaggtgtagggcttctcacctgtgtgcgtccggcggtgggcgctgaagtgcgagctgttgttgaagcgcttcccgcactgggtgcaggcatagggccgctccccgctgtgtgtcctgcggtggatgaccaggctggagctctggctgaagcgcttcccacactcggggcacgggtagggcttctcgcctgtgtgcaccctctggtgcgtgctgaagttggagcggtcgctaaagcccttcccacagactaggcacttgtaaggccgctcgcccgtgtgtgtgcgctggtgcttggtcaagtgggacgtcttgctgaagcctttgccacattcggggcaggtgtacggcttgtcagccccatgggaagcccgtcttcctggtggggggccgcctcttggctgatcaggcctgaccaagcccctgactggggctggcctctgacctgggagcgggtggccaggcccctggcatcgtgccgagagcactcggtaccactccattctcaacggggcatcctccctgccatcaccgccgtcctccaactggatcccaggtcctgagacagagaaagcacgatctctaggaactcacagcaagagggcaagggaaatccttctaataggaaaatgaaggcctcacagggctcctaaggttcccctacaaaacatttagcaggggctgggcactgtggctcacgcctataatcccagcactttggaaggctgaagtgggaggattgcttgagcccaggagttcaagaccagcttgggcaacgcagtgagatctcgtctctacagaaaataaacaaaactagctgggcatggtggcgtgtgcctgtagtcctagctactcaggaggctgaggtcggaggatcacttgagtctaggaggtcaaggctgcagtgagctgtgatcgcgccactacattccagcccgggtgacggcatgagaccctgtttcaaaaactaaacaatcaataaaacaaacaaagaggaacgcacttgaccatcacaataacccagtgggtcagtgctgttaccatctccatcctgcagatggggaaaccgaggcacacaagtgttaagaaacttacccagaatcaccgggctgctaagttacagagtgagggccatcaagctctgcactctgctgtatcctctaagccaggggttcccacccagtggcaaggtctggagacatttttgttgtgtctggggagggggttgtaaatggcctctagtgggcaggggccagggctgctggaaaacctcccacccagcacaggcagccccacgtggagagccatctggcccaaatgccagcagcaccaaggtggagaagccctgctctgggctgttctggctgagcagagcagtcgtggctcccagccactggacctcccttgtcgtacttggtgtggcccctgaggcccctctgcagatccaggttctagagccaccaccaacaggacaggagaacagggagaggggcctggaatgatccaggctttgcccctttcaggaaaaagcccttgacttctctgctcttcctttgcagcatgagggtgactgcagctggggacctggtagcacaaagtgcactggggtgcctggggggctgggggagcagccgtcttcatagcagtcccgcaagaggctctgcgcatggtaggcacacgccatgctgacctcacaggggagggacagaaccacccactgcccttggaaatgtccactttaagacactcccagccccagacctcctgggcgaatccttcttgccctcccctcccatctccaggaccaacttccagatagccgaaggtgggtttggcacgtactgagcctcaaattccacatctaaaaaactgagaggaggccgggcatggtggctcatgcctgtaatccaagcactttgggaggccgaggaaggcggatcacttgaggtcaggagtttgagaccagcctggccaacatggtgaaaccccattttattttattaaaaataaaaaaattagttgggggtagtggtgggtgcctgtaatcccagctacttgggaggctgaggcaggagaatcgcttgaactcgggaggcagaagttgcaatgagccaagatcgtgccactgcactccagcctgggcgacagagcgagactctgtctcaaaaaaataaaaaaaaaaaaaatagaaaataaataaaactgagaggaggattggaaccacctcattggcctgctataataatattttatttatttattttaaagacagggtgatatggtttcgatctatgtcctcacccaaatctcatgtcagactgtaatccccaatgtggaggtggggcctggtgggaggtgagtgggtcatggaggcagatttctcatgaatggtttggcaccatcctcttggtactgtcctgacaatggtgagtgagttcccatgagatgtggtcgattaaaagtgagcggcacctcccctcgctcctttgctcctgctccagccatgtgagacatgcctgctccctctctgctttccaccatgactggaagcttcctgaggcctccccaaaagctgagcagacaccagcatcatgctttctgtacagccaattaaaccttttttctttataaattaccaggtctcaggtatttctttacagcaatgcgagaatgacctaatacacagggcctcactatattgcccaggctggcctcaaactcctgacctcaagtgatcctcccacctcagcctcccaaagtgctgagatataggcgtgagccacagcacccagccttgttgtaaaaatatttttacttatttatttatttatttttgagatggagtctcgctctgtcttccaggctggagtgcagtggtgtgatctccgctcactgtaacctctgcctcccaggttcaagcgattctcctacctcaggctcccgagtagctgggattacaggagtgagccaccacacccagccaatttttgtatttttagtagagaaagagtttcaccatgttggccaggctggtctcgaactcctgacctcaggtgacccaaccgccttggcctcccaaagtgctgagatcacaggggtgagccaccatgcctggccgtacaaatatttttaaaagagactgagtctggcagctcatcaaaaggtaaacaagagtcattatatgagccaatgactttactcctaggtacacacccaagaaaactgaaaacatgtcctcaaacagaaatgtgtacataaatgttcacgacagcactcttcacagtagccaaaaaatggaaatcacccaaatgtccatcaacgaaaatggatcaacaaaacgtggtctatccatacagtggaatactattcagccatgaaaaggaagcactgacacatgctataccacggatgacccaggaacacatgacactgagcaaaagaagccagtcaccaagggacagtccctgcacgattccctttacagaagacaaccagaataggcacacccagagacagagcagacaggtggctgccagaggctaggggaggggaaatggggagaaactgcttgttgggtacgaggtttccatttagcatgataaagaatgtttttgagggccaggcctgatagctcacgcctgtaataccagcactctgaaatgccgatgcgggctgatcatttgacgtcaggagttctcgccaacatggcaaaacactgtctctactaaaaatagaaaaaatattgggaggccgaggcgggcagatcacaagatcaggagttcaagaccagcctgaccaacatggtaaaatgctgtctctactaaaaatacaaaaattagccaggtgtggtgatgcacacctgtaatcccagctgcttgggaggctaaggcacgagaattgcttgaacccaggagatggaggttgcagtgagccgagatcatgccactgcaatccaacctgggtgacagagtgaaactccatctcaattaagaaaaaaaaatgtttttgagcccgggtaacacagtgagactccatctctatcaaaaaatttttgtcgcccaggctggtgtgtaatggcgcgatctcagctcactgcaacctctgcctcctgggttcaagcgattctcctgcctcagcctctgagtagctgggactataggtgcatgccaccacacccggctaatttttttgtatttttagtagagatggggtttcaccatgccggccaggatggtctcgatctcttgacctcgtgatccacccgccttggcctcccaaagtgctgggattacagacgtgagacaccgtgcccggcccaaaaattttttcaaaattagctgggcatggtggcattgacctgtggtaccagctactcgggaggctgaggtggtagaatcacctgagcctggggaggttgaagctgcagtgagtcaaaattgtgctactgcactccaacctgggtgacagagtgagatcctgtctcaaaaaaagaaaaaaaaagttttggaactatgtgttactgcacccaacctgggtgacagagtgagaccctgtctcaaaaaagggaagaaaaaagttttggaactagatgaaggtgatgattgtacaacactgtgaagatacgaaacgccactgaaccgtttactgaaatatggctaattttatgttatgtgaatttctttttctttgagcagcagcaagatttattacgaagagtgaaagaacaagtttccacagtgtggaaggggacccgaacgggttgcccgtgaatttcatctcattaaaaaatgtaaaaactttgaggccaggtaccaacctaatttgtttttttgagacagagtctcactctgttgcccaggctggagtgcagtggtatgatcacagcttactgcagccttgaccccccaagctcaagtgttcctcccacctcagcctctcaagcagctgggactacaggcatgcaccacttttgtatttttttgtagagacaaggcttctccatattgctcaggctggtcttgaactcctggactcgagcaatccacccgccttgacctctcaaggtgctgggattacaggcatgagccaccatgcccggcccgtttttgtttttgttttttggaaacggagtcttgctctgttgcccagactggagtgcagtggtgtgatctcggctcactgcaacctccgcctcccgggttcaagcgattctcctgcctcagcctcccgagtacctgggactacagatgagtaccaccacacccagctaatttttgtattttttaggagagacagggtttcatcatgttggccaggatggactcgatctcctgacctcatgatccacccgcctcagcctctggaagtgctgggattacaggtgtgagccaccgcgccagccaattttttttttttttttgacacagagtttcgctcttgttgcccaggctggagtgcaatggcgtgatcttggcttactgcaatctccgcctcctgggttcaagctattctcctgcctcagcctcccaagtagctgggattataggcacccgccatcacgcctaatttttgtatttttaatagagacagggtttcaccatgttggccaggctggactcgaactcctgacctcaggtgataaacactcgcctcggcttcccaaagtgctgggatcacaggtgtgagtcaccgtgcctggccatttttttttttaagcaagatcaaatagatccaattttcctcggccccacagaccttttttaccataggctctggcgccgggtaagtaaaacccaaacacatgcctgtgaccctgagagggaagctgtgtctgggctccaggagctggtggacagagctgggcagaatctcattccttcccttctgaggattccacgtaaccacttgggagccgggagggctggcaaattctttcccttttgacttctgccttttgcacagggaatgaactggaccacaggtaatgtgcgctcagagatcttcagatcagggttcctcaatcacggtgcaggtggtgtccatgggacctggcccgggctgtctctgatgcggccgccctgtgcaccgcaggaggttgggcagcatccccaccttctgctcaacaaataatcactttcatcagtgacaaccccagggtcgtgacaaccaaaaatgtctccaactcatggacagatgtcctctgggggacaagattgccccaggtggagaacccctgctctggatgcctgtcactaaagctactgatgaccaaccagagccccatacaacatcatctaaaactcttcataggcaacaaaagaaaaaaacgatcaactggacactagaaccaaaaacttttgtgcatgaaaggacgctaccaacaaaatgaaaatgcaacacacaaaataggagaaaatatttccaaatcaggccaggtgcggtagctcacgcctgtaatcccagcacttagggaggctgaggcaggcagatcacttgagatcaggaattcgagaccagcttggccaacatggcaaaacccagctctactaaaaatagaaaaattagccgggtatggtggcacacacctgtaatcccagctactttgggaggctgaggcaggagaatcgcttgaacctggaaggcggaggttgcagtgagctgagctgagatcgtgccactccactccagcctgggcaacagagcaagacttcatctcaaaaaaaaaaaaaaaccctgaaaataacaaccattggtatggatgtggagaaactggaacccttgtgcactcttgctgggtgcatgagatggtgcagatgctgtggaaaacagcatggcggctcctcaaaaaattcaacacagaatgaccacatatgctccagccatcccactgctggatacatccacccaggaacggaaagcagagttgatcagagatacacttgtacacccacgttcactgcagcattatttacaatggaatattcttcagccttaaaaaggaaaaaaattctggaggtttcccaaagaaggaagtctgcctcaagaccgtggcacagaaatcctaagcttccagtctgctggcctggcctgcagatttcagacttgtcaacttctgtaagcaaccaagggagctgtctaagtacccattccttaaaataaatctgtgtgtgtgtgtatcttctgttggttctgtttctctggagaagaaccctaatacaaagcgatatctcactgtcattagaaaaggcttcagcatggccacgcacggtggctcacacctgtcatcccagcactttgggaggcctaggccagcggatcacctgaagtcaggacttcgagaccagcctggccaacatggtgatgaaacccatctctactaataaaacaaaaattagccaggcatgatggcgagtacctgtaatcccagctacttgggaggctgaggtgggagcatcgcttgaacccaggaggtggaggttgcagtgagccaaggttgtgccactgcactccagcctgggcaacagagcaaaaatccatctcaaaacaaacaagcaaacaaaaaaccagaaaaggcttcagcagcatcaggaaaggcaggaagagacaaacggacagagaaagagcttaggggacggtgctgggtaacaggcagggcagtgctcagtgtgatggggagaggctggagaaccaggtcctgtgggagcagctctgcccttgagaggagggcacagggaagctgaagtgaagtaggaccagcatgtagggggcagaggcagaagaacaggatggcaaggcagtgctgggcatctgcctgagtcacggccgagtggctgtgcaggccctgcaggtgggactctgcagggatacgggtagccctgtccacggaggatcgccccaggccaactggaccaacagaaccaagccccggagctggtgcctgacagttcctatttttggcaagccccctagaggacacaatcacttgcaagttaccttcattctccagcggcgcgtcccgctgagctgggtccatgcatcttggctcctccccagaaaggtatacagccacgtcctccaagttcacgggcacctgccagaacgcaccccactcagtcctggccccaagcaagctgcctcctccccaactaaggccactggcccagggagctgcaccgccactgcccctcgaggctggcgccaagcctggtggtgcagctggtcttctccactctcgttgcagtggtgagtcctggtgtctccgcccactgctcccatgtgccactgctgcagagctgggacaccaccggagaagggacagattcgccacgaggagtggtggacccactgcacactcagccaccgaggcccatgctccacagggagacaagagcatcccctggctccgtggctagccagccccaggaccccattgcggcagacgggggacttcaggatgcctctgggccagtggctcccagatgtagcaccagattgacccggaagcatgattaaaaaaacaagcaaactctttccagaacaggcaaattcacagagacaagaaggagctttgtggttgccagaggctgagggaaaaacaggtagagactctggtaatgagtctagggggttttcggggagggtctaaaggaaatgttcggccgggcgcggtggctcacacccgtaatcccagcacattgggaggccaaggcaggtggatcatctgaggtcaggagctccagaccagcctggccaacatggtgaaaccccatctgtactaaaaatacaaaaaaaattagccaggcatggtggtgggtgcctgtaatcccagctactcaggaggctgacgcaggaaaatcgcttgaacccgggagccggaggttgcagtgagccgagatcgcaccattgcactccagcctgggcaacaagagcaaaactctgtctcaaaaaaacaaaaacaaaacaaaacaaatacacatacatacacacacacacacacacacacacacacacacacacacacacacacacatataaaaattataaataaataaataaaaataaaacaggccaggcatggtggcttatgcctgtaatcccagtgctttgggagacttaggcaagaggatcacttgagcccaggagttcaagaccagcctaggcagcacagcgagactgtgtcccattaaaaaaaaaacaaaaaaaaaacaactagccgggtgtggtggtgcatgcctgtagtcccaactaactgaggaggctgaggcaggaggatcccttgagcctgggaggtcaaggctgcagtgagctgtaatcacactactgcactccagcgtgagcacagagccagactttggctcaaaacaaacaaacaaacaaacaaacaaacaaaaaccccaaaaaaaccagcaagcaaacaaaggagactcccattccagcccagcggtgtgggaggaagctgtgttttcccccagagtcccaagagattcctgtgcccagcagagtaggagtcaccaccctgtctcactggtggaccgcagaatcttccgggcacagccgagtacttaaatggcctctggagagaagaaaagacttcccaggaggccaggggaagtgactccagggttggggcaaagggagaaaactccagggaagagctcctctgacatccaaaaccttggcccccaggagaggtgtccccttaacaaggaagtgtgacacacaggaggtcgggccagaccccaggatgctgcagaccaggagcatcccactcacctgggaccaggccgaaaggaagggcgaggctgacgccatctcctgatgccggggagctggagggcctgggaaggagcagagtcaccaccagtcacacagctcacccagtactgcccctgccgtcccctgcacaccaaggccccaacagcccggcggctgcccacccaagatccactccttgctggagagcctgtgcaccctgcatccaggcaggcctctgccctggccacagtccacaccccagtcaccttcacctccctcccctgcaccacttctcattcctccaaaggggtgctactcacctctctctggccacaacagcgggcccctctgtggcctgtggctcagctgggctgggggctgctggctggagaatcgagcctcttcctccagggacagatcctctggctgagcctctgcctggtgttttaagaactgtccccctatcccgaggggcacctcgtcatcagaaagcagctctgagccctgcacacagacagtgatctccccaccagctcccagaaggccagaaggaaaaatccccgcagggccccacacccctcatctcaggcaccccagccggctgcccacccccgggctgtctgcagcctccctccctctgcccagccgtgtggcagtgttccctgcagccagctcccagcctgctctactccatggtctctccctgtcaccacaatcgtttccccatcacattcttaccctctattccttggtcctcctgatagaccctgggatagaccctgggccagaagagccctgagtcagcgctggactaatttcagaagttcacagaactgcatttgctagattttttgaaattatctggccagctgcaatggctcacacctgtaattccagcactttgggaggccgaggtgggtggatcacctgaggccaggagttcgagaccagcctaaccaacatggtgaaaccccatctctactaaaaatacaaaaattagccaggcatggtggcagcacgcttgtaatcccaggtacttgggaggctgaggcaggagaatcgcttgaactcgggaagtacaggttgcagtgagccgagatcgtgccactgcactccagcctgggcaaaagagcgagactccatctcagggaagaaaaaaaaaaaaagaaaaaaaaaagaaattatcaacaggtgctctgagatgatctatttcctaattccaggaaaggtgagttgaatgaaattgggtcttagaattgagctctgcaatagcacttggacaagagacatccctaggcaactacaaacccagcgtcagggacccatctcaggcttcctcttattcaacattccacacctctaagggagcgtagtccccttggggagcacagcctgcccctctcagctcagtgatggccatgaggcatgtgtgcagaggtgtcggtgcagtgacagaaggaagccatgccgggaaccccaaacactgaagctgtggtggccaggaaagaggctggccggctgggaagaaaccccgatttcttggccaccccgatggcaggattttctgactgcggtcagctcacgccgtggtcaagcattaggggatgtgcctcctctgttggctgcaaaaggccagcagtgtgcagccagcagcactgccacaggaagaaaggcagctggtcagcactgcccatgtgccccatccacgcaaggccctgaaaaatgaactgaaacagcaggtggcaggacttctttctaatctcaaggagttccacaactgaaactgaagcagcaggaatgagtaagaggcttcctctactccttcaaatggggctggaaggaggtggagaggcactgtctatagagatttcggtgtgtcagaagggtcctgtctgtgccatccagtacagtagccactggccatgtgtgacgactgagcccttgagaggtggtcagtgtgactgaggaactaatttaacattctacacagtggccgggcacagtggctcatgcctgtaatcccagcactttgggaggccaaggcaggcagatcacttgaggccaggagtttgagaccagcctagccaacattgcaaaaccctgtctctactaaaaatacaaaaatcagcctggcgtggtggcagatccctgtaatgccagctacttgggaggctgaggcacgagaatcactccagcctgggcgacagagagagactctgtctcacaaaaataaaagtaaaataaatgggctaggtgcggtggctcacgcctgtaatcccagcactttgggaggccaaggcaggtgaatcacgaggtcaggagatccagaccaccctggctaacacggtgaaaccctgtctctactaaaaatacaaaaaaattagccgggcgtggtggtgggcgcctgtagtcccagctgctgaggaggctgaggcaggagaatggcgtgaatccgggaggcggagcttgcagtgagccgagattgcgccactgctctccagcctgggcgacagggcgagactccatctcaaaaaaaaagaaaaaaaaaaaaaaagtaaaataaatgtacatagctataatttaaaaagctacatgtggctggcagctactgttttgcatggcacagctctagaacctctgggggctctaaccaaagtgccccccatgcccctggtctttcttcccagtgttctcccactttgggggtagtttcaactccctgccttggaaggtgccggacctctctcccaccaaaacctatgtttggggctggcgtagtggctcatgcctgtaatcccagcacttcgggaggccaagatgggaggatcacttgaggccaggagttcaagaccagtctgggcaacataacgaaaccctgtctctacaaaaaatacacaaaattagcaggtgtagtggtgcatgcctgtagtcccagctactcaataggctgaggtgggaggattgcttgaagcctggaggtagaggctgcaatgagcggtgatcacaccaccatagcctgggcaacagagcgagactatgtctcaaaaaaaaaaacatgtttggcctaccctaggacagtgttcacaaaccatctgcactagctaataaagggctattggggtaggatgaggttaatcaaagggtggacacccattagccaaggctgagaaatcttttgcagttgctttcctcaaaagggctcaggggccaggcagccacacttggtcacccaatgaccaaggaatctgcagctgcagaccccagcagcagggccccatttcctcacctgagggtcaaaatgcccccactcacccgctgcctgtgtttcctgggcttccgctgcagcccttccacaaggaccacggcctcctcaccgctctccggctgctgctcgcgtacccgagcctggatctcccccggcagcacagtcaggaactgctccagcaccagcagctccaggatctgctccttggtgcgcagctccggccgcagccagcggcagcacagctcccagaggcggctcagggcctcccggggcccagccacctcctggtagcagaagagccggaagagctggcggaaagtctcagggctggggtcctccgtctccacggagggctcctcttccaagcagaagtcctcctccaccttcacaatcaggatctcttcctgttccaggtcctgctccaaggttggcaggggctggaggccagggacagtggccattgcttccggtgggccttgttccttttcaggccttagagttgaacctgtctctctctatacctctggccagacacaggaagagagtttttttcagggccctgtggagagacgataaaaccatctgaagggcagccctggggctggataagccctttggcctgggaagcccctgccctggttccaaggccagctcaccccaccatggaaaaggaaaaggaagtggatgaatgtcatctttgttattaaccccctgttaattcccgggtaatttactgaagggctctgggctttgcttcctcactgggcaaacagagatgataacaggacctacacacacaggttgctgacagaactaaaagggatggctgggggcagtagctgacgcctgtaatccccgcactttgggaggcagaggagggcagatcacgtgagttcaggagttgaccacctggtcaacgtggtggaaccctgtctctacaaaaaatacaaaaattagcccgacatggtggtagcacatctgtaatcccagcaactcgggaggctgagacaggagaatcgcttgaacccgggagatggaggttgcagtgaactgagatagcgccactgcactccagcctgggcgacagagagagactcaaacaaaaacaatctaaaagggatgtttgcggtcagagctcgagaatcgttattttccatgattagagtgggtcctatatggaaggggttcctttggaaatctgatgaaaagtagggcctttctgcagactctgcctcaacttgatccccggtgtccaggtctggcgaaccctgaagcccctacgcggccccgtcaggcacccccgcgtgggtggtcacgacagccccccaattccagggtcctgggagagctgggacccccaggccgggctgctttcccgtctcatccctcaggtggagggtgagcggtacccgaggccgcggcacagacccgggtgctggcgcgggccgcgaaatcgaagcttcggccgggacccgcgtccccgcgccccccgcactcactggaagcgctgccggccgtgggcagttcggggcaggaccggagcggcgggtctcggcgggagtaggactgcgggcctcaggcttggcagccagggacgccagagccggggccgaagaccctaaaccaggggtgcaaaccaggccgtgcgggtgggcccgcaggcggcattgtgggtaacgtagccgtggcaccattggctaagccggccgttgggggcgtggcaacacggccgagtgggcgggtccgcgacgtgcactgtggttaatgtggtcctcaaaggcacgcattgtgggtaacgtagtccagcacctcggtgaccgcgcgagcgtgcggcgactctgcagcctctgggctactttcccagtcactgttccacacccgctccgctctcctctggccgcctcctccatctttaaagccagcaaagtcgtccgggcacggtggctcacacctgtaatcctagcactttgggaggccgacgcgggcggatcacctgaggtcgggagttcgagaccagcctgactaacgtggagaaacctgggcgtggtggttcatgcctgtaatcctagctactcaggaggctaaggcgcaggttgcagtgagccgacatcctgccattgtcctccagcctgggcaacaagagcgaaactccatctcaaaaaataaataaataaataataaataaataaaataaataaaggcagaagttgttcaagataaaactggaagagatgccaagtgcttgcgcccaccctcccccaagagggcccccaacaacgtccaaccccaaatatcccttgtcctgcctgcttctttctgacaacataataatgggcatcaatctttgttgttgttgttagagatgaagtcccaccatggtgcctaggctggtctcaaactcctgggcccaagcaatcttcccgcctcagcttcccaaagtgtcaggattacaggtgtgcccagccaggtatcaattcttgtatgtatgtatttatttatttagagacagggtctcactctgtcgcccaggctagagtgcagtggctcgaccttggctcacagcaacctccgccgcccggttttaagcaattctcctacctaacctcccgaatagttgggattacaggcacgaaccaccaggtccggctaatttttgtatttttagtagagatggggtttccccatgttgcccaggctggtctccaacggcctcaagcaatccacccacgtcagcctcccaaagtgctgagattacaggagtaagccaccgctcccggtcgcatcaattcttgagcatcaagcaagcaaaacacatttgtacttcgtttcttcctcatttagtaatagaggtactataactagacctaccggttcaacaaaacaaaacaaaaccctgaagctctgagagttttaagtattgaaccccccagagaaggtcaaacaggaagtacagaaatgggattggaacccaaatctttgattccagaacttcagctcctaactaccaggttaacgtagtttgcccctaatcctaacttgggcatcctaaggcccgtctcctatgctggattctcgctgcttttcctctttggttgaacatgatccggagtttccctctgcctggggtgcccaggaaagagtcccagcaccgagttcgggtgagcagcaacgcagcatacacagcaggcgtacactcaacgtacgccccgccccgcacaagctccgccccgcatgcgcgccccgcctcgcatcccggatctacccccggaatctcgcgcgtctttcccaaagcatcggctaggactcagcccgccggaaacaaatttggggacgccggattcaggaagctggcaggactacatttcccagagcgccccgcgccctccccggaggcagattcctgggcgctctagagggggtgggttggcggcctggagggtctcctcaagtggcggcactgccaggggctcggaggaaggggctgcagtctcccggtggcagcgtccttgtcgtcgagactgcgggcggttcccttgcgcgccctgaacctcagtttccatatctgttaatgggggacattaaccctcaaggttgtaactcattcaagaccattcatccaggcataataaatgcataaacgctgcacgttgagtcctcccaactgcccccttaactaggcgctcgggtgatggagtggtggcaggtgcctgctttcatggagcttgccatgagaggcatacagtggacaaaattaccatgagaggcatacagtggacaaaattgcacgaagaattgtttaatcacttctttggcaaatgttagcaagcggcgtaaaagagggaacctgataccttcagggtggaagtgacagttgagcagcctagggttaacctggggaaccggtggggaggattccagacagcaggagtgaaaagtgcaaaggtcctggggccggagagaacacggtgcgtttgaggaacagaatggagaccagagattgggagatgtggctggagggatgggcaaggcctgaccatacttggagactctggtgaggattaaggattttatccttggagtcaatagagtttggggttttaagtaggatagcatcgtgatcagataagaagctttgtggagtacagatctcagaaagactggagaggagcagtgagactagctggaagctcctggagtggtccagagttggggtaactagtgatggtggtagtcactgacaaggatctggccaagattcctggagcacattcaacagtgcttggtggttgattagcttggggtggaggagggagacaaggataactcctttgtacaatggggatggtaacatcacctgcagtaggcaccattatggtaaagagacagaacagaacgtcagacacatataggcttaatatgtcctaattctgttagtaataaagactacctctgtgttcagggcagtgttgtttgtaatggcaaaaccgaaaacagtctaaatgttagtcaacaggagaatgatggataaatctcacggaggctatgccaaacaaaaaaaggcaagtggcaatatgatacaattttcataaattttgaaaatgcaaaacaattctacatatgatttagagacatgtatgcggttcaaagaaatgtttgggacttggatgaacaccaaattcaggatggtgatggggcaaacgttgaagagggatgtgatggggggaaggttcagggggcaaaaactgcaagttttaatgtgctttttatttatttttaatttatatatttatatttttatatttatttatatttttttatttatttttacttattttatttttttttgagacagactctcactgttgcccaggctggagtgcagtggcgcaatctgggctcactgagacctccgcctcctgagttcaagcgattctcctgcctcagcctcccaagtacctgggattacaggcatgcaccaccacacccagctaattttcgtattttcagtagagacgggtcttcaccatgttggccaggctggtcttgaactcctgatctcaggtgatccaccctccttggcctcccaaagtgctggaattatcaggtgtgagccaccgcgcctggccattaatgtgctttttaaaaacaacaacaaaagccattattttgaatttgtattcatgaagtattaaaacctaccaaatgttttaataaataatcttaaataggccaggtgcggtggctcacgcctgtaatcacagcactttgggaggccgaagcaggcagatcacttgaggtcaggagttcaagaccagcctggccaacatggcaaaaccccgtctctattaaaaatacaaaaaattagccaggcatagtggcacacacctgtaatcccagctactagggaggctgaggtagaagaacagcttgaaccagggaggcggaggttgcagtgagccaagattgcaccactgcactccagcctgggcgacagagccagattccgtcttaaaaaaaaaaaaaaaaaaaaagccgggcacggtggctcacacctgtaatcccagcactttgggaggctgaagcaggtgggtcatgaggtcaggagatcgaggccatcgtggctaacacggtgaaaccccgtctctactaaaaatacaaaaaattagccgggcgtggtggcaggcgcctgtagtcccagctactcgggaggctgagacaggagaatggtgtgaacccgggagacggaggttgcagcgagccaagatcgcgccactgcactccagcctgggtgacaaagcgagactccgtctcaaaaaaaagaaaaaagaaaaaagaaaaattagaaggccaggtatggtggctcacacttgtaatcctaccactttaggaggccgaggagggcagattgcttgagtccaggagttcaagaccagcctggggctgggcgaaaccccatctctactaaaaatgcgaaaattagacaggcagggtagtacacgcctctaatcccagctactcggggggctgaggcaggaggatttcttgagcctgggaggcggaggttgtgatgagctgagattgtgccactgcactccagcctgggtgacaaagagagaccctgtctcaaaaataaaataattaaatcttcaaaaagagcctccagaggctgcagggctctgtagacaccttgattctggcccagtgatattgatctcatactcctgacctctggagctataggaggatacacgtgtgttgttttaagcctctgcatttgtgctaatttgttacagcagccacaagaagtgaaaacatatggaatgtagtgctctgggtggccagggaggctgtttcccctcctttacaacactggacagccttgggggatcccctaacacatgcgcataacagttagtggtgcacaatgtgggggtgctatgcttcccccaggggacacgtgacttgtcctggataatttttttttttttttttttttgagacagagtcttgttctgtcacccaggctggagtgcaatggcacgatcttggctcactgccacctctgcctcccgggttcaagcaattctcctgcctcagcctcccgagtagctgggattacaggcgcctgccaccacgtctggctaatttttgtatttttagtagagacggggtttcaccgttttggccaggccagtctcaaattcctgacctcaggtgatccacctgcctcggcctcccaaagtgccaggattacagacttgagccactgtgcctggccccaggataatttttaattagcaacaaagtgagagttgctactggtgtctggtgggtggaggccagggatgctactaaacatcctacagtgtacaggacagtccccaccacaaagaatgatctagactgggtgaggtggctcgtgcctgtaatcccagcactttgggaagctgcagcaggaggatctcttgagcccaggagttcatgaccagcatcggcatcatagtgagattctatctctacaacactagataaaaattagctgaggggcccagtgcggtggctcaagcctgtaatcccagcactttcagaggctgaggcgggcagatggcttgagctcaggaggtcgagaccagcctgggcaacattgtaaaaccctgtttctaccaaaaatccaaaaaaaaaaaattagctgggcatggtggcatgcacctgtggtcctagctacttgggaggctgaggtgggaggatcgcttgagcccaggaggcagaggttgcagtgagctgagatcatgcccacggaattccaggttcagtgacagctagaacccatctcaaaagaagaaaaaaaaatctttggctgctttgcctgtggagtagtcattcttttattcctttgctttcgtttttttttttgtttttttttttttgagacagagtttcgttctctcgcccaggctggagcgcagtggcgtgatctccactcactgcaagctccgcctcccaggttcacgccattctcctgcctcagcctcctgagtagctgggactacaggcgcccgccaccatgcctggctaattttttgtatttttagtagagacggggtttcaccatgttagccaggatggtctcgatctcctgacctcgtgatccacccaccttggcctcccaaagtgctaggatgacaggcataagccacagcacccggcccctttgctttcttaataaactttttttgaggcagagtctcactctattggccaggctggagtgcagtggtgcgatcttggctcactgtaacctccatctcccaggttcaagcgattctcccgcctcagcctccctagtagctaggatcatgggtgcgtgccaccatgcccggctaatttttgtatttttagtagagacagggtttcaccttgttggccaggctggtcttgaactcccggcttcaggtgatctgcccacctcagcctcccaaagtactgggattacacaggcatgacccagccttcttgattaactttcaaaaaaaaaaaaaaaaaaagcctggcactgtggctcatgcctgtaatcccagcactttgggaggccgggacgggcggatcatgaggtcaggagtttgagaccagcctactcaacatggtgaaaccccgtctctactaaaaatacaaaaattagccgggtgtggtggcgggagcctgtaatcccagctattcgggaggctgaggtgggcagatcacctgaagccgggagttcaagaccagcctggccaacatggtgaaaccctgtctctactaaaaatacaaaaattagccgggcatggtggtacgcacccatgatcccagctagtagggaggctgaggcgggagaatctcttgaacccgggaggcagagttgcagtgagccaatattgtgccattgcattccagcctgggtgacaagagcgaaactccatcttaaaaaaaaaaaaaaaattagctgggtgtggtggcatgtgcctgtagtcccagctactcaggaggctgaggtgggaggatcacttgggcctgagacgttgaggctgcagtgaactatgattgagccaccgcattccaacctgggcagtagagcaagaccctgtctcaaaaagaagaagaagaagaggaagaagaggaagaagaaggagaagaaatagaatgatctagcacaagtgctggtggtgcagaggttgagaaacctggtctgtgagatgtattcctagaaatgcaacggctgagccaaagggtgtgtgcttttgaaatgctgtagatgtttccatattgcccagggctaatcttttttttttatttatttttattattttattttatttttttattgatcattcttgggtgtttctcgcagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtacagaacaaaatgaaaagtctcccatgtctacccctttctacacagacacggcaaccatccgatttctcaatcttttccccaccttccccccctttctattccacaaaaccgccattgtcatcatggcccattctcaatgagctgttgggtacacctcccagacggggtggtggccaggcagaggggctcctcacttcccagtaggggcggccgggcagaggcgcccctcacctcccggacggggcggctggccgggcggggggctgacccccccacctccctcccggacggggcggctggccgggcggggggctgacacccccacctccctcccggacgggcccagggctaatcttaaaccttgggatgtgctgtgacgtgggccagtgtctcagccaactcagatgttggtcgtgggtggtttgagtgcccacgggctctggaagctccccagtcctggagtcagcctgcggtgtgggtggagaagctggtttgtgaattcaaccagcagatcgctgtagggcaggcaatgcagggtccgttctgttcagtcagcagccctgttcttaccacctgccatgcactggatgcagggatgaaactgacatatctctgccctcactatgtttccagcctaatgggggagactgaccaggaaacaaactaggtgacacacactcagagggggcagtgagtgggttgcctggggaaggcaaggagggcttcagggagaaggtgacttttagttggaacaaaactgctactcattgttgtcatttgttgaaggctcaccttgcacccagcttcctagattagaggggtagccctttcttttattaccaaactaatgactaatgtagctttggcccccatggtgtgggattctgtgaaatccatttattttctagcttttttgttttgttttgttttgtttttgagatggagtctcgctctgttgcccaggctgaagtgcaacggtgtgatctcggctcactgcaacctctacctgctgggttcaagtgattcttctgcctcggcctcctgagtagctgggattacaggtgcgtaccaccatgcccggctaatttttttttttttttttttttttttttgagatggagtctcgctctgtcgcccaggctggaatgcagtggcgggatctcggctcactgcaagctccgcctcccgggttcatgccattctcctgcctcagcctcccaagtagctgggactacaggcgcccgccactacgcccggctaattttttgtatttttagtagagatggggtttcaccgttttagccgggatggtctcgaactcctaacctcaggtgatctgcccgcctcggcctcccaaagtgctgggatttcaggcgtgagcaccgtgcccggcctattttctagctttctggagagtccctgggctgtggagctcacacattctgcagcaggtcctccaccctggactgctgctccatcttgatcatgtagcctctgtcttcatgccatttctccaggttgtggtcggcacatcctagggagtattttattttgtctgaacaacagtgctatgtgcttggtaccatgatccccattttacagatgaggaaagtgaggcaaggggagcataagtaactgacttgcctgctgggattttcacactggcattgccaggctccacagtgggagctgtttgctggccatgctggcccctggggcaggggaatgaggaaggtgggggatggtggaacacagagatcaggtaagacagccagagatcaggccacaaagatggggattttgaaagtgttcttggcctgtgggcctagccccgggccaggagtaaggggctgggacagatgggagagctgattttgtcacttgggtctggctctggggcagagggggctggttgtccaaggcatgccttcccaggccttcaagattcctagggccttgggtctcacattattcaaaaagaaacctgggtgctgtggctcatgcctgtaatcccagcactttgggaggctgaggcagatggatcacttgaggtcaggaatttgagactagcctggccaacgtggtgaaaccccgtctccactaaaaacacaaaattagctgggcgtggtggtgggcacctgtaatcccagctacgcgggaggctgaggcaggagaatttcttaaacccgggaagcagaggttgcaatgagcccagatcatgccactgcatttcagccagtgcgacagagtgaaactccatctcagaggctgagtgcagtggctcatgcctgtaatcccagcactttgggaggccgaggccggtggatcacttgaggtcagttcaagaccagcctggccagcatggtgaaaccccatctctactaaaaatacaaaaattagccaggcatgatggtgtatgcctgtagtccccagctacctgggatgctgaggcaggagaatgacttgaacccgggaggcagaggttgtagcgagccgagatcacgccatcgcactccagcctgggcaacaagagcgaaactccatctcaaaaaacaagacaaaacaaaaaaaaaaaaaccccagaaaactccatctcagaaacaacaaccaacaaccaccacaaaaacatacttggttggcagcagtggtaatcccagtgttttggaaggctgaggcggaaggatcacctgaggtcagctaaagaccagcctgagcaacctagtgaggccttatctctacaaaaaaaaatggtaaaaatcagcccatcaaggtggtgtcatgcccatagtcttggctacttgagaggctgaggcaggaggatcacttgagcccagaaatttgaggctgcagtgagtcatgattgcgccactgtactccagcctgggtaacagagtgacacccagcctttttatttgtggatagctcaaagaagtcatttacaaaatgccttttgttttcaaagcacagcttttcataaaaagcaaggctcacatttaatagatgctctggtacataggtgtgtgttgagagccgctggggactcaggaagcccagcagccccgggatccgccggtggtcagaactcatcatcagaatcgtcatgggcccccctgcagaccttgaaggtccggggggtggtcagctgtcctggggaggccggggccaggttcacccagccgggcccgcggggcagcaggtggctttcattgagtctgatgacgcggtagttctcatagtggatgttgtgggttatgtccttcaggtcttggaggtgggagctgggggaccggagacggtcagccccgatggtggtgtccccagggcccctcgccagccccctagccccaggctccccacaccctcaccggataagcaggtctctcaggagaggaaattcacagtgcgccatgttctccactgcaagacatgggactcagtatgggcgctgcttagtgagcactgagtaagtgcctactgtatgcaccacctgacaccatttcccttagcccttttcccacatttctctttaccctatcctgccttccctttgttggttcattcattcattcacccactgttgtgttcccagtgcctggtacaggcggctcctacaaatagctgtagaatgaatgaatccaccaatcattattgtattatatgtacactcggcctctgtatccatgggtgcccactgtaggacttgagcatctgccgattttggtatccctgggggtcctggaaccaccctctgcggatagcatgggtgctatatcataggcaatagtatagtatatttctggctgggcgcggtggctcacgcctataatcccagcagtttgggaggctgagttgggtggatcacctgaggtcaggagtttgagaccagcctggacgacatagtgaagccccgtctctactaaaaatacaaaaattagccgggtgtggtggtataatctgtagtcccagctatttgggaggctgaggcaggagaatcgcttgaacctgagaggcggaagttgcagtgagccaagatcgctccactgcactccagcctgagtgacaaagcaagactctgtctcaaaaaaatatatatatatagtatagaatatttctaataattataataatacatcacctgaccgggcgcggtggcacacgcctgtaatcccagcactttgggaggccgaggcgggcagatcacgaggtcaggagtttgagaccagcctggcaacatagtgaaaccccgtctctcataaacatacaaaaaattagctgggcgtggtggcaggtgcctgtaatcccagctctttgggaggctgagacaggagaatcacttgaacccaggaggcggaggttgcagtgagccgagatcacgccaccgcactccagctcgggtgacactgcgagactccatctcaaaaaaataaaaataaaaaataataataatacatcaggggctacatcctcgctgcccctcctgtgtcactttccctagctccctaaggcagtctcctctccctcccgccacaatcgccttcactgtgcctccccgacctgtccttgtcctgtcagctctatggggacagggaccctgtcagtcctccctttaccgtgcactgcagtaactgcacatagcggtgcctgatacacagtaggcccatcgtaatttccggccagccactagggcagccttgggtattgggcattgtgcaaaatggtggttctccccgctccaacaccctaggaagttgatgcactgtgatgcccactttactgtgaggaaactgaggcccagagggtccggaaacttgccacagcctcccagctggaaagagggaccattccccagggctctttgtctagtgggcttcacctttctgtgccctgtgatgggtgcgaaggttgcccaaggctgctctggtttccaaactgaccccacctgcatcctacccaggggccccgcactgaccttcaatgatgccccacttggtcttccggcccaggacacacctcccgttcaccaggtgctcttggtcagcccctaccacggcaaaagggattcggtcctgggaaaggagaagacacagagatgggaggattgacttcgctggggagaagagaagaaaagtcaaggcacccaggcaggagaggggagtcctatccttttcgaggagggaacatggtagaaagtgcacagaattcccaagttcaaagacataaagtctaattggtgcctctggctgagtgaggtagctcttgcctgtaatttcagcactttaggaggccgaggtgggaggatcacttgagccctaggagtttgagaccagcctgggcaacatggtgaaaggccatctctgcaaaaactaaaaaattagctgagcttataatcccattatattatatagcgtattatatagctcacacctataatcccatagctcactgcagccttgacctcctgggctcaagtgatatccccgcctcagtcccctgaggagtgaggaccataggtgtgcaccaccatgcctggctactttttaaacatttttagtagagatgagttctctgtgttgcccaggctggtctctaactcctgggctcaagtgatcctcccgcctctgccttccaaagtggtgggattataggagtgagctaccacacccagcctgcctgtcttcctatatataaagttttattggcacatagttgagcctatgagtcatttttgtctatggctgctcttgaaccatgacatcagagttgaatcatcacaacagagaccctacggcccagaaagtctaaaacatttactacctggccctttgcagaaaaggttgttgaaccctaccgtaaactccagttgtttacttgctcatggccagaagcagaaattcaaacttgcaaactccgaagtgacatatatgggtttttacttctgaattcatctgtgatggggagtaatgtggatgttgataatattgggcgtggtggctcacacctgtaatcctagcattttgggaggtgaaggcaggcagatcacctgaggtcaggacttcaagaccagcctggtcaacatggtgaaaccctgtctctaggaaaaataaaaaattagctgggtgtggtggcgcatgcctgtaatcccagctactcaggaggctgaggtgggagaatcacctgaacccaggaggttggaggttgctgtgaacggagatcctgccactgcaccccagcctgggccacagaacaagaccctgtctctgctgggcacggtggctcacgcctataatcccagcactttgggaggctgagatgggtggatcacaaggtcaggagatcgagatcaccctggctgaaatagtgaaaccccatctctaccaaaaagacaataattagccaggcgtggtattgtgcacctatagtcccagctactcaggaggctgaggcaggagaatcgcttgaacccaggaggcaggggttgcagtgagcggagatcacgccactatactccagcttgggtgacagagggagactccatctaaaaaaaaaaaaaagaccctatctcataaaaaaaacaacattaaaaacaaaacaaacaaaacattgtacggtacgggggtttttagtatttgaccagggttatgcaaccatcatcgcaatctaatttcacaacgttttcatcacgtccccccaaaaaaaccccataccttttagcaatcactccccatttctcccttccccacagcccctgactaccaccaatctactttctgtctctatagatttgcctatgcctatttgggacatttcatataaatggaatcccataatacgtgaccttttgtgtctgactgatttttgtctgagaaacatgtttacaaggttcccccacgctgtagcaggcaggtgacagggtgacagtgcttcatttttttttttttttttgagacagggtctcactcccttgcccaggctggggtgcaacggtgtgatctcagctcactgcaatctccatctcctgggttcaagtgattctcctgcctcagcctcctaagtagctgggattacaggcatgcaccaccacacccggctaattttgtatttttaggagagacgggatttctccatgtcggtcaggctggtctcgaactcccgacctcaggtaatctgcccacctcagccgcccaaagtgctgggattacaggtgtgagccaccgtgcccggcctttttttttttttttttttttttttgagacagggtctcactcccttgcccaggctggagtgcagtgtcacaatctctgctcactgcaaccttcaccttccaggttcaagcaattctcctgcctcagtctccccagtagctgggattacaggtgcgtgccaccacacgcagctaattttgtatttttagtagagacagagtttcaccatgttagccaggctggtctcgaacccctggccgcaagtgatctgcccacctcagcttcccaaagtgctgggattacaggcatgagccactgagcccagccttgaactgtacacttttaaagggtgaacttcattgcttttcatggttaagggatagtccatggtagggaataggccgcactgtgtttccccactcatctgttgatgcatatttgggttgcttccactttcggggctaaaataaataatgctgctgtgaacattcacgtacacatttttctgtgaatgtacatttttgtttcttttgggtatacacgtaggagttcagttgctgggtcatagagtaactgcatgtttaagcatttgaggaaccaccagactgttttccaaagtggctgagccattttactttccctccagcagtaggtgagggtttcagttcctccacatcttccacagcacttttttttttaagctggagttttgctcttgttgcccaggctggggtgcagtggcgcaatctcggctcaccgtaacctccacctccaagattcaaccgattctcctgcctcagcctcctgagtagctgggcttacaggcacccaccaccacgcccagctgatttcttgtatttttagtagagacggggtttcgtcatgttggccaggctggtctcgaactcctgacctcaggtgatccacccacctcggcctcccaaagtgcagggattacagggctgagccactgcgcccggccaacacattttttttttctgagatggagtttcactcttcttgcccaggctggagtgcaatggcgccatctcagctcactcactgcaacctctgcctcccagtttcaaaattctcccgcttcagcctcctgagtagctgggactaaaggcgtgcaccaccacacccagccaattttttgcatttttggcagagacaaggtttcaccatgttggccaggctggtctccaactcctgacctcaagcgatctgcctgcctcggcctcccaaactgctgggattacaggcgtgagccactgtgcccggcccaatgttctctatatattcaggatacaagccccttattgggtatgtgattcgcagacattttctccgattctgtgggttgttagtgtgagctgttatttcttgctcaccttgagcttgtggatgagtagagaatcatatctgctaggaatatgtgcacatttccctgagatgtagagaaagatgagtctttggatggaaaggatgtgtgggaaggaaatcacctcgcccgcctcccgccccacagcctctcacccgtaacttgctgttgaggattttgtcattgatgtcctcgtcaaagcacatctgggggtagacgtcgatgcagtgggtcctcaggttctgctggatctggagatcccacacaggtgacctcagcccaccctgcccactctgccctctgcccccgctgaccccagccctgcccgggcatccagatcaccctgcgcctgaaggcctctcgctcctccatggtcaggctgtcggccctggcaatcacgggcaccacattcacagtccggcacagccgctgcaggaactcaatgtccaggggccgcaggctgccggaggcagggcagtgatgggggtggcggtggtggtgagtgtataaacgacagcagcagggcacgggggtgggggcagccggcagcccatggtggggaccccttctcctcctccctgccccgtgcaggtggtcctcgccttgcaggtgcagccccctcaccagtgcccagtgggtggtacaaagtacacgcagcagtgcacccgggtgtctgggatgtggcgctggcgggtgatgaggatctcctcctgcaggtactgctcgtattgctcgttgatgtagcccaggatggggtcccagctgaggcgggaggtggaccctcccctcagaactgtgctgtgcccagagagccccacccctctcctctgtgtcctctgggcggtcctcccttgggacgacgaatcgtcccggttggcccgggacctgtgggtcaccccggtactttcccccacttccctgcatcatcagagacacacagggagacctcctgccattctcggcttcactgtctgtaaaatggagacaatagtagcacctacgttgcaagtaagggaggggtgagcattaactgtattaaagggccacagctgggcccaaaccaccaaggaatcgcgcctgatggttgcaggggtctccctcctcctcttcgagtcccttcccctcttgggtattgtcaacactgtaagtagccaaacagatccttttaaaaacaggtgtcaggccaggcccgatggctcatgcctgtaatcccagcactttgggaggcggaggcaggaggatcgctcgagcccaggaattcgaggctagcctgggcaacatggggaaacgccaactctacaaaaaatacacaaattagctcggtggggtggcacgtgcctgtggtcacagctactcaggaggctgaggcaggagggtccttgagcttggggaggtcaaggctgcagtgagccatgatctcgccactgcactccagcctgggaaacagactgagacactgtctctaaataaataaataaataaataaataaataaataaataaataaataaaatgaaaccagggccaggtgcggtggcttatgcgtgtaatcccagtgctttgggaggctgaagcaagtggatcacctgaggtcagtagttcgagaccagcctggccaacatggggaaatccccgtctctactaaaaatacaaaaattgggccgggtgcagtggctcacacctgtaatcccagcactttgggagactgaggtgggcggaccacccgaggtcaggagtttgagaccagcctggccaacgtggtgaaaccccgtctctactaaataaattcaaaaaagtagccgagcgtgttggcggatgtctgtaatcccagctacttgggaggctgaggcaggagaattgcttgaaccccgggaggcggaggttgcagtgagcagagattgtgccactgcactctggcctgggtgacaagagcgagtctgtcttaaaaaaaaaaaaaattagccggaaattgcttgaacccaggaggcagaggttgcagtgagccgagattgtgtcactgcactctggcctgggcgacaagagctagattctgtctcaaaaaaaaaaaagatcacacagcctggctgttccaggtctggggtgtttcccaaaggttgaagggggaggggcacggacaggaggggacagccatggcttggcccccacctttgagaacccaccacttgttgcgggcacagtggctcatgcctgtaatcccagcactttgggaggccgaggcgggtggatcatctgaggtcaggagttcaagaccagcctggccaacatggtgaaaccccatctcaactaaaaatacaaaaaaaattagctgggcgtggtggcgggcgcctgtaatcccagctacttcgggaggctgaggcaggagaatcacttgaacctgggaggtggaggttgcagtgagccgagatcatgccattgcactccagcctgggtgacaagagtgaaactctgcctaaaaaaaaaaaaaaagagagagaacctaccagttgtcattgttgatctggtccccgaagccgggcgtgtccgtcaccgtcagcttcagcttcacacccttctcctctatgactgtggagggagagcagagtcgggagagactggacccaggtgggatggggtggggcagggtggggtgaggtgtgggcaggggctcactcaccatgggtcagtgaatgcagctgcagcgtctggggtgtgggcacccccaagcccggtgggtttgacttccacactttggacttgaacagcgtgttcaccatcgtggacttgcccagcccgctttgccctgggagtggcaaccggatgacagcagttagggtgggcgttttaggcagtttttctctaactctttacttttctattttatttttggagacaggttctcactctgtcacccaggctggagtgcaatgatgcaatccccgttcactgcagcctcgaccttcccagactctagtgattctcgcacctcggcctccctagtagctgggactgtaggcacacgccaccatacccagctgatttttgcactgctttttttttttttttttttgagacgcagtctcgctctgtcacccaggctggagcgcgatggtgggatctcggttcactgcaagctccgcctcccagattcacgccattcccctgtctcagcctcccaagtagctgggactacaggcgcccgccaccacgcctggctaatttttttgtatttttagtagagacggggtttcaccatgttagccaggatggtcttgatttcctgacctcatgatccgcctgcctcagcctcccaaagtgctgggattacaggcgtgagccaccacacccggccttgcactgttttttaatttttaagacagggtctcaatctgtcacccagactcaagtgatcgcagctcactgcaacctccaccctcaggttcaaacgatcctcccacctcagccccccaagtagctgggattcaggtgcatgtcaccatgcctggctaatttttaaattttttttgtagagatggggtcttgctgtgttgcctaggctggtcatgaactcctggcctccagggatccttctgcttcagtcttgctctgtcacccaggctggagtacagtggcgcaatctcggctcactacaacatctgcctcccaggttcaagcaattctcctgccttagcctcctaagtagctcctaagtacaggcgcccaccaccacgcctggcaaatttttgtatttttagtagagacggagtttccccatgttggccaggctgttttcgaactcctgacctcaagtgaccctcctgccttggcctttcaaagtgctggaattacaggcttgagccaccatgcccggcctcatttttgtactttttgtagacattaggttttgctagtctcaaactcctgagctcaagtgatccacccacctcagtctcccaaaaccctggattataggtgtgagccaccgctccaggcacatttttgtcttttaatgactcagcatttctcaaattttcaatgacaacatccctgtgaggtgctattatcaggcccacctaagagatggggaggggcgacaggctgccaaaggtgaggccacacgcccaggcacgcgtagcactgtgggtctgtcctgccgtgggccctacctctcactcacccaccaccatgatgttgaactcaaaccccatcttcatagccttgatcttcagctggtccagcacagcctcaatgcccacaggaccaagcatctcgcagggtggggtgctggggctggagggctgcgaggacaggcagggagagggggagcgcctcagggggtccatgggggccaagggttcgagatgcctgtcaccaggtgggtggggagaagggggtcactggggctcagaggagcccacattgacctctcctatctgaacccctatttgagcttggccgttggccaaccccctccacacttcatgcctctggtgtaccctaagtgcctgtagtcccaggggtgtggcaagggtgcctgtggggagctgtttctgcagggtgcctcaacacccatccagagaggctccgctgcccaagggtctgccctgtccccacctacagcccaggcaggggcctctcaggtcgcttcccccagcagagcctggagggccaggcaaagtccaggatgggtgtttgcagccaggctggagtcctggaggggcttcagggagtgtgtatggggtgaagtggctcccgtcccagcaggaaacttgggcagggggctcaggaggaggtgcccccactttccccagggggacacacagcagagttgatagagagcgagaaagacggcacaggcatgaaggtgacggagacagagagagagagaccaaggtcaggcagggaagatggctgggagggagcggtgcgaagagcccacggggggcagagagagagagaagcagcctgctgtgacacctggtggacgtgggtcctggtggagcttccaggagctgccttgtcctggcagggcctggtgtgtgtgatgggggaggggagagggtgacagttaaccgaagaatctgagctccatctgcacttgctgtgacccccacctggaggcttctctgcagcaggagcaggagctgttacccttctaatccccacaatgaccccagcctaataatacaataatccccaagtagaaccaggggcccaaggccccctcgtcagctgggctcccacctccaagctgacgccctcaaccactctgctggggtgagcaaacccaggccccacagctggctagcgggatatccgtgtccacgattggcgccatgtgttttaagttgcagcgtcaaaaacatgaagagattgctttagcaaatatttacccagtcctgactctgcacatggcatcgttctaggagcccaaagatgttaacttgtttaataatcaagccctgtgaagtaagtgctgttactaccccaagctgatagataagagagggtcaggtgaggaggtggcagagtctctgccgctctgagtctgtgtgctcaccctctactgcctttttctggtttacagaaacatctagatttccggtgtatcttagaggttatcaccctgacttgagatgccctctttaaataggccatgtgctttccagactgtggtcctcacccctgccttactgtctctctgataagctgtttctttttttgttgtttgtttttgagacagcctcgctctgttgcccttgctggaatgcagtggcgcgatctcggctcactgcaacctccgcctcctgggttcaagcaattctcttgcctcagcctcccaagtagctggattaccggtgtgcaccaccacgctaattttgtatttttagtagagaaggggtttcaccacattggtcaggctagtcacaagcttctgacctcaagtgatccaccaaccctggtctcccaaagtgttgggattagtgagccaccatgcctggcctttttttttcttttttcctttttttctttttttttttgagacggagtctcgctctgtcacccaggctggagtttagtggcatgatctcggctcactgtaagctctgcctcccgggttcacgccgctctcctgcctcagcctcccgagtagctgggactacaggcgcctgccaccacgcccggctaattttttcctatttttagtagagactggttttccctgtgttagccaggatggtctcgatctcctgatctcgtgatctgccctcctcggcctcccaaagtgctgggattacaggcgttagcccctgcgcccagccctttttaaaatttttttgagacacggtctcactatgttgcccatgctggtctcaaactcctgggttctagtgatcctctcacctcagcctccctaaatgctgagattacagacgtgaaccaccatgcccagcctgataagctgtttcttataccaagtccatctcacacagttaattctttcttgtttcctggtacttgacttcacaaggcttaggcattcctgtgtccttgctattggcaaatgttttctctttcttttttctttcttttctcctttcttttctttcttttttttttttcttttttgggacagggtctcactttgtcacccaagttggagtgcagaggcacaatgacagctcactgcagcctcgacttcctgggttcaagtgatcctcctgccccagcctccctagtagctgggacttcaggtacgtagaccatgctgggctaatttttttactttttgtagagatgaggtctccctatgttgcccaagattgtcttgaactcctggggtcaaggggtccagctgcctcagcctcccaaagcgccaccacactcaggctggcaagtgttttctgtaaagggccagatggtccctattttaggctttgctggtcctaagttctctgttgcaactactatgcaacttttcattgcagtgagaaagtcgccacagacaataggtaaacagatgggcgtggctgtgtctaagtaaaaccgtattcacagaagaaaggtggccgtggttccagctttcctgagccccaggccgacttctgccctttgctgtccactaccttctgccagttcttccttctggggaactcccgctccttcctggaggcttaaccttaaaggcttagaggctaggggtcagccaggtgcgttgactcatgcttgtaatcccagcacttcaggaggccaaggtgggcagatcacttgaggtccggtttgagaccagcctggccaacatggcgaaaccccatctctactaaaaatacaagaattagctgggcttggtggcgggcacctgtagtcgcagctacttgggaggctgaggcagggagaatagcttgaaccgaggaggtggaggttgcagtgagccgagatcgtgccattgcactccagcctgggcgacagagtaagaccctagctcagtaaataaataaataaataaataagtaagtaaataaataaaggcttagaggttaagggtgggccaggcagggcccagggtggcagggacgatggggcacagcctgtcctggaccacagtttgttgtccaaggtgaaatcttgaaaaccacaattccacagcccttgagggattcagcacgggggcctctcccataagcagctgaggatgtggttagtggatgaacaaatggctctggtgatggtgacgtgtggactgcgtttgagcagtagacgtacctctggggatgtcccctaaggaaatgcgcctctgtgcagagaaaacactttctccaggaaaatcctcccatgtgagcgatggtctaattctgaaaatcgtggcggtgaggggaggagcctcactgggtgccagtagggactgcaccatgtaagtgccgtcaaaggagtagtttgcagaaagcatgctgtcatctggaaggtgctcccggtggtgttgactggcaaaagccagggaaaaaacgatctatgcagcgtgactatggtggaagaggacaaaagcctggatggaatcacacgtcaacacggcgataatagcacagggcattcagtgcacgtttctgtgagccttccatcatgcttcgacggctctgacatcgatgatcagttcatttcatcctcacgacactgggaggaggtggatactattaacatacccattttacagatgagtatactgaggcagaagggctcagggaacgttactcaagctcacacattggtgggtcttatggcatgcaatcgaacctgggtccagaagtctgactcaccggaaccactccctgccacagcctcctcctcctgttactgtcctgcctgggactgggcggggctctgtgacttttgtcttttttgttttctgagacacagtctcactctgtcacccaggctggagtgcagtggcgagatcttggctccctgcaacctctgcctcccgggttcaagtgattctcctgcctcagcttcccgagtagctgggattactggcaccaaccaccacgcccggctaatttttgtatttttagtagagacgggtttcgccatgttggccaggatggtctcgaatttctaacctcaggtgatctgcccacctcggcctcccaaagtgcttggattactggtgtgagccaccgcgcctggcctgactttgtcttttaacaacttggtggtttccagatcttctttaagagatagatacgactttcataatagtaacaacaaacattagaaacaaggtacccagagagacaggaagactgagggccagaggggagaggaggggacagtgggcctcctgcccacccagccaggccaagagctggagcaggggccacagttgttcccctgcacttttctttttttttgagacagagtctcgctctgtcgcccaggctggagtgcagtggcgtgatctcggctcactgcaagctccgcctcccgggttcatgccattctcctgcctcagcctcccgagtagctgggactacaggtgcccgccaccacgcccggctaattttttgtatttttagtagagacggggtttcaccgtgttagccaggatggtctcgatctcctgacctcgtgatctgcccccctcggcctcccaaagtgctgggattacaggcatgagccaccgcgcctagcctcccctgcactttttaaatagaagtatgtctgctgggcgcggtggatcatgcctgtaatcccagcactttgggaggctgaggggggcggattgctagagctcaggagttcaagaccagcctgaccaacatggtgaaaccccgtctctactgaaaacacaaaaatcagctgggtgtggtggtgcacgcttgaaatcccagtgattcgggaggccgaggcaggagaatctcttgaacccaggaagcggaggttgcagtgagccgacatcgtgccattgcactccagcctgccagcctgggtgacagcaagactccgtctcaaaaaaaaaaaaaaaaaaaaggccaagcatcgtggctcacacctgtaatcctagcactttgggaggccaaggtgggtgaatcacctgaggtcaggagtttgagaccagcctggccaacatggtgaaacccagtctctactaaaatacaaaagttagctgggcgtggtggcaggtgcctgtaatcccagctactcaggaggctgaggcaggagaatcgctcgaacccgggaggcggagattgcagtgagccgagatggcgccactgcactctagcctcagcaaaaagagcgaaactctgtctcaaaaaaaaaaaaaaaaaaaaagggagggaggaggattagagtcagaggaggagacgtgagcctggaagcagagggtggagggatgggagaccacaagcccaggaatgccaccaccctctagaagctggacaaggcaaaagatggactctgccctagaaccttcaggatgaacacagcctggtcgacccattttagactctgaccttcagaaccatagggcaatacatttgtgttgtttgaagccacagagtttgtggtagtgttacggcagcattgggacatggatacattaggtgtgtgacgggctaatggctaaacttctctaggcctccgtttcctcatctgtaaaatggaaaaagcaataatacccactttaggattgctatgaggaataaaccaggtgacacagcacagtgctcgatgcagagccccacattagctgatattttcaagtagtaaaatagagaaaataaggacagtgaagagtcctagtacagctggccttccgtatccacaggttccacatctgtggcttcagccaaccacagacagaaaatatttggaaacaaatcacatctctattggacatgtacagacttttttgcttactgttccctatacaatgtaacaattatttacctagcatacattatattaaataaatatatgtatacaattttttcttgagatggagtcttgctctgtcacccacgctagagtgcagtggtgccatcttggctcactgcagcctctgcctcctgggttcaagcgattctcctgccttggcctcccgattagctgggattacaggagtatgccaccgcacccagccaatttattttttttgagatagtcttgctctgtcacccaggcgggtgtgcggtgacatgatcttggctcactacaggctccgcctcctgggttcaagcgattctcctgcctcagcctcccaagtagctgggattacaggtgcccgccaccacagcggggtaatttttgtattattattattttttgagatggagtcttgctctgtcacccaggctggagtgcagtggcgagatctcggctcactgcaatctctgcctccagggttcaagcaattctcctgcctcagcctcctgagtagttgggactataggcgcgtgccaccatggccggctaattttttgtatttttagtagagatggggttttaccgtgttacccaggatggtcttgatctcctgaccttgtgatccgcctgcctcggcctcccaaagtgctgggattacaggcatgagccaccacacccgaccaatttttgtatttttatctttttttttttttgagatggagttttgctcttgttgcccaggctggagtgcaatggcgtgatctcggctcaccacaacctctgcctcccgggttcaagtgattctcctgcctcagcctccctagtagctgggattacaggaatgtgccaccacgcctggctaattttgtatttttagtagagacatggtttctccacgttggtcagtcaggctggtctcaaacttctggcctcagctgacccgcctctgcctcccaaagtgctgggattacaggcgtgagccactgcgcccggcccaatttttgtatttttagtagaggtggggtttcgccatgttggccaggacggtctcaagctcctgatctaagtaagtgatctgcccaacttggccttccaaagtggtgggattacaggtgtgagccaccaggccaggccaaatatattaagtattataagtaatccagagatgatttaaagtatagagtatatgcacaggttatatgcaaatactgcctcattttatatcagggagtttatagcatctgtggattttggtacccacggaggtgctggaaccaatcgttgaggattccaaggacaactctatgatgcaggcacacctgtcctagctgctcaagggtcgtgggatgcaggtaggttttctcccccttccccctccctcccacccaccttctctcccatctctctctctttcattcacgaagtcagcagtggccaagcacacaggtgttcccagctgcatatctgggatactgaggaaaggtaagaagtctcaggagtgaagaagccacaggccggcgtcttcctccctgggcctccagcagtggggagccagggagcgcacctgctgggcctgggccctctcccctgggctgggcggcctctgctggccctggggagggcggggctggttgccaaggcctcaggtggtgtggagccggaagcaggaagcagcctgtgctccccaggacctgcctggttgggggaattggaggcttctaggaggtaggtgggggcctgggggctgggctgccagggggagagagaggggagatgacagtggctggggagaaggttgtcagggtaaggaccacagggctgggcaaggagagaagctgggcctggggccgagggagaagtggagtgggagggggtggggaagctggcgctgggccaggagcgggcagtggctgggctgtgggaagcctggatgtggtccccgctgagctgagcccaggatcctgatgcagcctctgggggaccggggcaggtggcacggtgcacgccaagatggctgtgtccacagaggagctggaggccacggttcaggaagtcctggggagactgaagagccaccagtttttccagtccacatgggacactgttgccttcattgttttcctcaccttcatgggtaagtgtggctgtggcctctgggtcctcccagccccctgccctgggctccaggttggggccacacctggacgcctgtcctgtccccaggcaccgtgctgctcctgctgctgctggtcgtcgcccactgctgctgctgcagctcccccgggccccgcagggaaagccccaggaaggtgagcccctggaaggtgagccctgccggcctctgggacctgcacggaactgtactgggggtggaggcggaaggtgaggggagtggcgggaagggtgctcatccccctagggaacaacgagcgaacctgcttggtcccgctgtgcttctcgtgcaggaaagacccaagggagtggataacttggccctggaaccctgaccctgtgtctcctgcccggtggcagtaacaaagccttctgtctgcccagagcctgagtctgcagtgtcttccagtccccgtctgggtgggtgacgcgggactcgccgccccactcaggtggccacctggcctctccaagccttcagtcagcacgactgtgccaggtcatcctcagtcacctagctgggaggggagctggtctcaggccgggcgcggtggctcacacctataatcccagcactttgggaggccgaggtgggcggatcacgaggtcaggagatcgagaacatcctggttaacgtggtgaatccccgtctctactaaaaatacaaaaaattagccgggcgtggtggcgggcacctgtagtcccagctactcgggaggctgaggcaggagaatcacttgaacccgggaggcggagcctgcagtgagccgagatcgcgccactgcactccagcttgggcgatagagcgagactccgtctcaaaaaaaaaaaaaaagactcggtggcccaaagtcccaggtagagctcttgtcgccaccccatgggcttcttggcagcccgagggtcccctctcgacagtaggttctgtgccctgccctggcatggcacagggaacgcggaagccaggctccgggaataggggagacggctggctcctgaagctcatggccactgactaccagagaccccctgcctgggttcccactcagacagacagacaggggctccaggtggagtctgatgatctttatttcttagacagccctggactggggctatgaaacacagtcaccagcactatactcactcctagggtggctctgtctgtggcgttcctcaccatccccgggactcatagctcagtgccaccccccgacaccatgccctccagggggaggggacagcgaaggggagaggagggagagccctgcgcctggccctgtcctgagtccaaagattcccatggtgatcagagggcggtgttgggaatgtgggacacccttggccccgcctccctgacctccccactaccccaccaaaccagccttccttcctcctggcacttccagtgtccattcccggcagtgcaaatgtgttaggtggggtagggggtgggatagggagataaatagcagcctggcgttggcactggctggtgctctgtggtgggtatgagtaggggacggggccgccttcctggagacaagctcctgggtgctgtgatcagaagggtctgtagctccagtagctggagaacacggagatctgcaaggggagagggtgctgtaggttgctgaagggggatggggtagcccaggggagatgtcaaggtcacccaaggacaatatgtcaggacagggcattgctgcctcgcagtgctgtggggtacaccagaccccaaggttggggcgctctgagggtgtggcaaggacccttagaagtccttcccctaatgaaggcgctcggcccgggcccaccttgtccttgagctgctggcagagctgcagggagacggtgaagtagaccagggcgtcgttgagccaggggatcacgcactccactttgtgcacgtggctcacctccaggcgctgagagccccactcgctgtgggcagtgagagggtccctgaggagggtcccggccctccaggtgtggagggatggggtgggcgtgcctggaccccccgcccctgcctacttacaacatggccccagggctatgcagcaccgcgcccccagctgggcggaagttctagggagaacagcaccagacccgtcaggccttgcagggcgtgtgcatggcgggcagtgggccgggcaggggtccctcctcaccttggtggagttgggctgcagggcatgcagctggtacaccgtgaggcagagcttgttgaggttgatgtagacgttgaccagcaggtcggacggcagggcaggggcgaacatccgctgcgggaggcaggtgggatgaggccctcgcaagcccccagcccaggctggatggagcggggctctgcagtcactcatggagtctgcaggggatcccagtccccaccccagagatgctcttctcatcaatgggggcttccagacttttcccaggtgccccaagtatctcctgtgctgtcaggtttgggaaccactaacccgaaacagggttaacgtattttaggggcacaggacggaagccaaggaccccatcccagaaacctgcctagacagaatattccacctataatctgggagtggcacccctccgcgtccatcctgagggcaagctgggacccactgtgggacccctctcctgcagcaggggctggcaggggcactgaccgtgaggccgctggcggcgatctcggggagggtgagggtggcgggggtggtgagccggtttcgggctctggtcagctgcagcatcactgcgtccatcagctgcagggagaggcggggttggctctgcgtcctcccgtgtccccatgcattaaggaacaacagacatggtagctcccactcccacccagcccagtggctactgttcccaggtcccgaaacccggcagcagggacctgttaaagacaggtagttgggctccagctgggtatggaggagggcaggatgtctgcactaatgtcagtcgggatggggctgattcactgcacggggatcctgggtgctggatcaatggggaatggaaggtcctgggaggtcagtcccaggggcacaggctttgtggacaggggtacaggcaacaaaggttggttgtaaagggccagagagggcttcctggaagaggcgatggatgactgggttgaggttttcaggggggtaagccagggtcacggctgatggatggtgggaccacctggagcccattccttccctttgccgtggagcagagccctggcagactcctcagagccccagctttcgtgccattcagccgtggccatgagtaccagggtgatgtggctcccaggaaacacgtaagagctgactgggggtatagggcctgtagcaccctagggtggttacagttctcgaagggatcttagtctatctggttctaagtgtgaggaaacagaggtccagagagggcaggtgaaccaccggaggacacacagcaagtcaggggcagaactcaagcatgaggtcaggtgcccaggtcagctcttcacatgtgccacgcggttaatgtgaaggctttcactgctgctaccggcagtggtgtgtgccgagtgcttactgggggccccgtgacctgaattattatggtgaacagtcactccagcttgcccctgaccccacaggtagaaatggagacacagagtcggcaggtaagtgcttacaggttgcacagctcaacgtggaggccctgggattggaacccaggtgtgattccggatcaagaacgtgggactaggcccaggagtcaggcccgggggcagctcaccttgaggacctcagcgcccgtcttgaactggtagctctggtcccggctggtaagcaggtaaatggcttggctcacatggtttctggcatcctggatctggaagcaggggtcatccagaggggtcacgccagcttccatgcggccaggaggggagagtgggtgctgcctgcctgccccacgtcattccactctccacactgtcatccctgtgccccagagggccaggtccacgccaggtgatgggcatctggcatcacctggggcaggcctggtctctgcccaagctgactgccccctcctttctaagggatggacacacagtaatgcccaagacaagagtctgtgcgagttgcggagggaagcaaacagggcgacaaggcaggggcaagggtgctgagatggagacagtcggggtggagggggcaggggaggaggctggggcccattggtacaggagctgccagggagcatgggcctcatccccagagccatggcaagtccctggaggctctgggcaagggagtgacttttcagagggcttctgaaccatctcatccagccagctgctgtggggactccacagtcccgatgtggccctcggggctctcaggccaggttctctacctccccacatggcgcagcctccagggcttcaggaaacgcctgcccccagctttgctgttaggaaacaccctcccaggcttgctgtggccacagatccccagggctagtccctctccagggaggccccgcggcaggcctgctgccgcctgtccttgtggctgagcactagccaggaggggcggggtcacctgctgcagcttccactgcttgtcctcccggaaggcgaagtgcagcagctggttgttccggggcatcttcaggttcacatcctgacaggcaagagtggggtgagctgggcagtgggggggcacctcctgccacagccactctgagcccttaagcccagggcagaaatggggtgtgtggtggttcaggccttggccgctgtatagggcagagggtctcccaatgccttggccgtttgggggttgaacagggaggtcaggaaacaggaaaccaggcccaagaagagccacaaagaagtgaaatggaaagaggtgaagaaaggggaaggggaagaggaaaggcagcctctgtgaggctctgtgcgaacggggtgcatctagtgtctacaaagggcaacagatggagcccaggaggggggcctccccccacgccttggtgcctggcacagagtcgggtgcagactggagttcaggcattggctgattcaactgtgatgtgtggccagcctaatccaccaatgcccatgtttcactggtccggacgccaggccaggccgtgtgcaaagaacccctctcctgcacctcttactgaatctgcacaccgatcccgggagaaggtgtgagggttgctgtcattttccaaaggagaaaactgaggccagagagatcaagggtcccgcccagagtcgcagggcttgtacagagagaaagtgggagctcccatgctcttccccattggcaggatgggaggggacagggccgggggactcaccgcctggctgagggcatccccctgcagagtcagcacacccttcacctggtctgtgctgtaacatgtggcgtcagagcggtgcctgtggtcacccccccaccacccagccctccctcccggcgggctgcccctcctgtcccatcgcacaaccagctggtctgcaggacagggctatggccatgcctcctaccccccaaggtacccatttccccggtttccgcctagcccaggctcacccacagctgcctaggatgaagttctcttgcttggcgggcccctcagtgccggagcccggcagagtgaagcgcagagaggcctcctgtggaacagagggaaggaggggagctggtagcgcccactcaggcccggcccagtgctccttccagaagcccccctccctccaagtcagcggggggaaggaacaacgtggcctggcctcacctgggttcagctggggtgggaagaccctgcccaagcccccagggcacctaaccgtgagcccgatctctgcttataccacattccctgaacacctcctgtgtgcccgcctcggggaatacaaaacagacaggggcagcctcccagcttggttgagggggaaaggggcaaggggcagagtcagggaacaaggcagtagttatggtaacccgcggtcctgggccacagcaagcactacgccggttacttctgtgagctgcctggctcatttatctacaccccagcctcgcgaagcgggtactgttatctcccttttgccaatgagaaaagggaggcccagggaggttcagtgacttggctgaagtcacactgccaggcagaggcagaattcttcggctcccagattggatgccgctgctcccaaggcggccttccccgacccgaggccgggcgggactcaggcccttgctagcaccctcgtcgggacccgcccctgcccgcacacaggtacttatataatgaggtcggctcgagttcgcggaggcggggccctgcctgaaagccgcggcagccgcacactgtaggcgctcaggacgcagccgcgcggccccaggtggagccagggaaatgaggagggagggccgccacgcccggcggggcagggcgcgggtcgttaccttgaggatgtcctgcagctgcttcaacacagcgtgcacctcgtcgtgcagcagccagcggaactcctcctcctgcgggacagacccggcggtcgcgcccggccccgccgccccgccggcccgcccgctggcccgcgcgccttaccagcaccgcccgctccgccgccgtcgctgccatcacggtggccatggccgcaggccgccgccgagcgccctccccaccggccgctgctcctgtccaccaatctttctgtcctcggtcctccggtcctcccgtccgcccccggcgtctggctccgcccccacccgattggcggagcgggtaccaccccgcccccaggccggctccgtgctcgcgattggctggcgcctgtcggtccgcctcggcccccgaaacctgcgggagccctggaaccagactggcggctgcgggagtgaggctcgctccgcctggccagggacgcggccggcggctgcacgagtcaggcttgctccggctggccagggacgcggccggcaccagcctggggcgcccgcttgggggcggagctcccggggcgcccccaggatatgatagggcgctctgctccactcgcgctcactcattggccggcaggacagtctgtccccgctcctcctccctattggcccgcttggctccattggtcgtggttccaaccctgccgcggacctcgccgccactcccaagtccgtctcaccccggacgcggaggtcccgaaaacccaccccggccccgccgctgccttctcctcccacccatctcgccgaggacgagggaagcaggactcctgcggcacagctgtgttaccaagaagtgttttatttttcttgcagtagctttgttaattgcacaaaatcatgttttgtttttgccatttaaacattatcacacaatcctattctgaaagacaaatgttcattaaaaacaaagcaaaaataaaaattcacaaccttaattacctagatttgtcatttaaaggtttaaagaaaaaagggaggggctttcttacaagctttttcacaagtgtcacattttctccttaaaagggaaggatttcaaaagaaaggtgaaatagcttaaacagaaatattcataaaaaggaactttacagaattgtcaacaatattaagacaaaattgactaaccggtttcattaccgcatcttcccccgcccccacccccagtgtgttccgccaggactagaacaggctttgtgttcagacagaaatgcttcaaaatcccagtgaaatgaactgtgctaaaaacccgacaggcatcttccctgccctccccccactcgtcttctgcaatcctctaacccagtttctaatctctgaaaggggccaaagctgtgaggggggaaggaccccgccctagtgtggccaccctatatataattacatattgcatcgtaaatgctggccttccttctgcaaattatgattttggaaaatccaacccatgcagagggataaaaaactgacatcccttgggtaacttttttttttgcaacattccaagccccccccggtcccctatccaaggacaaatgtagggcctctaggatgtcccagacccacctcggagggccagtcagttcaggtaggtcaggcccagttctcttccctcccgacagaccccgggcccgggaagcaccgaagaccatgatgctggctggagtgaagacactcgtttccgtatcaagagctgagcctaagaaatgctcatcgttggtcaggctgggtctgggccaaagggacagacagaaagaaatactgtctccacgggaggaagagggagaggagggaggatggagagcggtgggcatgcaggggacttggcagggcagggtggagaaggtgggaccactgggaggggaccgaggtaagagtggctcttcagagccaggtgaagagtctgtggcctaacggaaacagaaaggagcgcccccaacccccactcctcttggctcatcactagtggccctgaggactccctcccaagggatggaatgcaaatccaaatactaaaacagcctagggaggagcgagcgcccgctgtggcagtggcatctggggcatggcttcgaggcggtgagggccgggcctccatgctcacctgcaggccggctgcttgctgcactccctggaaagccagggccccatcttctcgggactctgccagtctcttttcagttcacaaaggcgtctatggagcgctgggtgcacactggacgcttagacgtgaacatctttctcagctcatcacctgaggttggagggccccaagggcccctctgtctggagtctgtactggctcatctgggcccaaggcctctccttgtagggaatccagtgggggatggggacatgactacagcctcttcgctctgggggaagctgtgggaaggcttccaactctcgttgctgattctagttccttgactggaaggggtttgagataagacaagctcggaagaaaaaaagccaggcagcagtttctgggcagcttctatcctggggcgagagcctgtgtgtgtgtgtgtgtgtgtgtgtgtgtgtgtgtgtgaacacacagccacctcgtccggggggccagtgcccagctcaagagctttcccacacgccaatcctgctgacacttgtcccctccccaccggcctcaggggaagggtgctgctgtgtgctgtgctgatggcaagtctcaaagtctgtataaaaggaaatggagataggtgggctggtccagaatgaactcccaggcccccgaccccatgtgaggaagagggggtcagaggggggattggaggggtgagggcggggtgtcgacagcttagtgtatgtaggctcggtacacggcggacatatcgttgtcagactggtccagcgccttggctcttttgtacacctggaaaaaaaagagatggctcagtctctggccccagagctgccttcaagacctagacctgattcctggaggcagtggtggatgtggccagcaggcagtgctggagcccaggctgtccggttaggaatcctgtgttgaccttgcatgaagcacctccgtttctctggacctcagccactgtgcttcttgctctgggagaaggaacagtacccgggggatcttgtgagaatgaaatacactatgggatataaaacattcagcattggccgggcactgcggctcatgcctgtaaggccgaggtgggtggatcacctgaagtcaggagttcgagaccagccaggccaaaaaggtgaaacctcatctctactaaaaatacaaaaattagggccaggcgcagtggctcatgcctgtaatcccagcactttaggaggccaaggtgggtgaatcacgaggtcaggagatcaagaccagcctggtgaccgtcgtgaaaccccttctttaaaaaaaaaaaatacaaaaaattagccgggcatggtggcaggtgcctgtaatcccagctactcaggaggttgaggcaggagaatagcttgaacctgggaggcggaggttgcagtgagctgagatcacaccactgcactccagtctgggtgacagagcgagactctgtctcaaaaacaaaaaaagagcaaaactgtctcaaataaataaataaatgaataaaaaataaaacaagggcagatgaaacacccaggacacctatacctcagagtgagagttctcacacctgtggtgcttctgcccccaggggacatctggtaatatctggagacattttctgtcacctgaggaggagctatgtcactggcgtctggtgggtgggctacccaacatcctgcagtgcttggatagcccccccacacagaatggcagcagtgccgaggttgagaaaccctgccttaaaggatgagggagaggaagggggaaagaaatgcttctgtgtggttgcaaagtttttacatttaatgggaaatggtacaagattaactgtcttttttttttttcttgagacagggtcttgctctgttgcccaggctggagtgcagtggtaggatcatggctcattgcagcctcgaactcctgggctcaagcaatcctcctgcctcacctgcctcagcctcccaagtagctaggaatagggtgctcgccaccacgcccagctagttttttatttttttttgtacagatgggggtcttgctatgttgcccaggctggtctcaaactcctgggcttgcttaagcctcgaccctgcctcgaccctgcctcgacctcccaaagtgctaggattacaaggatcacaagtataagccactgtgcctggcaagattaactctatcttaaggatttataccgcaatctgtagagtaaccactaaaaaaagaatgcagaggcaaagtaaaaaagaaaatagataaatgaaactggaattcttttttcttttttttttttttgagatggagtcttgctctgtcgcccagactggagtgcagtggtgtgatctcggctcactgccagctctgctctgcctcccgggttcacgccattctcctgcttcagcctcccgagtagctgggactacaggcgcccgccaccacgcctggctaattttttgtatttttagtagagacagggtttcaccctgttagccaggatggtcttgatctcctgacctcgtgatccacccgcctcggcctcccaaagtgctgggattacaggcgtgagccactgcgcctggccccttttttttttttttttttttttgagacggagtcttggtctgtcgcccaggctggagtgcaatggcacgatctcggctcactgcaacctccgcctcctgggttcaagtgattctcctgtcccagcctccggagtagctggcattaatagtgcccgccactatgcccggctaatttttggtatttttagtagagactgggcttcactatattggccaggctgatctcgaactcctgacctcaggtgatctgcccgcctcagcctcccaaagtgttgagattataggtgtcagccaccgtgcccagctgaaactggaattctaaaaagaaagtaagaaaggaggaacaaacaaaagacaaagacaacgaacagaaatcaaatgataaaatggcagccccaaattgaaccacatatcaatacaactactaaaggtcaatgcaccagttaaccttcagaacctaacctctgaactcctaacagtatagagtctaagctcataccatccaaacgacctgaaagcagcgagctgcattgagaaattaacctaaaaactctgcttccaagccaatgaatcctgtagtcagggtggaggcaacttggaagtcacttcaaagagaagctttcccagcccaagccacatgaaacccttgggaaataactatagtcagaaatgagctttcatcaaaaaagacttataaaatacacaacgaattctactatccagagagaatccactggtagaatgaacaggggggacttgaaatagtaatgtaatctgaaagagtcatgaaataagtactctgaaatgttgaaacagacaagagacagaagacagaatttaggaacaaggctgcatgcggtggctcatgcctgtaatcccagcactttgggaggccaaggcaggcggattacttgaggccaggagttcgagtccagcctggtcaaaatggtaaaaccctgtctctactacaaatacaaaaattagccaagtgtggcggtgcatgcctgcggttccagctacttgggaggctgaggcaggagaatcactttaacccaagaggtgggggctgcagtgaactgagatcatgtcactgcactccagcctgggcaacagagtgagactctgtctcaaaaaaaaaaaaaaaaaaaaatacaattcaggaacagagaattatactatgaaaagccaggtgtcaaaagaacagtactggctgggtgccatggctcacgcctgtaatcccagcacttaggtaggctgaggtgggtggatcacctgaggtcaggagtttgagaccaacctggccaacatggtgaaaccgtatctctactaaaaatacaaaaagttagccaggagtactggcaggcacctgtaatcccagctactgtggaggctgaggcaggagaatcacttgaacccaggaggcagaggttgcagtgagccgagattacaccattgcactccagcttgggcaacaagggtgaaactcggtctctaaaataaaataaaataaaataaaataacataaaataaaagtgtatcagctgatagtactttaaaaatacagctgctgtttcacaaagtgtcatttttattataataatatggtaaagacaaatgtttttcagttgttttttttttagattcaaattctatgaagatgagctaagaaagcggaacttctaccctaaaaagcttttcgaaagtgtatgtgaagttggatacagttgtgcacgcctatagtcccagctactcgggaggctgaggtgggaggattgcttgagcctaggaagtcaaggctgcagtgagctataattgtgccactgcactttacctgggcaagagagtgagactgtgtctcaaatataaaaaaagtgcacgtgttaagtgcttaaaacatcatttgaaaaatgctaatagacatgctaattaaaaggcagatactgtcaaaatggataaaaatccaaaccccaattacatactgtctatcaaagccataatttagacataaataagagaggaaatggatggaaaaatatacataccatgaaaacaataagcctgagaaggctgtagcagctttcgtttttttttttttttttttgcgatggagtctcactctgttgcccaggctggagtgcagtggtgcgatctaggctcactgcaacctcccgcctcccaggttcaagcaattctctgcctcagcctcctgagtagctgagattaaaggtgcctgccaccatgcccagctaattttttgtatttttagtagagataggggtttcaacatcttggtcaggagaatgagaccatcctggctaacacagtggaaccccgtctttactaaaaatacaaaaaattagccaggcatggtggcaggcgcctgcagtcccagctactcaggagggtgaggcaggagaatggagtgaacccgggagacgaagcttgcagtgagccgagatcgtgccactgtactccagcttgggtgacagagcgaaactccgtctcaaaaaaaaaaaaaaaaaaaatcatacaggcagctggttgtggtggttcatgcctgtcatcccagcactttgggaggctgaggtggacggatcacctgaggtcagcagttcaagcccagcctggccaacatggtgaaacctcatctctactaaaaatacaaaaatcagttgtgtatggtggtgtgtgcctgtaatcccagctactcaagaggctgaggcatgagaatcgcttgaacttgggaggcagaggttgcggtgagccgagatcgcgacactgcactccagcctgggcgaaagagcaaaactctgtctccaaaaaaaacaaaaaaacaaaaaacaaaaaaacaaaaaaaacccaatacagggcagggcatgttctttgatcatagagcagtaagttaaaaatcaataatcattagatatctaggaaaacccaaacactagataaacttttaagtaattcatggatcaaagaagaaatcagaaaacaaattaacacggattagtggacatttaaagatttatatactcatgttataaagaaagcaggattaaaataaatgatttaagattccactttaaagggtttgaaaaagaacaaagaggccagacacagtggctcacacctgtaatcccagcactttgagaggctgaggcaggtggctctcctgaggtcaggagttggagaacagcctagccaacatggcaaaaccccatctctactaaaaatacaaaaattagcagggcgggttggggcacgcctgtaatcccaggctacttgggaggctacttgggaggcagaggcacaaaaatctattgaacccaggaggcagaggctgcagtgagctgagatcacaccactgcactccagcctgggcgacagagtgagactctgtctcaaaaaaaagaaaaagaacaaagaaaagctaaactaagtagagggaaggaaacgataaaagaaaaagaaacttggccaggtgtagtggctcacacctgtaatcccagcactttgggaggccgaggcgggcagatcacgaggtcaggagatcgagaccatcctggctaacatggtgaaaccctgtctctactaaaaaaaaaaaaaaaaaaaaaaaaaaaaaaaaaattagccgggcgtggtggcaagagcctgaggcgacagagcaagactctgtctcaaaataaaagaaaaagaaaaagaaaaagaaactgaatggctgggcgtggtagctcatgcctgtaatcccagcactctgggaggcagaggcgggtggatcacctgaggtcaggagttcgagaccagcctgaacaacaaggagaaaccccatctctgctaaaaatacaaaaattagctaggcatggtggtgggcacctataatcccaactactcaggaggctgaggcaggagaattgcttgaaaccaggaggcggaggttgcattgagctgagatcgcaccagtgcactctagcctgggtgacagagtgagactccgttaaaaaaaaaaaaaaaagaaagaaaaagaaactgaagggccttggggcttgggccacatctaccctacctcatttgctgcagctgccatgggagtcggatggttgaccgcatcacccagcgcaatggctaagcggagatccttctgaatgtatttcaggtagaaatcaggcttaaagtttccttgcaggatatctgaggagaaaaagccagtatcagacaaaagccaaggacctgaaactaaaaactacttacggtccaccaggtgtcagtacctaaaacatactcagggctcagttccacatagcctaggcctcttggctcctcactcacccttagacacctgagggctgcagctcccagcctatatccccaaatcccgcccactgtgtttctgaacctcctctggccagggtcagggactgactggggaggggcatctttcacgctcactaaatccctgacctagtaccctgctctaatcaaacaccaaatgcaagaagaggggccaaaaacaactcactttggcacttctggtccaggaagatgctggccaactgtccctgattgaggatgtccaagagtgtctgctgggactggcctgtcacgtgggccagggtcagcccctcggcaatagtggccatgaagctcccttggaccatgttcacgatcagcatcatcttggctgcattgcccacttcacctgcccagggtaaagactcacggtcacagcccaagaatgccacagacagggcttctctgtccaccctcacctctgctcagacccacctctctccaggggaggcccccttcacctgcccccgacagactggctcttcctccttccacgcactgactatgcaggtgaaaggaaaccttccccagggtccccggcagaaaggccgtgtgggactgacgctgtcatcagtgtgaaacagaggagatgtggccccaggctccaggcctgacaggtgcaggcgtgttacctaggaagaaggaggtcttccccatcgcctggaagcagctgctgcagtcctcatataagcccctgtctccagccgctaagatcaccaacatcccgtcattagacagctgctgattccctgagacgggggcttccagaaagcgcccccccctggacacaatcacctggaaagaaaagtcacagcttctggaggcctcccctctcccagcgctctctgggcaggactcaaggagtgttgctgagtggccacggctgctcatcaccttccagagctggaggggacggccacccataccaaggtcctttagctgacacctaaactcaggagctaaccatgtgcaggtcacacaggccgaatcacagcagtgatgagacgctggggtctccacacaggaacccaactgacttggaattttttttttttttttgaggtggagtctcgctgtcgcccaggctggagtgcagtggagcgatctcggatcactgcaagctccgcctcgcgggttcatgccattctcctgcctcagcctcccgagtaactgggactacaggcgtccaccaccacgcctggctaattttttgtatttttagtagagacaggtttcaccatattagccaggattgtcttgatctcctgaccttgtgatccgcccgcctcggcctcccaaagtgcttggattacaggagtgagccaccacgcctggccggaatttttttgttttgtttttttgagacagagtcttgctctgttgcccaggctggagtgcagtggcgcaatctcagctcactgcaaactctgcctcccgggttcatgccattctcctgcatcagcctcctcagtagctgggactacaggcaaccgccaccatgcctggctaatttttttttttttttttgagacggagtcttgctctgttgcccaggctggagtgcagtggcacgatcacagctcactgcaagctccgcctcctgggttcatgccgctctcctgcctcagcctcccaagtagctgggactacaggtgcccgccaccgcgtccggctaatttttttgtatttttagtagagatggggtttcaccgtgttagccaggatggtctcgatctcctgacctcgtgatccgcccacctcggcctcccaaagtgctgggattacaggcgtgagccaccgcgcccggactggaatttcttagagaccaacaactagaaccagatgtgaccatgtcaatggctcggctgaacacacacctcccctgtggatgctgccctcccctcagaacatatgtgggtcccaaagtccccactcccttatttgggccagatgctcggggaggagggatgctttgccagtgtcaaatgcagacagctgctcaaaccccaatgccaggcgggcggcctgggttgcttctcatcataaggctggcagctccaggacttgatgcccatcccagccatgcagcgactgcccatggctgttcagactagctgcggtttgaaggtggagcacgggataggctagtcccaaggctactcgcctctcctcttccctctctggctttggctctagagtaacttaactgcccactcttgtaagcctgggtcttgggctctgatagaaaagatgctggagagccagcccaaggaaggctgctacctgggccagctcagtgacggtgtcagcgtccactgttgacatgtccacgtagcacttcccagggcggatcccttgcagcacaccactggggcccagcaccagctgtggggacacaagggagaagcaatagcccaggctcccgggcagatgctcaggagccctacagacctcagatcagaatcctgctgctgttttggctcatttcctgatttctatcagctgaaaagggaagaacaatgaaataagcaagggatagaaaagtacttcccgcatgctcccatttatctttaaaaagaatctatgtgagtgtgtgcatttctttttatttaaaaaaaaaaaaaaacaaaccccatttaaaagaataaacctcagcatttactttggggacttctttggatttacttggattaggctagtcaccagtttaataagatgactaccacacttgaacttctaaaatatacaaatacagtgacagctaaacatagaagcttggcacctggaccaaaggcacattcagttccaaagcttctagttcaacaagaacacatgaagcctgttcaagacacatttcagcacagacttcaagggccctagtagtgttcattctttgatctgaattaaaggaagtctgtattcaattaatgcaaacacccttcacaatgggagatggcccctgatgggaaattcagccccccacatgtggacactcacttggtgtgcaggggaggaggggaagaggccagccagcaatcctggctgtgacccggagttgctgaggggagggagggggtccttacgtccttggccgccttgggatccgacacgcaggcgaaagtgatgtcgcaggttgagacgacttcagcgggggttcttcccagacgggccccctcctggatgaacaaatcacactgcaaaagtcacagatcctaacgtgagctgcaggcagtgcacaacaaacatgccagccaggccagagaattgctgaccaggcctcctggcggcctaccaaggcaggaggctgaggccgggagcctgggtcatggagataggagcccaacttttggggaagtgcacggggccttttactggccatcttcagtttttgcatgacgagtgcctaggatgatgaactgcttcacaagtgtctgctgaaggtatgctgtttcaagaatggggtatgaacagtagcacctctccccagcccccgctgtgctgtcctggctgtggccctgagctatcaacactctgctgggaatgtggggatgtcgctggaagccttccacctggtggccattcgtttttgggttgtttctcaacactgttgtcaggttaataagacttctggaagtgcctaaaaacactaccattttggctttttttttttgagacaaggttttgctctgtcacccaggctggagcacagtggtgcaatcatggctcactgcagcctcaacctcctggactcaagtgatcctcctgcctcagcctcctgaatagctgggactataggtgcatgccccatgtgtgatttttttttttttctgtagagacagggtttcaccatgttgcccaggctggatgggcctactattttctatcagacttttaatgttgtttatgattcacatttatctatattgttgtctttcataattctggcataattatggtttatagtggttgactatggaaaacttcactgagagatatactgtgatttacctaatggctgacctgtagtttgacacttagcccactttcaattgtaaaatcacatcaccaaacatctttacgtacaaaacttctctatgttttaaattcaggtctccacaaatagaataaaacaggttctaaaagttttaaggctctcaacaaatgtagacagatgacttcccaatgagactatgtcacttcataaagatcaccagcaagctctcctattatgccagtaccaagtatgtaatttaaaaactacaaataagtgcccataaatacatgtaaaattcttcctacctgatcatttaaccagtcaaaaaaggcaactgtttcattttttttttttgagacagagtctcgctgtcgcccaggatggagtgcagtggcacgatctcagctcactgcaagctctgcctcccaggttcacgccattctcctgcctcagcctcccgagtagctgggactacaggcgcccgccactgtgcccggctaatttttcgtatttttagtagagacggggtttcaccgaggtctcgatctcctgacctcgttatcccccagtctctgccttccaaagtgctgggattataggcatgagccaccgcacccggccttgtttgatatattttaattactcctgattaccgaatattttttatgcctttgtttcctcttttgtgagccatttttttgtcctttttcttttctgagacagggtcttgctgctgcctaggtgggaatgcagtggtatgatcacagctcactgcagcctctacctcctgggcccaagagatcttctggcctcagcctcccaagtagctgggactatagtaggcaggtgccacctcactcagctaatattttattttttgtagagatggagtctcatgttgtccaggctggtctcaaattcctggactcaagcaatcctcttccctcagcctcccaaggtgctaggattataggtgtgagcctattcttagatctaaaattattaattagcaccctactaatttttttgtcttaattatcaaactatgtttaataaaagcaacatattacccttcttacgtatttgctacaagtacttctagttggtattcctttgaattttatttttttgttgttggggagtattatcaaaaaaaatcaactgatcttcttgtgtgatttttattagttctagatttacaaagatctatgttagtatttattttcttctggttttcttttaaaaaattacttgtgggccaggcacagtggctcacacccgtaatcccagtattttgggaggccaaggcgggtggatcacctgaggtcagaagttcgagaccagcctggctaacatggtgaaaccccttctctactaaaaatacaaaaaattagccaggtgtggtggcgcgcgcctgtaatcccagctacttgggagtctgaggcaggagaatcacttgaacctgggaggtggaggttgcagtgagccgagattgtgccatttttttttttttttgagacggagtcttgttctgttgccaggctggagtgcagtgacacgatctcagctcactgcaacctctgcctcccacattcaagttattctcctgcctcagcctcctgagtaactgagactacaggtgaacgccaccatacccagctaatttttgtattttctattttttttttttgagacggagtcttgctctgtcgcccaggctggagtgcagtggcgcgatctcggctcactgcaagctctgcctcccgggttcatgccattctcctgcctcagcctctggagcagctgggactacaggtgcccgccaccacgcccggctaattttttgtattttaagtagagacggggtttcaccgtgttagccaggatggtctcgatctcctgacctcatgatccgcccgcctcagcctcccaaagtgctgggattacaggagtgagccaccgcgccaggcaaatgtttaggttttataataacatcctaagtttaggcatctacatctctacctgcctggactaaaagcttggcttctattctattgcacgcagaacgctgagacaacagggggagatgtccactcttagggttaccccagactccaccgatccaacaggcaccacccctgaatgcttactttctctgcagtgcggttccagacagtcactgtgtgacccatttttagcaagttggagacgattccacttcccatgagaccaaggcccaaaaatcctatcctgaaacagagagagactgatgagttcagggtggaaagggagggtcacggtgatgatgattccatgcagcacaaggctcgctcccttatacagcttggggtaggggaattcagactgccagaaacagcagtggccaatctacctgcagagccaggggcgtcatgcacatgggtcttctcttatgccatggtctaaagctgtcccaggatgtaaacaggcattttgaaacccctgactgtcacagaaaaaagtatgatgtgtatggttcagggccagtctcccagggcaaagtccccttgctgcccttttttttttttttgagacagtcttgctctgttccaggctggagtgcaatggcgcgagctcagctcactgcaacctctgcatcctgggttcaagcgattctcctgcctcagctttctgagtagctgggattacaggcgcacgccaccatgcccagctaatttttgtatttttagtagagacagggtttcaccatgttggccaggctggtctcaaactcctgacctcgtgatctgcccacctcggcctcccaaagtgctcggattacaggcgtgagccaccatgcccggcctcacactttacttattttttgagatagtgtcttgttctgttgcccaggctgcagtgtagtggtgcaatcatggctcactgcagcctcgacctcctgggctcaagtaatccttccccctcagcctcctgggtagctgagactacaggcatctgtcagcacacctaattttttgtggagatgggcttttgccatgttacccaggctggtcttggactcctgggcttaagggatccgcccacctcagcctcccaaagtgctggggttgcaggtgtgaaccactgcacccggctctggatactactttaaagcccaacagaatccaccacaagtcactgaagcactgtgtttagagccaggcaacttccttgactgcatgaaccaggacggcaattttcacctctctttcccaacttcaattctctacccacaccctacctttcccgtcttcccgttatcaacagaatgggccttgcctctcctctccaaagctaagtccttcacctgagcttggaacccaatctttcccagtccacaaatccttctccccatgcctgccttcccccaaacctctcactgttcccccagcccttccttccacaggtccttcccaatccttgtgacagaagcactcattggccagtctcctccacacacattcacatactccgcctgctccttcctgcaaccctgagagctgggggctggatgccactgctgctatttcaacatgcttttacggatgacttttagcttgccaaagtgtcttttcttgattcttgtacttcttcacctctctttgcaagtgacaatggtgcaaaagaatgcctttcctcatttctgatcatatcatgttcttgtttttatagtttttaatttttatttatttatttatttaaaaagagagatgggggggtcttgctatgttggctaggctggtctcgaacttttggtatcaggcaatcctctcacctcagcctcccaaagtgttaggattatgggcgtgagccactgcacccagccttttttctttttttagtgacagcattatgctgtctcccaggctggagtgcaggggggtgatcatagctcaccgcagcctcaaactcctgggctcaagtgatccttccacctcagtccacctgagcagctaggactataggtgcatgccaccatgtctggctaagttttaaaatttttttgtagagacggggtcttgctgtatttcctaggctggtcatgaactcctggcctcaagggatccttctgctttggtctcccaaagtgtggggattacaaggatgagctactgcgcttggccatgttttcaattcagaaattctctgactgctggatgtccccggcagctcctccactttgaccctgtcattctttccatagttttggtcttctggaaccatctctacaaatggacccctaatctcagctggaatatcagctgctcacattctccctgtcccagcctgtattaagtaatttgaatcacatgttgaaaatggaacccaccaactttctcaccaaaatagacctccttgctaactgcttcaagttgtggcttaaaaacaaggaggtacctttttgtcactcattatttgggtagtacaatattcccccatgattctaaatcatgacaggcgaattccctttcctttcttggtgttctaggaagtccagtagacctgggataaagcttctggatttttttgagacacagtctcgttctgttgcccaggctggagtgcagtggtgcgatcttggctcactgcaacctccacctcccgggttcaagcgattctcccacctcagcctcccaagtagctgggattaaaggcacccaccatcatgcctggctaatttttgtagagacagggtttcaccatgttggccaggctggtcttgaactcctgacctcaggtaatccgcccaccttggcctcccaaagtgctgggataacagccatgagccaccatgcccaggtcaaggttctggatttttaatatggcaactgagagtccttcacactgtgtctcagacaaaatggaaatgtggattaaggtgggttgggcaacaacaaaactggttggttttgatgctggcttcatactcttttattaaaagtttgactaatgggccaataaatgtgttgggtaaaaacatcaggactctgtcctcaccctatcctgatcatttttttatttttatttttttaacacaatcctcctcccctttgtttgcacctaatatgcccttatctcctccactctacagagacaagttcaccaaaaataactggtagcattagtgatttaaacagtacaaaaatatcatgtaaaagatgcactgtttttagtctggggaagaccatgtgaaaggtacaaactggaaactgactttagctaacttgctccagagaacgtgttttcctagaaaaggtatctttttgccaacaagactctgcggaggagacatgcctacagagcaggcacagaggcaaggctgggcgcaagttgggtctgggagcatgtccaggatcgccccacccacaccgggcagggtgcaggacagccagcaagtgctcagtgaggatccccaagcactttcatctcccttcccccacctgccccaccatggccaattttggggcctcatcatgattctactcagccagtggttctcacagcgtagctctgaccagcagcagcagtatacctgggaactggttaaaaatacaaattcttgggccccacccggacatattgactgagaagccaccttccaggtgactgtcaggcacaggaaagtctgagaaccactgagccaagtgctccttgctcttgagttctggagccaaaaaaatccctcagcttatgcccaagggagacccgaccacagatttacacagcttttgactcctgtctttatcgataagagttacaacatccccccaccttttccattcaatgccagcaatggctgggacacaacccttaaagaacccccctggggtcaccttctccccaccctcagcagaaccagagccactggaggccttttcatcaaaggtcctactttttgtctgtgggtgtgatgctgccattcacggctgtgctgtcagctgcctggatggaggtggagccagtttcctacggacaggaagcacacatcatcaagtcagtctgcctgcagtttaaggccccaggtgaaaattaaaatggggaggcatggagcctacatacctcttcacatattttcaacttcttcgtgattgcctggtaacagacagctggctaatgaaggaggaggaaagagactacttgtgctactgcaggcttaaccagtcttcataataatcccctcaaaggttagacccaaagtgggaagttaacatcaactatttgttttatactttagtgaactccaaattttacactagaaagttcatacacattacctcattcaagtccccatgcaattctaccaggtctttttgctgaccatggtgttgagaataagagtcataagcttggaacccacatctatccaactccaaagccacaaactctcatgagatcctagcacggctcaggccaccccataaccttgcagaccttgggaggacctccctctgcatccgcaggacttggagactacctcttggagtgagcttgaagatgtgtctgccatgcaatttcatggggtgctgacagcttacgatgtttggtttctgccctaaactctaaaggtcactgtgacagtctcaactacacagctggctgagttttaaatgctcttctgagatagagtctcgctctgtcgcccaggctggagtgcagtggcaccatctcggcttgctgcaacctttacctcctgggttcaagcgattctactgcctcagactcccaagtagctgggattacaggaatgcaccaccatgcccagctaatttttgtattttcagtagagatggggtttcaccatgttggccaggctggtcttgaactcctgacctcaggtgatccacccgccttggcctcccaaagtgctgggattataggcatgagccaccatgcccggcctttgggtttatttatcttttttgagacagagtcttacgctgttgcccagtctggagtgcagcgacgcaatcttggctcactgcaacctctgcctcccgggttcaagcaattctcctgcctcagcctcctgagtagctgggattacaggcacgcgccaccatgcccagctaatttttctatttttagtagagatgaggtttcaccatgttggtcagactggtcttgaatccctaacctcatgatccacctgcctcagcctcccaaagtactgggatgacaggtgtgagccaccgcgcccggcctggatttacttttaatcttaacaatgcttggctcattagcgggcccatatgggggcttctgggctagttgctctgggcaatacaccggcagagcctaacttttcagatggccaggccaggacccagtggaggagcactccttggccagcccctgaccaagggccaagagcctcaaaggcaactcaccttctctgtttggcttagcaggaaatgatggaaatgaggatctgcatctttaacaggctgaaaccagaaaacagtgaaataaaaccagttatctgccaccaaaggtcacttccttctccctggtaactggactctcctctggctgcaacacctctggattctggtctctttttcacaattgtctggaaactcttttcccattttggcctaagcctttttataaaaacaagccccattccagctagaggaaaactggctttaaagtgtaaaagaatagatgattctgctaggttggtacacaaattattccaatgagcctgtgggaaaatattaacaagcatacctgtgctttataaattcggtactcatcaggcacagcagataacccagcaaactaagtcacatctattctggaatttcagggttttggcctacttgtgtctggtaccaagcccttggcgatctcatcttactgagcatattaacagaaacagagtagccacgacagtggaccttcatgggctttccataattatgcccagcaacaggtgtagccgcaccaaggataataaaactaaacataaaagttgtatttatggacaataagagggtgtttataaaatattaggggaaaaaaacttgtggaatcatcccacttttgtgaaaaagaaccctgcccaaaataaaaaaaactagacataggtctataatcatgtaaatgaatgctaagtgggcatcccaaaggactgaaatccgtcacctcgagcctcacagtgctcaccctagagggaaatttttaattttttatttcatagacttctgtactgttttgtaataataaattaagcctcacacacaagaaagggacaaaaaaaaaaaaaaaaaggatcacacaggaacctcgccctaagccacagcttgtcctgcctgcaggagagctccttacctcgcttgcggttggctgccatttaaacgcggccatcggtccggccatcatccccttcacggtactagactccgggatggtgagatcctatagagggaggggcagggcattttaaaatcacattcaaaccccaacaaaaccccttgcaagctccacagtctaagggaaagttcaagccaatccccaaccactgttctgatgaccgtccctcgggagaaacaagccagttcttcccattaacacaaagtgagtctttcttctcaattctggaaataataaaatgtgtacttatgtctaaatttcacaaagatggaggtaattagaaagcccaagtacgatctgcagtactgtctgcaaagtttcagagtaaatgccttatggtgaataccaaacattaagaaacagttgtggtggctgggcgtggtggctcatgtctgtaatcccagcactttgggaggccgaggcaggcagatcatgaggtcaagagatcgagaccagcctggccaacacggtgaaaccccgtctctactaaaaaatacaaaaattagctgcacctgtactcccagctactccagaggttgaggcagaagaatcgcttgaaccggggaggtggaagttgcagtgagccgagattgcaccaccgcactccagcctggagacagagcaagactccatctcaaaaaaaaaaaaaaaaagaaaaaaaagaaacagtagtggcttcagaaggaatccgccatatttcaaagaaacgaataaaaccacatggggctgatgagatctgcccacattttacagctatcatgacaaaggcagaattaaactccagggtggccagagcccaagagcctgagttctcctgagacggacacaggaggacatggtgagatgagaagctcctcttcatcgatggcccggctcaccttcttcctgggcaaagggtcctctttccagttttaacactggtctggtccctctcgactgctctgatgttaccttgcactccctttccccagtcactcccttccagccacagtggccctcttgacaccccctgcctaaactactcctgaggttttctcagtcttagaaaacgcctgctccattctactaggccgatatctttagagcccttcttgacccctctcttctctaatccactgacaatgaatggggctttacagttggcgatctgcccaaccccttcttctcaccatccctgctactaatacctaagctcaggccacctggacaattgcaaaaataaatctccctgcttccactcacagtctagtctctacacagcagccagagtcagctaccaaaagggccaatcagattatgatgcttctttgccttaaactgccttccagtctcacatagtaaagctacgggcttcatgagcatggtctacagggagggtcttgcaagttctgccgtctcccacccatcccacgccaatctccaacctcaagtcctatttcttcccccgtcactgctctctagctcgttagcaccctgctggctttcccccccgcaccaaacacaccaagcatgtgcctgccctggcacccttgtgctacttggaacgttcttctgacagttatctccttggctcaggctcgctttgggactctgctgaaatgtcaccttatcagagtggcttcacctgacctctttttatgtttgcccatagaacatgatgctgatgtggattataatgagaacaaatgccttcatagggcttactatgtgctagacatcacaataagtcctattttatacatacattctcatgtaattcttgccccttcatgaaacagaattattatcatcttctttttttttttttgagacggagtcttgctctgtagcccaggctgcagtgcagtggcacaatcttggctcactgcaacctctgtctcctgggttccagcgattctcctgcctcagcctcctgagtagctgggaccacaggcgcgcggccaccatgcccagctaattttttgtatttttagtagagacggggtttcaccatgttagccaggatggtctcgatctcctgacctcgtgatccgcccgcctcggcctcccaaagtgctgggattacaggcgtgagccactgcacccagccctattataatcttcttttacagaatagaaaactaaggcacacagagcttaagtaaccttgcttaaggtcaccgagtcagtcactggtgtggtagacacaacttatttatttatttggaggcatagtctagctgtcacccaggctggagtgcagtgactcaattatggctcactgcagcctcaaccacttgagctcaagtgatcttcccacctcagcctcctgggtagctgggactacaggtgtgtgccactacgcccagctaattttttatttttattttttgtagatgtattatttatttgcaattatttgttttctgtaatttctaattttttgtttttatagggtcttgctatgttggccagactggtctctaacttctggcctcaagtggtcctcctacctcggccttccaaagtgctgggattatgggagtgagccactgtgcctagcagactgacagaatttggctccagggtctgtcatattagaagcacatcctagaaaagcaagaactctgccagtctggcctactctacaacccatgctgccatacagtccaggttcaattcttactgaaggagcctcgtctgacttttatgctgctttctctccaggcatttggcctataggagaattactcaataaacatttgttgaatgcagaggtttttgggggaaaagaaaaggcccagcccagagctgcccaaaagaatattctgcaatgatgggcgtgtactccatctgcactgtgtgatagagcaggcgccagtcaagcgtcactgtggagcatctcacacaatagggtgatggagaagctgcattttaatgtgcatttaatttcaatttaaatggccaattgtggctggggcagcacagctgtcttgggtggtgcagccctaggactcacctaaggccacaatgacccaatggaaacaaggaggaggcagcttgtaactctcagtttggcactaaggaagggccccaactcctaaacttctgctcctcgtgtgagtatgggattttgggagagtcacagaactaacagcgctactttgatctgggtgggctgtgcccagagttcatccccagaaagagggtaggtgggcgctgctggggtgcagctcttacatgcaggtccagacgcaaacccagcctttccctgcctgcctccgccatcaaggtcagctttttccattaatcctcacggggcaggagattatgtcccggaatggcactcagctgggctttgcccagttatcagcctatgtgactgctcagtgtttctgagaggagctcgccagccaaatgacaattactatagcaacacacacacaaacaccctcctctgagactacgggatgtatcgcatttaaaacacaccaaaattccaaagcccaggcaccgattccctacctgtctgaaggtgctgaactgaaacggctatctgtcctgtaccacatgccagctctgtcctctcctgctcatacgtcctttcactatgggccaggtgaagcacaaagaacaggcaggaaggacacctcgaagggtcaatagcagctagagctcctggaccacagacacacctcgttttattatgcgttgttttattgtgctttgtaggtgttgcacttaaaaaaacaaacaaacaaacaaacaaaaaaaacgggccaggcacggtggctcacgcctgtcatcccagcactttgggaggccgaggcaggtggatcatgaggtcaggagatcgacaccatcctggctaacatgatgaaaccccgtctctactaaaaacacaaaaaattagccgggcgtggtggcgggcacctgtagtcccagctgctccagaggctgaggcaggagaatggcattaacccaggaggcggagcttgcagtgagccgagattgcgccactgcaccgcagcctgggcgacagcacgagactccgtctcaaaaaaaacaaaccaaaaaaccaaaaaaccaaaaaacgaattgaaggtttgtggcaacccagtatcaatcaaatctatgggggacattttcccaacagcatgtgttcactttgtgtctctgtcagcatttttttttttaagcaatgaagtatttttaacttaaggcatgtatatatatatatttttttgagatggagtctcgctctgtcacccaggctggggtgcagtggcgtgatctcggctcacttcaagctccgcctcccgggttcacgccattctcctacctcagcctcctgagtagctgggactataggcgcccaccaccatgcccggctaatttttcgtatttttagtagagacggggtttcaccgtgttagccaggatggtctccatctcctgacctcatgatccgcccgcctcggcctcccaaagcgctgggattacaggcgtgagccaccgcgcccggcaaaggtatgtacattttaaaaagacatattgctattgtaccacttaatagactacagtataaacctaactttaacatgcaatgggaaaccaagacgtttgtgtgacctgcaatgatctggaatcgaacctgcagtatctccaacgtatgctacactactccccagattaataattcagacccaagggctgtctgcagtttattgggagctcgtgagacgagttcctgtaagcctgggcagtggcctctggggttctcactgtacaaacggccagtgtctgcgaaacaaacctaaagaactgatcaaatgccttgtacacaggcactgttctaagtgctgtgtccatgtcactcatttaactaacacagtgaacctaggaggcacgtactgttgtaattcctaacgatgagacaaggaaactggggcaaaggtgctttgctaaggtcctatatacgtgattcaaactccaggccctcgtcataacctctcctttgtacttccctttatccaacgagaaggtatttctttccagggtggcacaggcaccggtgagatgcatggcttcacataccagacaatatcaatttgggaaatagcataaaatctgacagcccagattccttttggattccaggaaataaactcagaagtcacattacattttttgtgggtcaatttagatcatgttccctataaagttctctctgcactgcagctggcagcttttccaaaccttgggctgacggtatgcagggacagcactgccacccttgctctcaccactccctcagcctgaggtcatctaacagtgagaagggctgtctctcaccagaggcctcacactggcagcccacagagatgtttctatggccccaagacatatttttgaactaagcacatttaaaattgggatatttcacataaaaacctgtatttccagcttctctctttttttggagatagggtctcacactgttgcccaggctggagtgcagtggtggaattgtaggtcactacagccttgacctcctgggctcaagtgatcctcccaccccagcttcccaagtaggtgggactacaggtgtgtaccactatgcccaactagtactttttgtttctttttttgttgttttttttgagacagggtctcgctgtgtcacccagactaaagtgcagtggcataatcttggctcactgtaacctccacctcctgggttcaagtgatcttctcatctcagctttctgagtaggggggactacaggcacacaccaccaaccccagctaatttttaattcatttatattaaatttttttttttctttgagacggagtctcactctgtcgcccaggctggagtgcagtggcgcaatctcggctcactgcaacctctgcctcctgggttcacgtgattctcctgcctcatcctcccgagtagttggaattacaggagcgtgccaccacactcgggtaatttttgtatttttagtagagacggggtttctccatgttggtcaggctggtctcgaactcccgacctgaggtgaaccacctgcctcggcctcccaaagtgctgggattacaggtgtgagccactgcacccagcaaaaaaaattttaatagagatggggtttccctatgttgcccaggctggtctagaactcctgggctcaggggatcctcctgcactggcctcccaaagtgctaggattacaggtgtgagctaccatgcctggccaattttttagtttttgtagagctagtcttcaactcctaagctcaagcaatctgctcacctcagcctccgaaaatgctgggattacaggcataagccactgcacctggccaactttgtcttttttttttttttttttttaagggaaaggctcttactatgcttctcagcctggtcttgaactcctgggctcatgtgatcttcctgcctcagcctcccaaagtgctatgattgcaggtatgagacaccacaactggccttcccagcttctcttgagaaaaaacagacaatttggcagaagctggctagaaccctgtggacagagcatgacctccccagactccctgaccatggccagccctgctgctctgagcaccaaggcaggtcagctggggtgcctggcacccgtgccactgcttcttaggtccagtcagctacagttgcttccattacctgcctgggctcgctggtgtctgaatttttgagccttgatccaaggtctaatgttccatcatggcctcgtcacccaactgttgctgccagccatctggcttctgttctctttatcctgctgttgacaatcctaccgcgttcctgacacagtccccttcactttgaaattcttctctgtggccttgtaagaccggccccaaatcttgtcagcaagaaggcgagagaggcactctcactgctttatctcatcttgctagctcctcctgctccttcctgccccaagcacggcattcttgtggcaatgcaggcctccgcgcttccctcttctccctctcttcctgaaacaaacccattccactgcccggactcaactacccttttacaaattcacctcccaaatctacatttctagtcctgaggtcacaccaagctcccaggctgtctaggccttgcctcaagttcttgacattccaaacagaactggtactctttctccacaagccacctctacatccccagtcctctacttttaagaaagtgatgaccactttcccaggaatgaagatggaaatcctcttttcctttttctcattcatcctctatataaccaattatggaatcttaagaactcttcctctgaagtgcctctcacctctttgcttgcaacatttgcaattacccccttatgaatgcacgcctagacttacctcctaattggctctgagactttcccctctgcactcggtgactactggtgcacacacgggaggcacacactgccactggctcagtcaccttcccgggcccccactgactccaagacgctttagtaccacgctgcttcagtagaccttcaggccctccacgatccagggacaagcttcctttttctcggctttcctcactatcctctccctgttcgagagtatctccaccagcaccgagcctcacacgggctgtgccctccatctttggaatgcctacccttctttcttgctaagcccctcccagggccagcccttgtgcaccggctcaagtggactgctctcctgcctcgcgctcctactttacacctgcatccaggccgtgtctctcacctggtctatgggattctttattttttaattttttaaataagattcggggtctcactccatcacccaggctagaatgcagtggtgcaatcggctcaatgcaactttgagctccaaggctcaagccatcttcctgactcagcctcctgagttgctgggataaagcatgagccaccgcacctgccctgcaggattcttgagcacagaattctgctcccactccatgagcagagtatagataagcatactacataagcatactgtagagcttaactctaccttgtactaaaaggacatcactaatcccggaagctgcagagagaaaacaaaccttctcatcctttgggggccgaccccgcttccggggactttgctcttgggctcttttcagaggggatttggagcctctctctgaagagcctgaagacaccctcttctttccttctcccatgttcttcttcaccttcccttcagacaggctaagtttgcgcttctcatcacctgagtttggcctacttctctcctcactggaattacgtcgattcttgtcatcagaagaattgtgggatgacgtctgaaagtttaataataataatgataactaccaccacagctgctgccgccatcgccaccatcatttacaggtgccatgtgctgctacaggcactctgtgtggtctcctcacaatgaccctagaaatagattctgctgtcgtcccagacattgggagaagcagatttaaaaaatatatatatcaaaagtcactttccctatgtcccaaaactagaagaaaggatttaaatctaggcagtatatgtatttcagaggctatgctcctaatctgtgtgctatgaaaggaagaaatggcctgtgctagactcaaatgctgagatatttctcctgggtccaagcaattttcctaaaagcaacaacctactccagaaaggttagctgcatggagtttcaaactgataagcaaaacgctgacaccttagaactgaagtagctttctccagtagcatttcagaagaacaaaggtttgcgtttgggtgacatttaatctgttagttgctatgcaaaaatcaccagtctggcattggtagaaagtgaacattgtgtctctcacctggtctttccctttggctctcctgaggaactcttcgacagcatctaccgcttgctggaatcgtttacccttgttaatttttatcatttcctctttatgagcatgatatggcttcagctgttccactttgatccaggcactagcagaaaacaaacacaaaaagggtgtgaaccatatagcatatgccctaaagtatcaacaacctcactatggcacggtgtaaatatccatttggtttaactggactttgcaataggccttgccatttctttcaaaacatgctatcaaccatctcagagtcttatgtctaaagtatattttcttgaaacaagtcaagcagaacaaccatcaccaccactgcagcaaccacaaatcaagttcctccagtgaaagcactgtgttgcagattatttatttccacaatcgtctatcagcctccaatgcccaaccacatatacgctgccacttgctcagggcagaaagaaatctggagaccctttcccattctcaccaggcagcacaaatggccacacacagatccctgggaatcagggtacctggaaatgtgatagatgatagcagcattactatgcaggaaaatgcctgctgcctgtcaacaatgggaaccagatttatgatctgttgatccacagagagtcagggatgttacagagctgaagaaatgcaacatcttctaaaatttgtggttcctatggatattcacagccactgagcctatatttgttcataaatgatggtaaccatggctactaaaccacacaaaacacggaacacatggtttggaataagggcagcagttacaaaaggaggcatttaaaaacaagatggcatgctgttttatgatgtctcaaaaaaaaaaaaaaatagaaacaagatgcttgagattaaaggtagaagaacatacacctccgatatgtaatttttaatttcaaccatcaatgtgtaacacatgaaagtgaaagtagtcagctgtcaattctggggtttctgatctgtcacactaacctgaacaaatctgctgcagctggctttctatggcttccctgaatggcatgcagcttatagaatccaagcacaaaataattttataggctttacaaggtatcagttagtttacatgttttagcctgtgatacaggtttcacagcataaccttcagaaaaagtaggtcaggttaaggatacagaaacccagctatctcacaagcttcaggttgttttcttcatagaaagctagagaatattcactaacagcaagtgttaacctttgcacataaaaataatgttactaaccctccaccagctacctggactttgagtgtgctgctggtagttgtgataatggggtctgtgcaaaaacacagacctgggatcatcggcctgcagatgtcaggcagcgaaccactatcaggcatgccaccatggctaagtgagatgatgaatggagatacagaagctggtctccctggcacagctccaactagaggagttaggcaaattccttttttttttttttttttttttgagacggagtttcactcttgttgcccaggctggagtgcaatggggcgatgttggctcacggcaacctcgcctcctaggttcaagtgattctcctgcctcagcctcccaagtgctgggattacaggcgtgagccaccacacctggccttttttttttcctttttgagacagagtctcattttgtcacctaggatgaagtgcagtggcacgatcttagctaactgcgacctccgcctccacctcccaggttcaagcaattctgcctctatctcccgagttgctgggactacaggtatgcaccaccacacccagctaatttttatgtttctagtagagacggggtttccctgtgttggccaggctggtcttgaacttctggcctccagtgatccacctgccttggcctcccaaagtgctgggattacaggtgtgagccagcaaactcctttccagtgaccaactcatcttaaagtttgaaattcaacatgagagcgccaatgagtccaatctgctgggaggaaaagtggaaggagatttcgaccccagattttctggcaagaatatccctgaactgactccgttccctctccttacagggatgctaatgacaggccagagcaatcagatgcaaagtcagacccagccccaaaagccagtgaagctaccatactaacccgtgggtctgagatgacacaaccagtatcaaggatgaagcttaaggagtcgtgaccagccagttcttcctaggagcttctggtcagaagctgagaaccacacaagttcccaatataggaccaaaaaggtgatttttatggaaccccttgagatgggacaacagactccgagacttgctaatcccacccacgccatcctgctacctccatccctgcctcccactacccagcctcacaggaacccgattctgagggaacagaaaggtgaggatgtctgtgaagtgccaaggaatcaaccccattttttgttgaagcatcttacaaggtttactgatttctgctagaaggaactgtacagtcaaaattccactcactttaaagcatttgagatactaaaattttcctctttacaaccatcttcgaaacattaaaatggctaaatgaactgacagtatgaataggatggtaaatccaagaaatgttaatctatttaaggaatcaacttattgctggagaagcatcctgttacatcaaaaaacagccataaaaaaccagcttggctgggcacggtggctcacacctgtaatcctagcactttgggaggccgaggcaggcagatcacctgaggttaggagtttgagaccagcctggccaacatggtgaaatctcgtctctactgaaaatataaaaattagctgggtgtagtggcacgcagctgtaatcccagctactcggaaggctgagacaggagaaacacttgaacccaggaggcggaggttgcagtgagccagtattgtgccactgcactccagcctgggcaacagagtgagactccacctcaaaaacagtaacaacaaaaaaacccagcttaccagagctctatggggattacctcttgaaagcaaaccaaacttaaatcactttggctatctgaatacaattttttctctaaaggttacacttctttcatcttttttaaatttattttttatagagatggggttcaccatgttgcccaggttggtctcgaactcctgaactcaagtaatctgcccacttcagccacccaaagtgctgggattacaggtatgagccactgcaactggcctacctctgtctttttaatgagaatatgcttttcagttggcgcctcaacaatgcaccactgtctaattcacggaggcacatcagccgggcctggcacaccactggtcctcaataaataatcactgggtaaatgattccttcccagatgttcaggaggatgtactgctcaccagtgagttaaaaggtgctacaatgctccagtgcgtaaggctttagtgtttttgttgttgctactgttggttttttaagtgactgtttctttccttgatagaagctgtaacttttgattttcctatcatcctcccaagacttagatggagctatatctttcagcccaattgtggctgggaagtcagaaaaatcaagcttattcaagctgtatttaaagtaggagactttgctttttatgtacagtagaatgaatgacacattgtgatagtaaatagctgaaaacaggcaaggtcattacagagaaggaaagcggatgtctcgtaagatatctggctacgtggagatgagcaagataaaaagcaatgcatgttatgtgctaccactcgtgcaaagacaaggaaaatggactgaccacgcactgatatctctggagggacacatcatcagaaactggtctaactgggtggctgtgggatggggatgaatgcaactgtttcaatgttgacaagtttttgtttttgaatggtgaacacatattatattggaaaaaaaaaaaaaaaacaaaacaaatcaatactaaaggcctctgccctagaacacaggctatgccgactgcccagagggtttcctccatgacttcctggtttgcaggtttgctctggtgggttgctgctgcctggctgctggcataactgcacctgtaacacagccaatttaccctggtgacctgacactcttcctataaaaagtctcttcatctatgaatacagaaccgccactaaggcactctcagattactccaatcaaaatgaattaaaatctggtattttcaaaaacttgcacacttctgatttgctttcctcttaaatgaaaatcatacatgtagggcccggtgcggtggctcatgcctgaatcccagcaccttgggagaccgaggcaggtggattgaggccaggaattcgacaccagcctggccaacatggcgaaaccccatctctaccagaaaacacaaaaattagccagttgtggtagcacacgtctgtaatcccagctacttaggaggctgcggcaggaactgcttgaacccgggaggtggaggttgtagtgagtgcagatcgtgctactgcactccagcatgggcgacagagcaagacttggtctttaaaaaaaaaaaaagaaaatcatacatgtagatactgtatattaaagatgtcagcctatgactaatcttgaacgctgtcacatgtgtttcagccttcacatagacaggtgacccggggtgaagccgtgaagctaagagaaagagaaaaggagaaaggacggggagaagatggcagggggagggagacagacagagaaaaagcacacacacacaagcatagagtataaaggtgagaacaagccggcacggtagctcacgcctataatcctagcactttgggaggccgaggtcaagagattgagaccaccctggccaacacggtgaaaccctgtctctactaaaaatacaaaattagctaggtgcggtggcatgcgcctgtaatcccagctactccggaggctgaggcaggataatcgcttgaacccaggaggcggaggttgcagtgagccaagatcgtgccactgcattccagcctggcgacagagcgagactccatctcaaaaaataaataaataaataaataaataaataaataaataaataaagataagaataaaaatacaggtgagaacaaagatggggccagaaggtgtgggtttgcttctccatttggatttggtgaatacttagtaaacaatttctatgggtgcctttttaaaaaaaatccatccaaaggggctgaagattactgaggtgttacaggccaagttcttcagaaataaaggcaccagaaaaaaacacacacaaatcaggtgccaggtgaaacgaaaaagggatgcttccaagctgctatgcttctaattattaaccacatattcttctagagcagctactttcagtactgactcagacacctcacatccagcgagaccggtccaccttagatgtggcttggtggaaaaggaccactggtctctcagtttcctcatctgtgaaaaaataagaaccagaaagatgaccctgtgcacttcctgaaagggctgctgtgaggactggaggggaagactgctatggaaactcgcaggtaggcacttgcagcttctccactgtttgtccacaatctgttgaaccggttggtttctggtggcttctaagcacctgtaatttaaatgaacactccctccattccatcatcatccacagccactgatgaaacttttctttttttttttttgagacagagtctcactctgttgcccaggctggagtgcagtggcgcgatctcgacttacggcaagctctgcctctggggttcacgccattctcctgcctcagccacccgagtagctgggactacaggtgcccgccaccacgcccagctaatttttttgtatttttaggagagacggggtttcaccatgttagccagcatggtcttgatctcctgacctcgtgatccgcctgacttgccctttgaaagttctgggattacagatgtgagccaccgtgcctggccaaaactcttcttttttaaaagacagggtcctgctctgtcacccaggctggaatacagtgcctcaatcacagttcactgtagccttgacctcccaggctcaagcgatccttctgcttcagtctcccaagtagctgagactacaggtacatgctactacgcatgaaccctctcacctgtgtttcagccttcggatagacaggtgacctgggctgaagccgtgaagctaagagaaagagaaaaggagaaagggcggggagaagatggcagggggagggagacagacagagaaaaagcacacacacacacacaaacacacacacaagcatagagtataaaggtgagaacaagccggcatggtagctttaaattttttatttttaaattttttgtagagatgggtcttgccatgttacccaggctggccttgaactcttaggcttgagtgatgcttctgcctctgcctcttgaagtgttgggattacgggtgtgagccatcacgcctggccccgatgaaacttttaaaccgtgagctctgtctctactctgatgggggggtcaccactaatcagacctgtcagagagggaccctcgtgcacttgacacataatctttggttgtagtcaccaagtgaagctggcagggttttgctgaaattatatccccttcgtatttccatgaaaatacaaaaattacgtgggcagttttgtcttggccatctcgctcagggagccgaatccgtataaagaagtcctcctctcaccaggacacctgattaggaaggtctggccctctcctaacagtgggatgtcaacacaatttgttagatattttggcagagatgtggagagagaaaaatcaggtttctaaaagattgtaatcactgattatcttgtcataaggagccgttctttctgctctttaataaaagaccttgcaaatattaaaaaagtataactacacttttttttgcctaagtagtgtgtcaattttgaaactgaacatctttgaccaaatcctgtatttctcaggaacggaggacactccactgggtcagaccctatccacctgggccagggtccagtaaccaatggtgcccccacccaggatgtgcctggaccacatgccccctccctgatgtcaagtgttaaaggcgaggtgcagtccagcttctacaggagccacttatggctttgtcttcacaagttagttctcatccctaaaaaatccccttgcaatacctgtttacaccacctcttaaacgccccttttatgcagtgctcctcaccctggtcctaacacagtcataccacaatccacttgcagtgcccatcgccaaactcctctaggccattcgctgtttcctacctcctgatcccgtgattccttcagtctttgcttttccacattgaagagtcctgctcttttgtctgactcagttcccttttctggatcttggccaattctaagagatccctttgaaagcatgatctgaagtccatagagtattcctgatgaggcgcatacagttttacataaaggtggaatgatgcatggttttgtactcaaagcctttttggtaaaaagagcaaacctggctgacatcctttaggaacttccaactctcatattcctttcttttcaaacaaacacacacacacacactctctctctctcccatagggagagtctccatctctctcagttttccatacttaaaggcatcctggaccaatgtgtgctaatacctgctgtatggcaagccacactctacacaagagatactacttttccttcctaactatgaggtagggggtatcatccccttatgtagaggacacagaggctcagaaaggtgaaatagcttgcccaaatcagggagcaaggtggaaccggtacctgaatgcacattaggctggtaaccaatccagagctctttccccaaagtaatctgctgccaccagccaatctggagatcttaccttcatagaaaaacacaaaataaaatctgccccagcactgatcactaaggaagtgttccttctttagagaagtactgtacatctttaccctttatttcctttctctaagttaactgcctacccacaaaaagataacacattagtaccacagtgacttcatttttatagtttaaaatgtagaactctagcaaaggagtttaaaaagttaaaaatattgcatttagcagttgctttgtatcccacttgtttacaaccctccaaagaaccttcgtcagttagaaattatatcatcaccaccaccatccaggctatttttgtcttgagcaagcacatcaccactggcttcacctgtttgcctggttaagctctgaaattaactcaactccaattttctgtgtcctatttctagcacttgttataaacaaggatcacagtttattaatctagtcttttagcattaaaaaaaaaatcggggctcggcgctgtggctcatgcccataatgccagtacttcgggaggccgaggtgggaggatcacttgagcccaggagtttgcgaccagcctgggaaacatggcgagaacttgtctctacaaaaaaaaaaaaaaaaaaaaaaaaaaaaagtaaaaaatttagcagggcatggtggcacacaactgtggtcccagctactcggactgctgaggtgggaggattacctgagcctgggaagtcaaggatgcagtaagccatgtccgtgatactgcactccaaccctttctcaaaaaaaaatcaagaaaccaaacaagaacaacaacaacaacaacaacaacaaaaaacataaggaaacaatggctttcaggctccttatgagactgagttcccatttttgtttcagacttgtgtaattattcatttagctaatgaagtttgggccaaccatattgcctctgttattcctaagcacaagttacctcaggcagggagcctcttcctttccataacacccagcttaatgccaattgttcatggtatccccactgtctgaaatgcccctatagtccccatccatccagattctatgtatcttccagagctggattcaaatcccatctctggctgagtgcgatggctcacgcctgtaatcccagcactttgggaggccgaggcgggcagatcacgaggtcaggagatcaagaccatcttggctaacatggtgaaaccctgcctctactgaaaaatacaacaaaaattagctgggcatggtggtgtgcgcctgtagtcccagctactcgggaggctgaggcaggagaatggcatgaacccgggaggtggagcttgtagtgagccaagatcgcgccactgcactccagcctgggcgacagagcgagactccgtttcaaaaaaaaaaaaacaacaacaaaaaaaaacaaacagaaaaacaaatcccatctcttcagtcagtcttcttggttctcatggctctccactgagctctccctcttctagaattctttttctttttaagacagggtctagctctgtcacccagactggagtgcaatattgtgatcatggctcactgcagttttgacctcctgggctcaagcaatcctcctgccttagccttctgcatacctgggactacacttgtgtgccaccatgcctggctattgaaaaaaaaaatttatttttttaagtagagacaaggtcttgctatgttgtccaggctggtctccggctcctgggctcaagcaatcctcctgtcttggcctcccaaagtgctgggattacaggcatgagccactgtgcccagcctagaattaacaattatctgccatcattcattctgcacataatctttatttattttttgagacagagtctcgctctgtcacccagactggagtgcagtggcgcgatctcagctcactgcaacctccgcatcccaggttcaaccaattctactgcctcagcttcctgagtagctgggattataggtgtgcaccaccacacccgactaatttttgtatttttagtagagacagggtttcaccatgttggccaggctgttctcaaattcctggcgttaagcaatctgcctgccccggcctcccaaagtgctggggttacaggcatgagccaccatgcccgaccatcattgtgcacatcatcttatctgaaatgtttacaacttgtcacttgactgagcatctggaaggtgggaactataatacttgctttcttataaattccctcagtgtcaagcaattcagaaagtggacacataacactgatgttatgcatgaggacaatctttcctgtttttctttttcttttctgagacatagtctcagtctgtcacccatgctggagtgcagggtctcgaacaatctctgcctcctgggttcaggcaattctcgagcctcagcctcccaagtagctgggattacaggtagacgccaacactcctggctaatttttgtattttttgtagagacggggttttgccatgttggccaggatggtctcgaactcatgacctccagtgatccacccaccttggcctcccaaagtactgggattgcaggcctgaggcaccatgcccggccaaatcttctttttaaatccatggagttctaagaacattccctcttccagaagctctggctccacagctccaggccagcgatctccttgaaatactgccaccacaggctgctaagctggcttgtgatagagaaatggggctgggtctatctgtaaacatgaaaccaggaagagcatctgacatataaactcctggatgagtgaagaatactgtttataatatatcgctttctaagtagaaatactttaaccgtcagaattagatttaccagagaagccacagacatttttttcaaatctaaggctgtattttcctataagaataataaatagaaatacaactacttaaagaaatcaaaccggctgggcatggtggctcttgcctgtaatcccagcactttgggaggctgagggggttgggggggggaggggcagatgacttgaggtcaggagtttgagaccagcctggccaacatggtgaaaccccgtctctactaaaaaatataaaacaattagccgggtgtggtggtgtgcgcctgtagtcccagctactcgggaggctcaggcaccagaatcacttgtacccgagaggtggaggttgcagtgagctgagatcatgccactgcactccagcctgggtgacagagtgaaactccatctcaaaaaaaaaaaaaaaaaaaaatcaaaccatctagctagacccaggtaagccacttgacatagtgataaaaagctaaacaaatcactagcaactcaagttaatacaggttcttcacgttcttcccgtcactgtaacatgttatatggtcagagtctcagattaatggtcctggtttccccaacttaggacagatctggtaaaaagacttactataacaatgtcaaagcaaatcacttagttttacacatgagaacatgattgaacaattacttttattaacataaataaaagtttccactgtataccccaagcatgaaccataatgatatatggcattaaaagagaactgaacatggcttttataaaaataattgccagctgggcgcagtggctcacgcctataatccagcactttgggaggccaaggcaggtggattgcttgagtccaggagttcaagaacatcctgggcaacatggtaaaaccccctctacaaaaaattagctgggcatggtggtgcacacctgtggtcccagctactcgggaggctgaggtgagagaaccgcttgagtcagtgaggcagaggttgcggtgaactgagactgcctctgcactccaggctgggtgacagactaagtctctgtctcaaaaacaaacaaaaaggaactgcctttggagttgggtaaagaaacatgtgagaaactgtttcaatgtgattgttatagttagaaggtaaatgaacctagttcttgcctgacttagttatagacctaggacagttgtctagggcaatttctgcaagaaattgcacctttatttaggtatgaaggcagaatgagatgccagtattacacattataagaagactgaactaaggatccttagaatattttcaaagcagctcagactccaggtaacacagaaagaaaggcgaagggagactcctggtgagtactactcactgatcttctgttccaaaaaatttcacaaagaagcatttctttccgcgaggtttcttcaagtcctttggtggattaacaatctggaggataaaaggggggaaaaaggttggctggcaacacagcagcccactttctagtggctccacattgctctacagttctacgttgctaagaaaaaagtaaattaaaaggacttacttacaaataaatttatttatatacaaaacagaacccaaggcctagtacttgtctaaatctcccatttttctattgaggtgtatggaaatgtgtagatattctagaagttcccaatatttaacatgtagcacagtgctcagtagacacaatatcccttttactgcagtggccctgttttacaagcagttaaaactaagatcaacagcatcccctgccccccaccaccccacccctgctccaatgtgaccccattattactgaaaaaatgcagacgacactctttgaaatacttcctgtgcaggaagggttgacacaggacatagtgaaaacaaaggacaaccgaggcacagaaaacaccatattgcaaagagaccatctaaagacacctcccgggctccaagcaagaatataaaaacacaacatttggaaagcaatgatggatcacctcatgcaaaatctggaatgccaacttctgcaaagaggcactggagtagcacatatggtaacatggaaagaagatttaaacttagttgggacaaaaatactttggcttttcactaacctacatttagactttcttcctggataatttatattttcttctccttttgttacatttaagcataaagctaaattcagactagaattatttccggggttaaaaaagaaacttcataaacctcctctaaatccagaaataagggtttagagaagatttaatgatctggtgtatactgcattgccttttaaaaaataaccgatactaggggaaaaaaaattctaagtgccatctgaatgagcccaatttaactcaatactagaaactgagaggaatgcatcttacattctccacctcttcaaacccaacttcagatctcttcctttagtagcaagacactcacctttcctggccaaggaggatatcggccgagtttccccctagagaaaacacaaagagtcaacacttgccctgcaaaagccagtccatctccttcaacccactcaatacgcaatttattttcctaaatctctgctggcatcctcaaatgccgaaacaaaagctttcatagctgggcccaacaccctcagaagtaaaatgcaaaattgtatacttatgtgcacaacgcatatccattcttctgttgacaaggaatacagaacaacacaactgtcaaaagtcacttgtctagagcttcttaatgacgggggtgggaggacagcttcctctgtaaacacagactttccctccctaagtctggtttaattcaacaggagacctgcctggctttgacaaatgctaatggaagccttcctctgggtggagaaacaagctacgcagctcgagggaggcggcgacaaagtcttggttcgggcggttgtctgggacacagaagcagaccgcgggaggcacccaagcgtgcactggtcactgccaagccatcggttgtaaaggagaagtccccccgccgtttcttcgcggggcaacgccagcagtccggtttagacaaccccggctgagccggccgcacaggtcggctgcatcgcaacctgggctttgaccgaatggcaccggccagatctcgcaggtccggtccccggcgcttctgctttctgggaagccccaacaagaccccggggaccggtcgtccggggaagcctcgcggcaccggcggctcccttcacgggggccgccagtatctgggccccgagtgcagaccccacccggccggcctcggggatcaaagccggtgcccgacgtggccaccctcggcctcggtcccccgggactggactgccccttccgcctggcgccgctcgcaagcgccggcaccttctcttcccctctctccgcgacctggagcgcataaaaaggcagctccagggccggcagcgaaccccgcgcccaggcgggtagctccccggcgcgtctcggttggcccggccgctcggactcaccacaccaagtcgccgagccgcagactcacagccgccatcttaccacccaaccaccgccgacgcacgggccgccgggaacagcaagtcgccccggcgccgcccattggagtgggcccgaccacgtgacgggggccggctgtcactggccacgccgctactctgacgtcaccgcgcccgccggggatcattggtcgaccgaggggcacgtgacgcgagcgccgcggtctccgcgcgccggagcgcagagactcccggctccttccccctcccttcggctcgtgacaacgaagcgcccgcggtctgaggcggcggcggcggcgacggtgcgaccggctgagcgcgagagggagccggcctcgcggctcgccccgcccccgggtcttggactccgcgcccctcccctctcggcgcttccgttacgcccgttggtccggcgcgggccccggggccattcccgagcccgaggcgctggtcggccccgtcgcagcgccagtgagctaccctgacggagctcggcgcggcctggaactcagcctccgccgggtctgggctcccgcgcccggcaactctgcttggccgcaggccgggaggccccggtgtccgcgcccgtccgctcccgccgcccgtgttctttggagcgctcctcccgacggccgctttcggaggcgccgtctgagcgcggggtcccgcgccgcaagttctcctggggcgaccggaggctgctcccccgaccccctggtgtccccggagtggctgcgcggacgtcgagttggcatttcttcgcttcctcctgggccggcgcgcggcgcggcacaccaggctcccctgggctcggggacccggccatgggccgaggcgcgggccgcccgcccgctgggagccacggcttagcagccgaccgctagctgcgccgccgcccggggaccggcatgaggaccgccgcggggggacgtctgcggcccgcgtcggcgctggggacaaaggtgcgtgtcgttgtcgggtccgggctctctcgttagccttgccctagttttgcacttttgaaaaagttgtgacaacaggaagacagatgccgggcgtagtttggacactttaaaactgaaccatgaactgggaagtgttaactgcagttgagcgcagcgtcggcccaaacttcagcagaccaggtagaatcacaattttgcaaaagatcccagtcccgatcacagactccacagtgttaaggattgacttagacttggtgtcgggctcttgttgagtcactgccagctggcaaaggtggcgagtcgacacgcatttccccaaggcattgtggtggttagagatttcggttgcaagtcggtgtttagcgtactgggtcgtcccgcagcctgatttttcttgggagatcagtttccctgaagtaccaagaattagctgcacggactgtcatttactgcgtgtgtatttttaagacaaagtgatctttaaagcgtatttaagattccagggaataatttgataaaaatttaacataagttcctgtttaaaaattctgaatttgtgaggaattgaatgagattttaataacttaaataaaaacatgaatcttggccgggcagggtggtataagcctgtaatcccagcattttgggatgccgaggcgggtggaccacctgagatcaggagttcgagaccagcctggccaacacggtcaaacccagtactctactaaaaatacaaaattagccgggcgtggtggcgcatgcctgtagtcccagctacttgggaggctgaggcaggagaatcgcttaacccgggaagcggaggttgccgtgagccgagattatgtcactgcactccagctaggcgacagagcgagcgagactcgtccccccgccaaaaagaaaaaagaaaaaaaaatctcaaatgaacattgcaccaaaacctagaggcattccccttaacatcagaaacatggtacatttctaccactattagataataagaatatattgcctaaaacctgaaagttctagccagtgcagtaagacaggaaacaaaaataagaaatgcaatttttggaaaagggaagacagaattctcatttccgtggatgataggtctgcctattttgaaaacaaaaacaaaaaccaaaaaacccattaaaataagaattcaggaagggtactcattataagttggaatgcacaatttagtttttctgtttcatcaataaccagtttgaaaatacaatgtttagaaggagatatatatatatatagtaagaaaaaattaaaaattgctgaggataaccaagggacaaggaaggctagtattttctcagtaacaccaactgaggtttttaaagggggatctttgtttttttcttttttttgtttgagacggagtttcactcttgtcgcccaggctggagtgcagtggcaggatcacggctcactgcagcctggaccttcccagtctaaagccatcctcccacctcagcctccttagtagccaagactacaggggtgtgccaccatacctggctaatttaaaaaaaatttttttgtgcagatgaagtctcatcatgttgtccaggctggtcttaaactcctaggctccagcgatcatcctgccttagcctcccaaagtgctgggtccgggaagttgaggctgcagtgagctctcatggtgccactgcactccagcctgggcaacaggagtgaggcaactgtctcacaaaaaaaaaaaaaaaaaccacaaaaaaagctaaaatctttccaaggacttaggcaactctcgtaagtctaatagataaatgtaagttttttttaagcattcaaacatgtttgaacttaattatattttcttaagcattttgaattatgattgtaagtctaacgtaccattgttaaatatattggattctcttaaatgtttcaaatggcttagtaacagcagaacattataatgattataaaacaaccccaaatctaagtggtaatagagtacagatttgactcactttatcctgtagtcctattttttaccttcttgggcctggagagtcacttaagcaactgaaaggagcagttttgccatctaggattgaagctgcagtctctcagacttggactgagataaggttatgtgtttactgcctggacagggggagtaggacctggttgccaattcaaggatgaccttcctgcatcccattggttaacttgctgattcccttcttatagtgagactgttccggttctatcagtgggggaatctgtaagccttcagctgggatttatttccacaacccagcgcatcacaaatatcctgagggccttggagatttcttttagggaaatctcctttaacatcttagtacgtgttgggagatggtcttttgcagcgccagcctgttacactgctaatcgttttgccgcctgattagaattattttaactcttcatttgtagatattttgttcccttatgtgatgttataagttgattttgtgatcataattcgacaaatgaatattggatatatacaaatacgtctacatgtatgtggatatatacgatatatgctaattttcctgaattaactcacatttgtgattgatttacaaccaaaatacagtgagtttttttgaaacctgccaaaataatacataggctggaatggcaaagtattatttataaagaaggataataaacatgagctttaactttgcaacattaaagtatgaaactttacaaaacagtgcaatactgattaaagaatctctaaataccgtattaatatgacacatggacttcagaaacaggccttagatatctgtgatgttgctttgcaatatatgccaaatcagcagaggaaggaaggattgtttagtgattgatgctggaagaaaccaagttacagcctctcctcatactttatagcatagcaaattcatctggggttaatgaagtaaatgtgaaaaaatatctataaatgaccatataggctgggctcagtggctcacacctgtaatcccagcaggagttcaaaaccagtctgggcaacatggcaaaacaacgtccctacaaaaaatacaaaaattagcacgcctgtagttccaactactagggaggctgaggtaggaggatcgctttagcttgggaggttgaggcctcagtgagctgagattgagtcactttattccagcctgggcaacagagtgagaccttgtctcaaaaaacaaaaaacctatatacacaagttcttctataagatctggttggagacgaacattctaggcataaaagaaatgggaggagtctcaaaggaaaagagcctagttttaactgcatacaaagttataatttccttggaaggagggtcgcttgaggttgtgagcttaagaccagcctgggcaacatagtgggtcagcatctctacaaaaaatagaaaaaattagccaggcatggtgggatatacctgtagtctcagctcctcgagaggttgaagtggtgagaggtttgcttgagcctgggaggttgaggctgaagtggctgtgattgggccactgctctctagcctggatataacagcgagaccctagctcaaaaaaaaaagaaaaaagttaacatttctttcatcatacctcactctaagcaacactaaacagcaaataacaaaacaagaagaagtacttataagagatatgacagattttgtatatctataatgtataataatttatgtataatatcaagagcgcttacaagtcaataagaaagtcacaatttattcaaccattccctgattgattgtcatttgattgtcattttggttgcttccatcatttttcttgtataaacaaggctgcaatgaatatctttatttattggtatggtagaaagttcacactagaatatgaactcttttaaaaagcaggacacaaaattgtatacgaagtaagcagaaaacatgtatggcatgtattagcatattcatattctgtgaacatttggaattctgtattcaaaatctattttgaccattcccaagtgattttgaaggtctttggcatgtcataatttgttattttgtcaaggccagtgtttgggtgtgagagtggtgcacagggcaggagtgtgtaactttgttaggaagtgagcctagccacaccctcctgagtcactggttctttactatcctggggtaggcaatatcttttgttcagctgataaaagctttgtcattgtgaagattggctcccaatgataggaaactgctggtgatgaaaataaaggggtcttaaagattattctcagccagaaaaaataagtgttagacaaattaaatggaaaataattaatattttagtagtctttacaatttggaggtctaaggctctgtcagcatgggttctttaaggtcaaggatctaggatacacatgcacaggaaaaaagactggaagtatgctaagcagtgactatctctgaatgattgtgaaaaaattttaggatgaataagcagaaaaaaacaataaatgacaaaatataacaatggagttttcttgacaatgaaattctcttaaacttaaatctctttaattaggcaggtaaactattttatcatcttcgtttgacctggcccttcttttcaatgttaacagaagccatgcagtgacacccgctaagacttgttggtagccatgtcggagccccacagggtccagttcacctctctcccaggttccctgaatcctgcgtttttgaagaagtcccggaaggaggaggctggggcaggagaacagcatcaggactgtgagccggctgcagcagctgttcggattacactcaccctctttgaaccagatcacaaacgctgcccagagttcttctacccagagctggtgaagaatatccgagggaaggtaaaaggccttcagcctggagataaggtacacccctttgttcccagaggcgctgcaggtttaacgcacaggggtcagtgcatgcatgtggggcttccgtagcggggaagcaagacttaactgaggttttggctgccccaagatcctgtcactcactcaaggcaagcacaagatttgcttctcttacctctgtgcgcaaagggagaggccaatttgaattatgactaattaacataaattttaaaaacaatacatttttctctgccaaggttataaacgttatgtgtaaatgaaaccagtccctgacagttccagtgttagaatttcatgctggacattttcctcttccaacagaatcttgctgtctacctagtataggggcagacaaaaaaacacgtagactgcctttttttttttctttctttttttttttttcgagaccgagtctcgccctgtcgtccaggctggaatgcaatggggcgatctcggctcactgtaacctccgcctcccgagttcaagtgattctcctgcctcaacctcccgagtacctgggactgactacaggtgcacgccaccacacccagctaatttctgtgtttttagtagagatggcgtttcactgtgttggccaggctggtctcaaactcctggcctcaagtgatctgcctgccttggcttcccaaagtgctgggattacaaacatgagccactgcacctagccacaacttgatggattttcatgaactcagtacccccatgtaacctgcacgtaggtcacaaaatatatttatcaggaccccagaaaccctccttctgccctgccagaagactacctcaatacttatgggcaaccactgccctgatttctaacagcttagatctgcttagatttgtggggtttttttgtttttgaggcagagtcttactctgtcgcccaggctggagtgcagtggcaccatcttgtctcagtgcaacctctgcctcccgggttcacgccattctcctgcctcagcctcccgagtagctgggagtgcaggcgtccgccaccacgcccggcaaattttttgtatttttagtagagacagcgtttcaatgtgttagtcagggtggtctcgatctcctgaccttgtgatccacccaccttggcctctcaaagtgctgggattacaggcatgagccacagcacctggcctctcttttttgttgttgttgttgttttttgagaccaagtctcactctgtcacccaggctggagtgcggtgatgcaatcttggctcactgcaacttccgcctcccaggttcaaatgtttctcctgcctcagcctcccgagtagctaggattacgggtgccagccaccacgcctggctaattttttttttttttttttgtatttttagtagagatggggttttaccattttaaccatgtaggccatgctggtctccaactcctgacctcaagtgatccacccacctccgcctcccaaagtgttaggattataggcgtgagtcaccgcacctggccgtgtttttgtattttatgtagatggaattgtatggtatttgagtaccgcctaggtgaaaagctgtttttttttttgagacagagtctcgctctgtcgcccaggctggcatgcagtggtgcaatcttggctcactgcaagctccgcctcctcggttcatgccgttttcctgtctcagcctctcgagtagctgggactacaggcgcccgccaccacgtctggttaattttttgtatttttagtagagacagggttccaccgtgttagccaggatggtctcgatctcctgacctcgtgatccgcccgtctctgcctcccaaagtgctgggattacaggcgtgagccaccgtgcctggcccgtgaaaagcatttttaagcacctgtgtctgcctttgcactgtgctaggctctgaggaaaaggtaagtgggccccacactcgcagcattgtggtctctagcatgtctcttagtgaaatggggatgaggctggtaattggttcacagttgtctgagtgtggaacgagaatgaaatcatgttgtgaattttctagcagtatgcctcagtgccaagtgatcagtcggtcttattcacaggtgtgctgttcggagggtatttttggttagaaggattaatctttttttcctgagattaaaaaaatgtgttttcttggcctggcatagtggctcacacctgtaatcccagcactttgggagtctgagacatgaggatcacttgaccacaggagttcaagactagcctgggcaacatagtgaaactccatctgtgcaaaataatacagaaattagctgggcatgatggtgcatgcctgaagttccagctactcagaaagctgaggtgggaggattgcttgagcctgggaggtcaaggttgcagtgagccgtgatcacaccaccgcactgggtgaaagcaagaccctgtgtcaaaaaaaaaaaaaaaaaaaaaaggctggaaggcctggcgcagtgactcatgcctgtaatccccacactttgggtggccgaggcaggcggatcacttgatgtcaggagtttgataccagcctgatcaacatggcaaaaacccatctctactaaaaatacaaaaattagccgggtgtggtagtgcatgcatgtaatcccagctactcggtaggctgaggcaggataattgcttgaacccaggaggcagagattgcagtgagctgagatcatgccactgtactccagcctgggtgatggcgactccatctccccctaccaaaaaacaccaaaccaaaaaagaaaaagtgtttccttgattgagatctgattgcctgattgccagaatggaggcctgtgagtctgtaccaagggtcagcctgttgcatgagcaccactgggcagaatgacagaaagtaatttcaaatccctttataattcctgtttcaggaaaatggtatcttcttcctttagaggaagagacaggagcaggagttggttaatgtgtttattcatgggttcaaaccaaatcagcaggtcaactgaaattagaactccagtgctctgatgtcacctttttggggactacagatgcccttcaccattgcagaaaaatgcatggaggatacacagagaattttgatccaattcagaggattcagtcctggacttcgggttcagaactcctaaatcgtcgtgggtctactctgcagtgttaaaaatacaataaaatcaggcacatttgtgcagcagttcttttagtgtatagtccttaatagtatgaaggcattgtgctagactcagaggactatagaaagttagagaaaacactgtaccagcctcaaaacaaacatcctatagatgttttgagagaatggtaccaccgcaggtaacagaaattacaatatggtcattgtttaagtctggtacgacacaggccctggaggtcttagaaagaagagagcttatttcctgattagtgttgggacagagctggaccttccgtcatacagtcaggaaatggtagttattggaagactgctgttggcaaggcgttcagtagtatacatagaatccagtgctgctcaaggttggtgggatttcttacagttacataaccactcaagttatatgcgatcattgtagaaaaattagaagatccagataagcatgtttgaaagactccccatttgaggtatgatcgttagatgtatgctctataatatcccattgtatgtgtacaccacaaatcatttaactgatcctttgcaggtggtatttcagtaggcagagatgggagggtgagataagaaagtttgtttgaaacaggcatacagtctttagtgttttctgtctaccttgaagtcttaaacatacttcgtacaggagtcttattaaaattaggattcctggctcctggctgggtgtggtggctctcgcctgtaatcccagcactttgggaggctgagatgggcagatcatttgagcccaggagcttgagaccagcctgggcaacatgatgaaaccctatctatacaaaaaacttaaaaaaaaaaaatttagctaggcatagtgttgtatgcctatagtcccagctattcaggaggctgaggcaggaggatcacccgagcctggggaggttgaggctacagtgagtcatgattgtgccactgcactgcagcctgagtgacagagtgagactcttatctcaaaaaaaaaaaaaaaaaatttttttttttggattccttgctcacaaagcttaaggcttatctgtggaaaatttgcttgatgagaaaagaataagcttataaaatggaaataagccttggaagcctgagtttaactttggtagcaccgagagaagtgcaaattcagacctttctaaacagtatggcagaacggctctcaagaacttgcaccacattcagtgggattttcacgtttttgagcccttgactattttggaagtcaatggactctttcttagaatgtttttaaatgcctgaagaaaattttaagagttacaaaggaagtccactttattgaacgtggttgtgtagcgactgggcatctccttctaaaggccctttgctgtctttgagtcctgcagcccctcatgctgtggtggatgattgtaggcattcaatcaagttttattaacctacattaagggaaattttactttcttaattaagataaacattgatgagatggtagcatgttttctaccttgcccttttctggaaaacattgtttttatagaggtattgagtaatcagtgaagtttctatgaataagaacatgggaatattttctgacttattttttgtggaacgatctctttacagaagaaagatctgtcagatcctttcaatgacgaagaaaaggaaaggcataaagtagaggcccttgcccgaaaatttgaagaaaaatacgtaagatttctctcttgaataacaaaacaacctcattgggtgggagacgtttccacactgtattcctttagtggatcatcatgtaataaacactgatctggaagtaagccttaagcatggagagaagagaagcagttattaaacctaacgcattaaggtacagaaaaggggcatggcagagctagtgtgaagagctaactggacaaataaccgagaagggcctgtggtcgccttagaagaaatattttggtacaaagcataagaagccatttagttcatttttctgtcctaggacattttatacaggtacaaatatgttctatgttaaaaggttttcaggaaaggaggttttggggtttgtgtgtatgtgagagagtgactgttttagttagtgcattacctctttgagtcatagctgatgaagttcaaggccacagttaattctgtgtgtttattcaaaaagcatgtaatctattgctttcacattttagggtggaaagaaacgtagaaaagaccgaatacaggacttgatcgatatggggtatggttatgatgaatccgactccttcatcgataactctgaggcggtaagtagttactgaaaatgccgtgtcagacccactgtacctgtagctcctcctgatactgaccaggaagctgggggtggggtcagagcagtcgtgccctcttcccagcatgaggcagtagcagcactgatgagagacgaaatgacattctttatccgggtcttagttccctcttcagaaagtgatgaccagatctgtccaaaacaccttgtagctcagacattcatgtttgaccagaggatgttttagcatgctcttggaagtggcagaggagcacagtcacatctctctcgagacccactttgcaccttcggactgcagaagcagaacttggagctgacagtttgtttcccatcttcagtatgatgagcttgttcctgcttctttgactacgaagtatggaggattttacattaactcgggaaccctgcagtttagacaagcatcagagtctgaagatgacttcattaaagaaaagaagaaaaaatctccaaaggttagaatgtgcttgcttttggatttcagaaatgctttttgacgtgaccctatcagatcagtaggtgacttgccagaatacgtggcgcttggccggctcaggaggatggtggaaaggcagagccgtgccaggttgatggctcgcctcttacacgtgtgccctaatgaggacacgtgcccgtgggggctctgttcagcacttggtcattatgtccatgtcacatgacatcccagcaggctcagcaggggtcgtttctggaggtggcctcagggtgggaaggctgtggaatgagggaatgtgtaccactcttgctgaccctcttctgtggacatgtagaggacttcagtttcagggctgccatcccactgaaaaccagtcagccttaggatcagtgtgtttaaaaacctgtctaccactgcctatgtgtttaagatgagaggtagggcccacttgtaactttcaaactacaaaggtttcaggctccagaatggtcactgttgtctcagccctgggtgtttccaggagacaccgtcggtgggaatgctgtgggtttgtggtccagggactgatctgagagcttttgttcatgaaggaaatgagacaggtctcaggatgtgccccgggcggagcaaggccagtgccgtgtagtgcacttgctccctgagttagggagccgtgtaactgtgccttgtctttaattctcagaagcggaagttgaaggaaggtggtgagaagataaagaagaagaaaaaagatgacacttatgacaaggagaagaaatcgaaaaagtccaagttttccaaagccgggtgagaggcagcagcttctttgctaggataaagcctgaactgttagggcaggacgactgggagctgactcacctcctccccacagcttcggaagaggcagcagggcctggccttcctgtcctcccgcacgcctcccgcagtgccattctgggcatagacgctcacctctcagtgtgtcagatagttccactgtcagtgttggcagctattgttgtcactgtgtgactgctgatgtttctcgtcctctggggtgctcctctctgccccagttctccttctgtctccgctgttttcccttgttgtctatggtcatgcttccttctcctcacttggtctcaccccagcttctcttcaagttgctgctgttctctgctgctcctgctttctccctctaaatacttttcttgctctccctgcccctttttgcaaccttttatttcagcctggcagtggtttctaaaaacccgtcggaaatttagcatatgtgacactgtgttgctaacctgtattaactctcaagctttggtctcagcaagaacgagctccatatgccaagaggagggaggaggaatgacagggtggactgtgacaggttctcctggagaccatgaccctgggagcaggggtgaaggcctctggagttccctttggaggtgtcctatagtctgagtgaccagtttccctcttgcttgcagcttcacagccctcaatgccagtaaggagaagaagaagaagaaatattctggggctttaagcgttaaagagatgctaaagaaatttcagaaagagaaagaggctcagaaaaaaagggaggaggagcataagcctgttgcggtcccatcagcggaagctcagggcctgcgggaactggagggtgcctctgaccccttgctctcactctttggctctacttctgacaacgacttgctccaggcggccactgccatggactcgctgacggatttggacttggagcatctgctcagtgagtctccagaaggaagtcccttccgagatatggatgatggaagtgattcccttggggtgggattggaccaggaattcaggcagccctcttctctccccgaaggcctgccagcacccctggagaagcgcgttaaggagctggctcaggtatggtggcacagtgcggctgggctttcctggaagcagtttgggcagattgctgttggttctgcactgcgtgaagcttgcccagagaaactcttagtgagttggcagttaaggtgtcagctttttccaaaccctattctcatcctgagggagaaaacagtgtaagccttgcccgtcaggcatcattttaggcctttcttggtttcttcatttctggaaaatttgctttcttctggggagattgttctctttctgttttctgtcagtttgttttccacacggcatcttttccttcatgtgatagacggatgatgttggcagcaggcagctgaggcagagattaatcttagaattcttacgaaggttttgcaaattcacaaaagtttgtaaacatacaagttacacgtagagtagatgcttcgttgccactaggtttcagtcgctcccttgcgttgtgtatccagtgttaggtagtgattacaggaatgcctcaaatgtgatgaatgaaaagcagcttaattttaaatgctgtccatgtcccattaaaacccaccatcggcagggtgcagtggctcacgcctgtaatcccagcactttgggaggccgaggtgggcggatcacctgaggtcaggagttcgagaccagcctggccaacatggtgaaaccctgtttctactaaaaatacaaaaaattagctgggcctggtggcgctcgccgtaatcccggctacttgggaggctgaggcagcagaatcgcttgaacccaggaggcggaggttgtggtgagtggagattgcgccagtgcactctagcctgggccacagagcaagattccattaaaaaacaaaccaaccaccattaccacctttaggatctagcagctcttgctgttttactccagtgattgggaattaagcactgagaattgtctgttcaagtaacacatttctaactgtaaactaggcatggatcattggttgtaatatcatttacctttaagttaaaataacattttaccttaagcatcaggacttgtgatgcagctctagtggcagtcataatctacagctgtaggttttaaatcagtgattcttacagtatttcagaagcattgttacctataatatcctttgtgttttagggcagggtaaattgtcagctactgctaaaatgattttctcacttccaaaaaatatttgaacaccatatacaaagcaaataaagtatctattcaaagctctacctcatctttgtcagcttgtgtccagcattggaaattcaagtattgtatttgaatgtaatgatttaagtgaattgtaccatgttggggtttggagtatctcttagtatgacattgaggtggaagtagctgaatctgaacttggtgtttttgagcctgctgtcctatatttgctctcagaattcatgttaaccaaacattactccttgttctttttaatcctctggttcgtaatcaaattgtttcttagcttctgaaagtcttgttaaatcatttaaggtctatgtgacgatagatggtcgttagagaaaagtcaaaaccagattcttggctgtgtccccactcgtgccataggttgtgttctagtgtgaaaacttactgtttcactttcttgggaaagatggggacagatttagtggcaacagaatgacataaccggaaacaatgttgggctgtggtgcaagaaagcggagctgagtaaacaccttgttaggcaagctgcccctcctcagtgattgccaagtgtcagttagctcttgggcataacaaacacagggttcaggatcccatagtcaaggtgggcctgggtcccagtggggagctggtgaccaggagaggctgatgttctggttggaaaatacagtattcaagtgtgaagttgatattcgagtcttcacattgcccttctcctataacagcattaagaaactttgaaaaatggggtggaaggtgtatggaaattatccatccggccaatataaaaacaatttctagttggatattcttttctagcctctgtgtatatgtttttatgcagctgtaattatagttgtgaataactgttttctgcctttttacgtaatattataaagccctcatgactttttatggttgcattaaaaaggtggcttattttaaaaagatgcttaatgctactccgaagggtcctcaggtgcgctcttctgaccagggccctgcacttggggcacttggagtccctgcatgtgtgtgcaaatgctcaggacccctgatcccactgagaatctgctgggaaagatagtcttcccagggaaggaatgcactggtatactcaaattgcttatgattccaaaagccacatgtggatatttgatatttggatccttaataaggggtccatcctagatcttgaaatggacatcgcatttttaaaatttaaagtaaacctgatgtatgtaactgggacattagcagtgttacgtgtttctcactttattttttatacccctaattttcccccccttttccctctattataagattgggtagactttacatcttggccctaggtgacacacaaatcagtttctatcactgtctgcaaaacaccccccaaaatttgccttgtcatagcagttcgtttctcctgactctgggccaacgctcatggctgcattcagctggcaagttggccaggtgctggcagggcttttctttcctggcctttcatcctgccttcttcagggcttggtggtctcagggcaacatctcaagaggggaaaggtggaagctgcagggcccttgagagctagccttagaggctatgtgtatcacatgacttccagcacacttttggtcagagcaaatcacaagagccgcccagatccaaggattagggagctagggtgcacctctttgggaggagaatttctttgtgggaggaatctgtgatcctggtttgttgttgttgttgcctttttttttttttttttttttttgagacagagtctgactccatcacccaggctggagtgcagtggtgcaatctcagctcactgcaacatccacctccgccttctgggttcaagtgattcttgtgcctcagcctcccgagtagctgggattacaggcgtgagccactgcgcctggcctgtgttcctgttttgtattctgccacagtacatagcagattcttatcccatgtgtattgatcccttaggggaaaaaactctgggaagcaaaattagatatatcttctaactaaatatggtacttaaaactttaaaaaatgtctttgaaaacttgtgtatgttaaagaggtcctctgagagggaaccttggtgatgcctctgccacgttcactacattctcacatcagcctgttttttgttactgatttgtattgtacatttgtataggccccagggaatccagtgatttgatggccttaccctgccctctgttaatatgcattgatggtgtcttttgtcttggttgttggcaggtacaggtgctgacaaagctcaggtttgatgctcctttgggttattgtcttgaggtagtttgacagctactcagccttgggctggacaaataacccagatctattttggttctctttagtcaagcataacatagagacaatactaagagcaggaatcaaagagaccccatgtcacccattctgctctgccctctatagaattagaacccctcatcacaagaagtgcagggagagatggatccaaagagaataacgtagggggaaaaaaaacgaaaacaacttgtttgatctttttaaaaaaaatcatgcccgattttctcctactcagcaaaaacagatacagtatataagattttgagctgggtgctaaaaggctacaggtgacttttcttagaataaataaaacagctcattaaaaggctgttggaactcttataaatcagcatgattgggatgtttaacctcatttactagttaacttaggattgattaattcacacaacttctggggtaagagtgtctctttttaggggtgagggaccccatttatttttggaagactatcagatatatatccaattgctcttttaattagatttactttaaaatgccgcagtcgactcttcagtataaagccagaccctcagagatattgtctatgcaattcaaaaggtttacagaaaagtactttctaaaattacataatattatttaaaatatttttaaagattgcgtaaagattacatagaaagcttctgaaatattgtacaagtggctatctaaacagaaaatttggcagggcgcggtggctcatgcctgtaatcgcagtactttgggaggccgaggtgggaggatcacctgagcccaggagttccagaccagcctgggtaacagagtgagaaaaaaaaatctaaaaattagtcaggcgtggttgcgtgcagctgtagtcccagctgcttgggaagctgaggcgggaggattatttgagcctgggaggtcaaggctgtatgagctgcgatcacgtcactgcactccagaatgggtgacagagtgagaccatctcaataaaataagatgctgggcatggtggctcagcctgtaatcccagcattttgggtggctgaggcgggcggatcacttggggtcagatgtttgagaccagcctggccaacatggtgaaaccccatctctactaaaaatacaaaaaattagccgaacatgggggtgggtgcctgtaatcccagctactcaggaggctgaggcaggagaatcacttgaacccgggaggtggaggttgcagtgagctgagatcacgccattgcactccagcctgggcaacagaacaagactccgtctcaaaaactaaactaaaataaaaaaataaaaaataataagataaaatttgattggaagtttaagctgtagatgggtctgaaagtgtggcatgtgaaatacatgttaattagtttgaattaatgtaagggtgcttctcgatcttaaaactagcagtgtaagcttaagcaaaaaaagttcagttttattttttcccagactaatataattctagtaccttccaagtgctaaggtagaattctgaatgtttccaagagtgtaagaaattggcacatggctgggtgaaaagtcatgccctttttttccattattcgtctgtggatttcacccctctgggctttcacctagccaagggatctgtagaagcttgagttttgcgcattttcttctgacttagttttggttgtttggtgttaagcttttcttcctgtggcgtgccgttttacagtagtatcttcatttgttgattcattcactcagtcaacatttagtaaatattatgtgacaggcagccatgggaaatatactgatgaataagactcagttctatattttattttattattattttttaagacagggtcttgctctgtcacccaggctggagtgcagtggcacgatcttgccttactgcaacctccacgcccagggctcaagtgatcctgccacctcagcctccagagtagttgggaccacaggcatgcaccaccatgcccagcttttttttgtatttttagtagagacagggtctcatcatgtgcccaagctggtctgaaactcctgagctcgcgtgttccgcccaccttggcctcccaatgtgttaggattacaggtgtgagccaccgcgccgggccaaggttccattcttgtctttcatgagctcgttacataaatggacccgatagatacgcagacaatggactgtagtacagagcagaatgaagtaagctttgtgatgtgtggacggccagatagccggacttaaggggttaaagagaggctcttggggggcatataggaagcagactggaggcaacaggcttcgccggcctcctggggaagatgccctaagagaaggcagggagcagagctgaagatgggcgagttggtggatggctgggccagatcgtggaggaccccaaatgccatgtgaaggagtttgggtttgataccaggcttggaaagagctgctgaagggttctgaagaagggagtggcggtcttaaggttggagtgcaattattagaagtggggaacacaggggaagagcagaagccagtgggtctggtgtaagttgagtttgcaaaccagagggtcatccatccacagaagtgcagttgacccttgaacaacacagggtttaactgcgtggatccacttacacgcagatgttttctaaccaaatgtgggttgatttgagggatgctaaatctgtgtatagagggctaactttttgtataggcaggttcctcagggctgactgtgcagttggattttggtatatacgggggtcctgtaaccaatcccctgcctataccaggcgttgactgtaattgggaaatttctcagagataactggaaattctggtccagagcttagatgagaggatttagggcttagtttagatttgagtgtacaattgtctgtgttattttgaagccctgagggggaaagaagttattgggagaagtgggttctagtgagaatcctggggtccgcctatggaaaggagctggtggaggaggcagatggagcagttagagtggttggaaggggccccagaggatgcagtgagaggaaggtgagtgggggagatgatggtgaggggttagcagtgtctgcaatttcagaggggttgatcccttcattctagatagtcaccttatcacccttgtttgctgtcgttactgtatatcatgtctgatttcagaaattttatttcacccaaagccttcagaccagcagctcttgggttgagaggaatggttcccagccctttttgcacatcagtgttcccagggttgctttgaaagagtacttgggccacttttgagagtgtgcattcctgaatctcctttccagagactgtgatttgaatggcctgagttgctccaagctgcccagggaattccaatatgcaaccaagtgtgagaaccctgatgcagacttccacagggtctgcttttttgtgttcccgctgtgtcgtggctgcctgccgtggttgcttcaggggtctctgagcttgccatccagggtgtgtgttaactgtgttcttttcgaaagcaaactaagactgtactgaaactcctataatctggtgttaataggtaatatggtgggttaattattcacatggtctggctaatagagagctcgtggtataccataagtagattaggaattgtcaaagagttttaatgtccttaagtgttagagctacacattattattatttttgtagataaaaaggcctttaaatcctatagactggttgaagttcttgaatatttttgtactgtagatacatggaaatcccaactaatggtgtagttgatggtgtatgggtgcaggggttagttggccttattggcctctggctaagtgcattgtgatggctttgactctgattttcttttctgtgactgttttaagtcccaggaagaactggcagcccacagatgctgcagcagcatttgaaaagagaatattgatcgcaggcgaacttaacctgggactagggtggagttggaaaggtggcggtgtgactgtattgacaggtgctctttatggagcgatgactcctgtgcctgtgggtgagcgtaagggacatgtggggaaagtgcactaacggctgttactgtctgctgtgcaccaggctgccagagctgctgagggggagagcagacagaagttcttcacccaggatattaatggaatcctattagagtgagtatcgtctgtctgtctgtctgtctgtctgtttctgctattactgagcttggggcaagccagctaggggacagtgggagtacaattgaactgcataaaggtgaccaccaaggagataaaagaagaattggattaacatggtttcattgttatttttcttttaaaaatcaaaacacaacagggacaccaagtacttgtctccagaagcgatagacctccttgatcttaggcagcaggcattaataacatgtgataatcatggcctgttagaagaggatttcttggcaggtatgagatgaggagagagagaaggtgttgcctgactgtctctgagaatcctgaagaatgagagacagcctggtggcctcgggcctgctctgccttgggtgttgcttggcgtccctggctgttccgctcgctggcactcctgttcctagtgccacgtgcatcatccctaatgctgttcccacatgcctgagcctctgagacaccacgctgtgtgaatcgggttaaaaaacagatgagcaaacatttgtaaatccagactgggaaaagtgaatccttgtggcctggcctgcagtgttgccgcttttctcctggttgcagtttgtggcaggggaagcttgttgctcaacagctgaggagtttgtgtgtgtaagaacagttgtcaaaatgtgggtgttctaccacatggcctcgcctggccgggacctggattggccccttgggtcaggaagtgtgagctgcagagagcacctgagcattggtgcggacgataggattgtgtcaacaaggaacctgcttgagcgtgccaaatgtggacagctcaaggcattgaagagaaatatttttttgcttatctagatggagaaactggaggggtgaggctttccctgacctcataatggttgataaacgtggggactgggggaaaaaaaagaaatgctgccgggaagtgtctcctttgaaccccaagtaactcatgactttccactttgaaagctttcatgttttctctatgaaatttagtgcttcagagcttgttctcctgggctctgttttcctggtattgtgacctaagagccttggcccacattacctagccatgttcatcaggcttgggagttgttgttgtttgttgattgctgaggatgtgtttccttgggcattcagttacattgtgtgaccaacaagacagggtttgactgccgttggctcctagctttcctctccacgtacggtgagctgatgaagacaggagttgcagtgagctgcagccggtggtgactgtgttttgttcttcagcatagaggcgcagactcgggagctgagcagtcaggtccgctctggggtgtatgcctatcttgcgtcattcctgccctgcagcaaggatgccctgctcaagcgtgctcggaaacttcacctctatgaacaggtgggtgactctagagtgaagccctttggctttggggtcctggcggaggggtgactgagtcttaagcaatgatgcgtctgctgccccactgcctccttgtgatcaccccatcatgcgtcctgagcgtaagagcgatgtgtaaacctgccttgaattgtgtcccgctcttcgcaggggggccgtctgaaggagcctctccagaagctcaaggaagccattggcagggcgatgccagagcagatggccaagtaccaggacgaatgccaggcacacacgcaggcaaaggttgccaagtaagtttgtcctggcgcttgcaggtgcaaccctcccgtcttgcctcttcccctcccgtttctcggtgtgtactgccgtttcccaaggagcctcttggctcttctttggccttttctccttctctgtgaagtcccagtagtgcagagtgaggggagaggcggtgggcaggagcaccttggggccccatgtaattctattcaccccgtaggatgctggaagaggagaaagacaaggagcagagggaccggatttgttcggatgaggaagaagatgaagaaaaagggggcaggaggataatgggacctcggaagaagttccaatggaatgatgagatcaggtgtgcccacactgggacttggcctctttggagggttggtggggcagtgtctgagcacgtcccctattgctgacaaaggttaggctcatttactttcatcagggctgctgaaagcacatgattggaaccttggagcagcatctgaagtagtttggagtttctgatttctgcctccttctcagggagctactgtgccaggtggtgaagatcaaactggagagccaggacctggagaggaacaacaaagcccaggcttgggaggactgtgtgaagggctttctggatgcggaagtcaagcccctctggcccaaaggctggatgcaggccaggtgagggccgtgtgctgagatgggcatctgtgcagtcaagacacgtttgaacgctgcttttgtgccaggccaacaggatccttgctcacagggagtcactgtctagctgcctcaactctgatctcacctgagtaactgggggacatgcaggtagctgggaaagggtcttctggatcttccctggaggaagggaagttgcctccagggttttgtttttgtcattttttgtcccacttcagttgatgtttggcctcccatctcaatatgcactttccttttttttttttttttttttttttttttgagatggagtctcgctctgttgcctgggctggagtgcagtggtatgatctcagctcactgcaagctccacctcccaggttcacgccgttctcctgcctcaacctcccgagtagctgggactacaggtgcctgccaccatgcccggctaattttttgtatttttagtagaaatggggtttcaccgtgttagccaggatggtctcaatctcctgaccttgtgatctgcccaccttggcctccctaagtgctgggattacaggcgtgagccaccacacccggccacacttcctgttttaacatacaggctgctatgagcatttgagagatgggttcatcttgggtctttcctgatgttcctgaagaagtgtcatttgcaggtagcagggctgactccttattggaactaagtgccaggcttccatctcagaggctaccttgtacgaagtcacttcctgcgaatgaagtatttgtgtcatacatgggacagagaaagttagctggagtgattttcttgattggactcgaatcatctgttgtgcggatagatcttggaacctttgaaattgctgtcctctctacgtaggctggactcatacgaagaacgtttttgttgagtttctctggacaaagacatgctgggtcactccacattttattcctggaatggagggactaggcaataaggaaagtgctgtgccctttagggaagcatcaccatgagaggtttgaggcagagccatacattttcttggtaaaggccagactcagcctttgggcagccagtgtgtcccattgagatcctctcaccaggaatttggctccccaatccattgacctttttttttgtgtgtgtggggggtgggtgggcatggtgggggggcggggacaaagtctcactctgttgcccagactggagtgcaatggcacgatctcggctcactgcaacctccgcctccccggtttgagcgaatctcctgcctcagcctcccgagtagctgggattacaggcgtgcgccaccacgcctggctaattttagtatttttagtagagacggggtttcaccatgttggccaggctggtctcgaactcctgacctcaggtgatccacctgccttggcctccaaaagtgctgggattacaggcgtgagccactgcgcctggccagttgacatttaatgagggatagctactgaggaccagggacactagcaaagttctggaagcagagtcccagctttctggggcatgtacagatgcctggtgttctgtgtctttcagaactctgtttaaggagagcagacgaggccatgggcacctgacttcaatcctgtgagtgtcttggtattttcacatctcgggacaagtgttgtttttggtctcctctggatattctctaaacttttctgtgctcattcctttgaacagggccaagaagaaagttatggccccttctaaaatcaaggtgaaggtgagtcagtttgctcgggtcacatgtcagctatgcccatctccctacaactatgctctggaaacagtcaagtgactgtggaagctcattgatctttgctcgtctggggacagctgctcaggatgacattcttgaagtcataacaggacagagacccaagccacttaacccccctctagccttggttctacaaacagtacccagctggcccagttcctggggttcatgtgggattaagtgggatcttcttggcagccctctgaggagtcagtagtccctgaaggtgtgaacgtgttacactgtgatctttgtatggaagaaatacactctagccaagtgcagtttagcttggagccacagcagaaagaaaaggcgactttactgagctaccaggcagaaatggagggcaatatagtggctggagaatagacactgtgaaaattaccttagatgttgcagaaacctctcaatgtagtaaaaattgctgtttatcaacatttttcccagttcttagtgtggtgcccttagccatccctaagcagaccgtgagaatgagatgtgcaaatcatttactcctaagtatctgttgagctcccacaatgtcccagacacactgtattaagcaccagggatgcaggagtgaaggattagaccccattcctgttcccatgaaaagctcactcttctttgaacccagtctgaggagatgggtgctgggaaaaatcaagaagggaaaaatagctgctttaaggcaattctcatgccatgccttggtctgattgcagctaggagtgcgctgagacagtgggaatgccagtaggcagagtatctcttcacgagagtcttaacgcttttcaaaacagaagaaagtttctcctggcggcttgtttgtacttagcaacgaagcatgccggggtaaacccagccctggccaaccagatactcaccaggggtgatgaagtcatggcatctaaagtcaaggcgggcacagctcctgctctgtcccaccacttgtcttgtaattatacaggaaggcccagtttttttgactcgagttcacatgtttgtatcctcacaacaggccaatgttggcatctttggacctttctaaacatcaacatttctgttttcctttaggaatcgtctacgaagcctgataaaaaggtttctgtcccatcaggacagattggtggccccattgctttgccctcagatcaccaaacaggaggcctgagtattggggcctcgagcagggagctcccatcccaggcatcgggcggccttgctaaccctcctcctgtcaacctggaggactcattggatgaagacttgatccgcaatccagcctcctcggtggaagccgtgtccaaggaattggctgcattgaatagcagagcagctgggaactctgaattcacactgcctgcaccctcaaaagcacctgcagaaaaagttggaggcgttttatgtacagaagaaaaaaggaactttgcgaagcctagtccttctgctccaccaccagctagctctctgcagtcacccctcaattttctggcagaacaggctctggcactggggcagtcctctcaggagaaaaaaccagagagttctggctacaaagagctgtcctgccaggctcccctcaataagggcctgccagaagtacatcagtccaaagctaagcaccacagcttgccacggacgtctcacgggccccaagtggcagttcctgtgcctggcccccaggtcaaagtctttcatgccggcactcagcagcagaaaaacttcacgcccccatctccatttgccaataagctccaaggcccaaaggcttctcccacacagtgtcatcgttccctcctgcagttagtgaagacagcggccaaaggccagggcttccatccctctgcaccagccacctcaggaggcctgtcagcctccagcagcagctctcacaagaccccagcctcgtcctcttctgccctgagccatccagcaaagccacattcagtcagctctgcaggctcatcttacaagaataatccctttgccagctcaatctccaaacatggggtttcttctggcagctcttcctcgggaggaacaccagtccagagttctgtttctgggagcctggtccctggcatacagcctccctccgtgggacaggccaccagccgacccgtcccaagttcagcagggaaaaaaatgcctgtttcccagaagttgactctggtagcccctccaggcggtccaaacggagattccagtggtgggacccagggagtggcaaagttgctgacctcgccgtccctaaagccctctgcagttagtagtgtgacatcgtctacctccttgtcagtgagtatctgtcatagcagcctgccctgccccactcacaggggccttggggatgaggttgcttgccttgccccgggtggagagtgagatctaaaaccacaggtcaggtaggaacagtgggctcagacgtaggaagggagactgggctccctgttctcaggtattcacttttctggtgacaggaagcccaggatggcctaaagcttcttctgaggagggcagagggacctaaaggatggccagcaccaagcaccatgcctcttcggaggctgtctgtgtggcacagaatgagcaacagcccttgccttccgtgaccccttgcctctccatctctctaaagggggctggaaatgctgtcttctatcagttgagtcatgtggaggtgttcatggaccaggaatagcaggaccttctaagagtgattctgttggtttttgaaggacagagtccaataattaatgcatctcgcttgtgtgtaatcacagcaggttcgggaagagggagtgagcattttcttttctttttttcttttttttttttttgagacgaagtcttgctctttcaccaaggctggagtgcagtggcgctatctcggctcagcgcaagctccacctcccgggttcacgccattctcctgcctcagcttcttgagtagctgggactacaggcgtccgccaccacgcccagctaattttttgtgtttttagtagagatggagtttcaccatgttagccaggatagtctcgatctcctgacctcgtgatctgcccgcctcggcctcccaaagtgctgggattgcaggtgtgagccactgcacccggcctctttttctaatatataaatgaagtggttgcaaagacaaaaccatagaaaggtctgttggaggtctcacctcctttcctgcacccaccacctctgtaaggtaactaagctctttagtttctggtttattttcctctttttaaacaaaagattaataaatataaataaaggtatatatgtatgtgtgtgtatgtatgtatataaatatatatacacatataaatatccatgaacatttatggatatctatattacatttttcccttcacaaaggaggctttttttttttgagacagagtctggctctgtcacctaggctggactgcagtagcgcgatcacagctcactgcaacctctgtaggagacatatttaatatcctgcttttaaaaaaattatgttccctggaatccattccatgttggttcataaagactgtcctggatcctgtctttggggctgcagggtcggagggtgcctcccagggccatctgacatggatgtgtatgtcctcctttgtggacacacaaggaggatcctttgtgttgccaggtttggtgtgagtgagccacgaacaggactggagttcttaccgcttgctgtgtttcttccctagaaaggagcgagtgggactgtgctgctggccggctcctctttgatggcttcaccctacaaatccagcagcccaaagctgtctggggccatgagctcgaactccttgggaattataacccctgtccctattcctgtccatgtgctctccttcagcgctgactcctctgccaaagcaggggtctccaaggatgccatcgtcacaggccctgcccccgggtccttccaccatggccttggccacagtaagtgcttctttgctgcctctggtcactcaggaacctctagattgtggccaggggtcctgctgttgtgtactctggttcctgtgtttgagtctggtgtgtgactgtggggaacatctccgggaactgtgccaagcccccactgcccctttgggtgtggtgcccagactggcctggcaggttatcgggggcttttggctgctggagctgctttcctgttcctgtcttcaatgtgtgtgttttgttcttttctcccctcctgttttctctcaggtcttctggctggcttgcactccagcccgccccatgcagcgcctctcccacacgctgcggtgcccacccatatcccgcagagtctgccaggtaatcacccgacggtcagtgtgccacgcgcaccgtgtgcctttgccctctccacccctaggtgctttgccgctgccaagggtcttggtgtctttgccttgacgctgttgttgttttggtttgtcctttgaggctgtgctttgtcagtactcagggtgacacgcacttctactcttggggtttcctctggtccccacttggagctgccgccaggtcagcctcagcctgtgtgatcacagggaaagttgcggggggcagggtggtgcgcttttgtgtgcggtggaggagttcctaaccctcggcttgtttttttctcttcagtttaaaaaaaaaaaaaaagggaaggtaatggtgcatcttctccaagggctaattgggtacaacaaggtcttggaatgcaagctgctccactgtcagatgtgattgcttaacagaaggctctctaaactttgtttccattaaagggaaaatccaggtagcagccagaggccacagtgcaagactttgagaggagcagctttaaatctgtccaagtgtgaaaactccatcagaacagatttgtgggagcacagcaggcatgtggtcggtgctccccttagcatcttctgaaatagggaacttctaaaagcctcaggcttgaggctgctctggtagcacctgagaactgggctcaggtgccccgggttggtacctttgcattgagtgcgtctgcctcaccctatcccgagtctgcgattcttgggtacgcctcctggaattctggcatgggaagtctcatggtgtctcagctttgacctagcattgttcctactgtagacccgcttcagacatgaccagggtgctacttggataaggggagagccgctcgtatggaagccagccgaggtaaccctggcgaactggtgccaggtggaagtaaggaccctctgtgctgcacgtctcccaagttacatctgcctcatgatgtgctgtggctccctggcaccatggcgcattatagtaaacaccagaggccatatggggcaagactaaatctgtaaatctccacaatggaaactgtgcttctttgaggggctaagcctatagcactagtgactcctcctttccttgggaggagaagtaaagtgcagtgacttctctacagactagaggctgcagagccaccttggtgagagcaggggtctttccaaagtcaggctgccctgcctttgcttactctcaggaatgttactctcagaaaagcaaagtaattgaggccggacgcggtggctatcacctgtaatcccagcactttgggaggccaaggcaggaggattgcctgagtccaggagttcaagaccagcctgggcaacatggcaagaccctatctctacatttaaagaaaaaaattagtcaggtgtggtggcatgtgcctgtagtcccagctctttaggaagctgaggcagaaggatcacttgagccgaggaggtcgaggctgcagcgagccgtggtcatgctactgcactccagcctgggcaagagtgagaccctgtctcaaaagattgctttctgctatattttcatttttcctctgggtatgaaaaggctatcagaataggaagaataagtgctagtgttctataccactgtagggtgactgtagttaacagtagtatgtagtttcagttaggaggaggatattgaacgtcgccagcaaaaggagatgaaaaacgtttgagatgatggatatgctaataactctaacgtgacactacacattttagatgttgaaacatcactatgtaccccataaaatatgtgtcattattatgagtcagtttttaaaactgtttaaggctctcagaggctggatgtggtggcattgagaggcaggaggattgcttgaacccaggaatcagagggtatagtgtgctgtgatcatgcttgtgaatagctgctgtactccagcctgggcaacatagtgagacctcatctctaaaaaaattttttttaatcagtttaaaagttcgaggaaaaagaaaatcaatcagaaaagcaactataccaaaacagggttatccaagtgagcttctctcacttccttagatggacttcagcttataggatgacacgagatgcgagtaagaagctatttgcgcatttcagctgcgtgacttgtgtctgcgttgctttcctttctttcttctgtggactgagaatgctagtgcctttgaatttgtctttacaggacctgagggtcttttgatggtaagagaatgaatgatcattgctgccttgagttctgtgtgatcgtcaggcctcgcctcaggatggcaattgtagcctgagatgacgtagcccaagttgcacagcagagttgctgttctggaaacactgtgctgagtgaccaccgaccttcacagtgctagtgtgcttgcaggctgtggccaggagtagtgtacacgaataactgctggctggtgtctcatggcttgtttgagctctagaacactcagcatttggggacttttgctatttaggtgtctcccttgaagtttggttactactgccttaaggaaatcagagagcatgaaaaacttgcgttctaatttttcttactcttttccaggtgcttctcagcttcacgggaaagggcctgctgtaccacggaaattgtgaccgcttcagaggcaaggcttgccacttgggtctgggtggaatcagaacgtgcaggtctcccaggatgtacactcactgcgccctttctgctgcttggtgttcttctggaggagcgtgagttctcagcggagcgcttctcggcacttctgatgtgcctcccatggagggagccgggcccttgctgctcaggaggtgcagactgccccgtgctctgggccttgcagctctgtcgctagacggttgttagaggggcagctctaggctggggcttgcgctgggccgtggtgggaggcacagtgtttacaggctctggtggcagagcagttggcacacctgtgggtgaatctgcctgatcccctggcatttggtcagagtacctcagagcaccccactgctcaggggctccttctggctgcagtaagctccctggatggtcacagtgccgccccatccccaggctgtgtgctcaaagcggacaaaactcaggccagagccacagctgggagacctgcactgtccctgcgaaatactaagaacacctagggtgtgctcactgtgggggccagtttctcctcggaacatgacaatgaagctcttttagagaaaagacctttgtagattcaacaattatgataggatttttacagacacctattttgggctcagttttcatcattaccattaaatgcattggatagaaggggactgttcttcacacatcatattataggaagacataattccagtgcctttatggtggagcagaattcgacaacacatgtccattcagccctctgaatggatctgagacgaagacctttttaaagatatgtctgtattgaagagaaagccagttttgagttttttacacttgcacatcattatctgtgccgtcctgactagaaggttgtctgggcccccaaattccaagtcccagtatagccagggctcccattttgtttttccagagttcgtggaggtggactgcagagcccagagcccttcatctctctgagggtcaaggataccaggggtcccaagtcacagatagacattccagtttgtattcttaggaatcattcttaggcagtgcggcagaagcaggcctctgtgaagtgtctgccgggtagaaataggccttgaagtcctggggctctccaggcagtggggttatgtgtcgactgaagggtgatgtgcagaagagcttggagagtggatcagagagactaggacagttactgcagagctcctaagtcaccactcaaccagtggctgtttcacaaggatttgagggcacttgcctgtcttgtgaggtctgtgccacaaggtgagtctgaactgactgctccagctaagtgatcaggcacgttgagagtatacggtgtcctcagcacatacacctgtgggaaaacggaccgctcttggctcctgactcccagggtacagcgcccagtaactcatccttcattcagaggtttgctggccttcccggtttcccaaggagcaagacctctgtccgccctttggcccggcctctgctctgtctcctttttttacataagaaccaatccgtgtttcacattgggctaagtggattccttatccctttgttatatatattttttgcaacttggatttccagtttgtttacagagtagtcttaggtagtagcaaaagagccaaagaagagatttgtattgctgagctcaaagccaagcagaggccggcagtggaggctgagcagggactctccaggcttctctgcccataaacacccgggtcccaggccctccttcctttccctttggtgctccctcctccccacgtaccattgcgcgtgcagctggagcagaataccctcatttttaggaatctagtgatgcctcttgcctcagggaaacgtttctttgatggggagtttgagatttcttttccttgtttatgctttatttgtggtaatgaaagagcgaatgactgaacagccatggcaaggcagacctacaggcgaggccgcagcagagggtggggcagagcagcctcggggtctgggggctgcaggggtttccctggcgcagcgaaagtctctgagcacttaccgggcgtgaccgtttcttaggtgtgagaggggctgtggcttttgtgcagcgactatgttggtgttaggggtggtgtggagattgttaatcttgtataaagcaattcaataaattgtttcaaggtttccaaaacattttttctcactcttttctttctaccatgtggaagtaagtagttcttcctgtaggagctgttacagatggaatatccattttggctgaaagccaaggggggggggcgggggagtaagccttgcatgcaaaagaagaaacatgtggaccgtacaagcagactccagccaccaggtttattttcatgctataaataaatttccctattagttcccattttcttatgttctacatgagatacagagacccagatattggcgtggtgaataatcaactgttttgtatacctaaataccagtgagataataagcgagacttgtaaagcactgaaactaaggctaacagcagcacaatccactatcaaaggatttaaatgccagaactgtgaaacattctctgtaggtgccgggacagtctggtggctgacaattaacgtccactccagcaccgagggctggacacttgtggtttctgttcacctttcctggcttggagcccagatctgtctcatgagcagagtaactactgaggaggcttctcggatggaaagttggttttaagccagaaatctggagagatgtcatgccaggcagcagcccccacgggcccaggcctttgtggggcagtgtcactgtctggtgtgccaccagtacccatgctgcaaggagtgggcttggctgctgtggttggcttgtccttcagtggttttcagattgtgtgcagttatcatgaggagtttgttgctgggagtgtacaggaaaagggaggaaaaggcatcgcagttgtccagtcattggaggatgaagtacgtcactcagggtgaatgatggttgggacgagagttgcctgtcttcagccagtgcctgtctcatatgtgggcgggactctgagcagcctggcagcgagggtatgtataaaatgcttggcctgcaccagggcaagggagaggacgacaccaaggaggtcactgcgtcgtaggagagggccagcgtctgccgttacgaagagttgcaagagctgtgcctacttctgcccagataccaagaccgccagctcctggatggacatatccttgttgacatagcggtcatactgagcaggggtcagcctgccactctgcagggcctcttcgatggagaacttcttgccagacttcctgtcgtgtatcactgaggactccccattgggacccttcactgagatctcctcccagtcgcactcctggcttctgagtttcacgaacatgttccagtcaatgagcccggcacggtgggcttcctccggggacagctcgcggcctgtgtcagggtggatgactacgatggagcgccgcaggtggttctcccgctgctcccgcttgacggccacggagcccaggcgcttctgcagctcgtcgatctcgaggtctttgtccttggagagcctcttgaggtcatccagttccctctccagggaccacagtctggagtcatggttggtcccagagtccgccacggtcatgttccgcaggtctcgtgtttccgtcgctgccatgttgatttccgattggagccttcgggtctccagctgcaggttttgcctctccagctgtaatttgtggttctcttccctcagaaagtctagttccttggatgacttggagttatggaattccagctccgaaagcctggcttccagccggctcacctcgacgtccagctcgcgcttgctgcggctctcctcctccaggctgctcttgagcctctggatctcttgctcggtgtcgcccttctccacctggacactctcggagagcaccaccttctccttgacctccgccttctccagtgcagccagtttcctccggagggtctcgagctccccctccaggagctgccgccggtgctgctcttcttccagctggagtcggagcagggcatgctctcgcgcctgctgcgggtcctgctgcagcaccaccttctgcgtatgggttaccttctcacgggcctcagcttcttcctgctccagcgctgccagccgctgctgcaaccgctgtacctcgcgctcggcctccctgcgggcctgccgctcgcgctctagctcctccagctgccgctcaagctcggtgcgccggcgctgcagccgccgcagctctgcccgcagcttgtcaatctgccgcagctccacatcgatgctctcggcaaaggcgctcgcctcggcccgcaggcctggctcctcctcatacctgaccacctcctgctgcaccaccctttccttcacccgcgagagctcctcctctttccgggcgatctgctcttcctgggaagctctttccctctccagatccacttgtttcttctgctcctctgagagctttgccctcagagacgccacctcctccttggtttgagggtcttcttggaattggaggatctcctggaccacctctttggtctggacctggggtttggtgtctttcagggcctggatttcctttttcagctggtagatctctaaatcacacctttcgatcagtctggtcttgtccacgatctcctccctgagccgctgaagctccttctccatctcagggtcagtcttgtacttaatgacttccttagtcacctctttgacttccacctgggggcctcgcctcctgagggcctccagctcactctggtagctccggagctgctcctcggcaccccggtactttcgctcctgctccacaagctccaggcggaggttcgccacttcactttccgccttggggtctggccgcacgatctcccgcaccttctcctgcaccaccactttggcgttctcctcctccaaggcccatatctttcggagcagctccgtcttctccctctggctagcgcgagccttggcagcctcgtcctcatattggcgggtgagatcgctgacctccctctcggtggccgcgtccttctccaccttgagcacctccttgacggtgatcttgccctcggccatggcccgctccttctctagcctcttgagcttgtcctggaggaagctcagctcctcctcctgcttctccctgagctggtcctggcgctggtggtcctcctgcagctgctggtactctgcctccagctgggggtcattctgcagtttcaccacctctttctctgtgaccttctcctgcgcccggctcttctcttcagccagggcggccacacgctgctgcaggaggagcacctctgcctcccgggcgcccttctgccgcctcagtgcctccagctcctcccgcagctgcaagacctcatccgcctgggccctgtcaggctcgatgcgcaggacctccttgaccacgtactcctgccccccgtctctggtctcctgctccagggcacgcagctgcagctgcagtgcctccagctcctcctgcagcagctggttcttgtgctgctcctctgccagcgtccgctgcagctgctggaagctctcctccagcacgggatccggcaccttcttgagcacctccttcctcaccaccgattcctgaggcccctgattcctcaaggtccagatttcttcctgggtgctcttgacctcgttctccagctgccgcctccgctcagtctcctcatccagttccttcctgatcttccacgcctcctccactccagagtccggcctattcctttgcagggtctcatgggtcacttctacttccggctgctgtgatggagaagacaagacaaggttaaagccaggctctggcagcacatgtagggcctgtccccacctggtcagagtggctgtcctgtggtccccaagggactccctcagtgccagttcatgttagttgtagagttctagggttactttcaaaaaggatcaaacaactagtttggggttttttttaatcaggtaaaacatttttgagctgtggaagagtttaaaatgaaaccacggtctcccacctctggtccccgtcctagggcgtgtctgtcagccttgcagatgctatctgtgctcacacaagaatatctgtctgtagtatgtaccatgtgtttatctctcctgcacaaatggtattcctgctgctcactgcacttacagagctcattccagctcagcacagagagtgctgcttcaggatttaccagcagcattgtttccgctctctggacagaccgcagtttagcccattgctgatgaagagtgaactgcttccagtgtcttgctattaaaaaacaatgctgtcatcaacatcatggacttcagaaaataacattcactttcttttgtttctttctttttttctgagacagagtctcgctctgttgcccaggctggagtgcagtggcacagtctcagctccctgcaacctccacctcctgggttcaagcaattctcctgcctcagtctcctgagtagctgggattacaagcatgcgccacgacgcccagctaatttttgtatttttagtagagacggagttttaccatgttggccaggctggtctcgaactcctgacctcaggtgatccgcctgcctcggcctcccaaagtgctgggattacaagcgtgagccaccatgcccagctgaaaatagcattcactttcagcagatgtttactgagttgaataagttctcatgtcagtagaagcattggctcgggccagtctttgcattggccctgcccagaaacgttagcaaggggacacttccatcaattcacaaaccatttctctaagacagagtctgtatttgtcacctgttagaacagcctgaagtagaatttcttactaagatcagttacctgtctgaggagattcagagcaaactccagattctgcagcctctgtctgttgatggcataaacttcagtgaacttggcggcaagtgctgcttcctgcagagaagaggattaggagagcggtcaacaaacaggtgtcaacagggtaagcaacagagagctagacagcgtggacgtggttcttgagaagtgtggaatttgggggtagaggcatagctcttgcccactcctgcctggagttagactgtagcctcaccggtggagagaaaaatggatctcgaggcagaagatccaggccagggtcttggccacactgactttgagcaagtctttctgcctcttagagcaccagtgttctctcttgtgtgtacaggagactaatatcagccctccactgtacttactgaggtgagcaaaacaggaacttcccagatccatggttctgaccctgacacttctgttcagctgcattttcaaaaatttttatttcttaaagacagaatctctttcactcagactgaagtgccatggtgtgattgtagctcactgcagccttgaactcctgggcccaagtgatcctccctcctcaacctcccaagtagctgggactacaggtttgcaccaccacgcctggctaatatttttgtagatatggggtcctgctttgttgcccaggctggtctccaacccctgggctcaagcagttctcccacctcggcctcccaaagtgctaggattacaggtgtgagccactgcgcccggccttgctgtctttctaggcatattgatgtcactgccctagaacaagttcctcatctcttaccaaacctgtttgcatgcaggagggctctcagtggcttccctgttgtgtgtgcatctctgaggccagcgtgtgacaccatgctccctggggagcagggcagcttggcctccacctcagtcccgaggccgcctggcccatggaactcacctcttccttcactttggtggcaggagattggagcctggctctcttgctcacgtggcttctccttccattctccaagtcgagaagagaccttagtttttctgcttctaactcatagtcctgcatgagggagagacatggcagaggggagattaaaacagctgagaagagacagacatgttcctgtaccccttcaggctgacccagacctgccctgtgccatgtgctggttttataatctgcgtgggtcttcctcacagctgcaccctgcagtgatttccaggaggttttgagaattactgatatctcagcagtacatagctccatcactcagtaacatatgagacaagaagtgccccctgaattcccctcccagcctttctacatgcctagagattttcacattctgctgctgcttttaacatcgtaccataaccctgtctcaccttgccaccacctcttctcatgtttaccagcttgctgactttataatccatcaggtggatgtgtgctgattcacgcagctttccccttccactggacaccagtcctttccagcgtactagttttgctattgtaaatagtgctgttgcaacaatgttgtttatcctgcatttttttttttgtactttttccttaaggataaattcccccaaagtgtttactgcttcagagtataaaacccttttacagcattccatgtctagtaccatgctgttttcccaaaagcctgtgccagtttgcacagcagccggcagtgcctcggatggccagctccacccccatgtgccagggccggtgcttgctgcttctctgaccagggcacggtggaataagacccctgctgtttgtgctttgggcggaagtttcccggctcacctttacagcttgctggtactgctgggaattggcacagatcttctgtacttcctgctccctacttgctatctcatctagcaggttctgtaagacagagtttaaaaatcaaaactaaccagaaaaaaaatttaaaaaagcaaccatggatgcagtagctggaaatctcagaatctgaatttattcttctctagcacaaagtatgatgaatggctcccttgtatacatttttattcattgcaaaaggcagtttttttgttgttgttgtttttttttttttttttttttttttttttttttgagacagtctcactgcatcgcccaggctggagtacagtggcgcgatctcagctcactgcagccttagcctcctgggttcaagcaattctcctgcctcagcctcccaagtagctgggactacaggctcctgccaccatacccagctaatttttttttgtatttttagtagagatttggtttcattatgttggccaggctggtcttgaactcctgaacttgtgatcctcctgcctcagcctcccaaaatgccgggattacaggtgtgagccaccgcgcccagccacaaaaggcagttctaaggctctgtgaagaagggccaagatcattatctctgctaggaaacaaatgtttactgatgatttggaccaccagacactgttctgctgtctgacttagattatctcatttaatcttcaaacgatgccaggaggtaagcatcgtgacctccagcttatgagtgaggaaagcttctgaggtggggatgtggctgatggggtggacccgggatttgcatctcagccattggcttcccgtgttcctccctcaccccaaggcactgcgttgggcatgggggaggcaggagtcccaactttgaaaatgggatttcccccacaaaggcggctcctcattctgtagctgttcactcacatagccaacccacgccaagtgtccattctgcaccaggccctgtgcggggcactgagctgggagaggtgagcgacacactcggttcttgttctcagagggttgggtgttgggagcttgagctgaggcccagggaggacacagctgtggcaggcctctgccctgctccacctcccaaaggcttggctccccagaaaggggcttgttgacctctgaccctcccttgccagtgtgtgcctggggctgcggaaacggccatctcaccttctggttcttcagcttggtctccatctggctgaggctgtctgtctcctggggctcgtaactggggatgctgactaggaactgcagcacgtggtcatggccgcggtggaagtgctcgtaggctgccttggcgctctgtaggctctgcgccctgtcaaggcaaagcgttcaggcctcagccacagcaaacagatgcctcaccgagccctcatttttttttttaaagtgggaaacaaccaaatgtaacaaccagaaataccccaagtatctcccacacagggtgggtggtcattagggaacgtcaggttggactgtggagaaccaggtgggtccatatacattgacttgcagagatgcccattgtggattacaggacccaggtaagcatgactcaaaagagagaccacagggccgtcagagaatctgacgaactcaccaaaaagaaaaacagcaaaatctgtgggacacggctaaagcattgcttagagggaattagatcgcattctcagaaaacaaaaatggccaccacccaccgcaccctcacctgcgttccacctgctggcgcaggttgttgaaacgctggcccagcttgtgcacctcggcctcctggcgctccaggtccggacagtgctcctggaagcggctggccagtgtgctcgagcactgcttggccgcctgcaagttctgctccacctcacccaggagggacttctgggcctgtaactcacaggccatggcctggcggggcagaggaggagacggcggtgctacggccagagctcccagagccaggcgatgacacccactgaagcccctgggccactgactgtaggagggtgggcaaggccacaggtaggaaggaccggagccttgctctgtacatcccaaacctgggtcacttctgccatcttctgttttttaacaatgaacaaagccctgaaaagctaacttctaaaaaccctgcagcaggcagctcgtgccctgcgcgagaacagcctgccactgtctggtcatgaggctgtggcaaaagcaagtcgtgagatgggagtgtgaataaggggcctcaggtcacagacttgaatgtttcctgtgctcaggcagtgtgggaagggggcccgtggcaactgcgaggtaagcaggccgagaaggcagctgctcctctgcccactgacttgccctctgagctgcagcccaggatgccagctctgctcagcaagagatactgggaacatggattgttatgtgctttatgcttttttttttttttttttttttttaagagatagggtcttgcaacgttgtccaggcggctggacttaaactccaaggctcaagcaatcctgccccagcctcctgaatggctggtgttacaggcatgtgccactacactggctattgcagatatttgatcttaaaatgctggcacccgaaatcccgtaagtcacacagatcccgtgaatagcttggatttgtgctgtgggcctccatttgcagttcccaatttgggcattccaaacctggggagactggatgctggtgtcctcatctatccagacgggcgggtggatgtgccagatgctctcacctgctcagagaaggactcccaggacttgggccctagactcaccgccagctcctgccccttgctgtccaggacacggctgctctcaggcactgtgtcatcctgattcagatggttctcgtgtgtggccagcaactcccagctctgctgcaggctcttctccaggcggttggccacatcaaccctgagagcaccaatcaggcgtcgggggatgcccacctggccccctgaccccaccccaacctccatgctgcctgtctgccacccacttctcctgggccaagtccagcagctgcaggaggtgctcgtatttccggttggtgtcctccacccgggtcctcagcaggggtgtggtgccactgcctgggagggcctggatgaaggcttcgccctcagccgtgctccgcgtcttctcaggttcaatccgcagtagctcgttggtgatgttctgtgggaaccagggcccctcagttttggacacagccaggcagccccttcccctgaggatgtgcccagggtgagcacagattcccacatcaggcacagtggaagcagctggagaggcctggcacattctggggctctgacccggcatctggaccccagcctgagggctgtatttttcacgagcatcccagggaaccgctgaggtggaatggactagtgacaccagaagcacccaggcagctgccgggcctgtgctgtcctcagcactgcacgcggacgcttctgtttaatctttgcggcaaccccgggaggtgagtactacgactccacccagtcacgggtgggggtgtgacgactcccagcagcttaggaagggacttgtggggtcaggctacacccgagaccggcatcctctcgccctgacttggctctcactctgaggccccatcaggggctatggcacttctccaatcccagatcctcttctgtaaaattggagtgctactcactgcctcagagggctgccttgaggatgtgggagactttgtataggaaaggaggtggggggaggtggcccctccacgtcccccctggcatcagctcaccctgtcctcgccactgccctgtgagcagggccaacccatcctactgaagacactgaggcctggagtttataaatacaaacgctaacgtgtttgcagtcaagccagccggtgacccagtcctgcggaattccacagcccatgtgccatgccaggcgtcagatcgacaagccgtgcaggaacaatgcaagtcctgccagctctttctcctggggaggtaatgacagcagccctgccacctccatgacttgggacccttttacatgcagcaggctgtccctgacagacagctgcagtgaatatcccaagactccatggggaaaagacctcaaataggggccccagggggccagtgcagggctcccccggccccacctgtgctcctgacccgcaggtaccttgaggtccttggcccgctcggcactgtcctgcacagcccggccttgctccagtggtggccgcaggatccctgtgatggccttctcctgccggtccaggtcgctggccaccttgtccaagccagccagcagctgccgcccctgtaggtcagaggcatctgtggagggagggaggacacaggcaggtgtgacaacgggccaggggtgtgaggcccagggatggacctaggcagccagccccccgccgtctcatccacagcacagaccctggtccagcccctcctccccggtacccccagagcctcaggcgagtggccctggcacccacctccgggattctcggtcttcagcacctcataccgctgctgcagcgtgcgtttgctcccagctgccttctgccgcacgctccggtactggctgcccaggctgtgaggacagaaatgagctgggaacctgggcagcccaccaccccctgcacccacagaggcgggactgcggactctggctgggcagacaccccagaggagcctgacagctccttagatgcggacagcaagtgctcactgtggcactggcctttctgtgctcctgggctcagagctcttctccctccttccctcctctttcgtaggaagtctcactacctaaaattgtctgtccaataatcaccaccaagatgttacttctgagggagcatacacagtaggtgctcaataaatacttaataaatgaaggcattccttgaatgatccactcattcagcaaggagttcctgggcacctactttgtaccaggtacttaactaggccctggagagaggaaattcaaggagcccaggcccaatgagactgacgcatacgctagtcacttaataaaaagcggtgcgtgcagtggaagaaggtgcctgggagcaaagaggaggcagcccttatcccagctgagtcctccagccaaggggctggggtctgcaagtacagggagcagtgcgtgcgggagtcaggggcccttagaaactgcttagaaactcgtgagggggccaggacgaagcccagagctagacattcatgtttagcaagtcagctggcccacaatctgcccctctcctgcatgaacttccaagggggtgcagatggagagtgtcagcgaccccgcgctccccacaggctgagtccaaatccccggggctatgaatggggcctgagaagccctgggggtgggactggtccatgcagactcccgcctttgcccttgtacctgtcagccagagccagggcctcagggtctgtgggggggatcacaaaacacacggccggagcaatcagcttgttcccagcgctgtccatgagctcccagctctccccgttgttcttctgcagggtgtagctgtagccccgcgagatcaggccctggcgggggcaggctggacagtcaggatcccggcagggcctgagggcctgggagcccggttgccatctcagcccccgactcttggacctggggagccccggctcatcacttggaccctccccgtagagtggggaggggcatgcaggagaagcacatgtgttgaggctgccggcccagcaacccacctccatttccctttggggaaccttccctcccaattcccagtccctgtggtctctccttctccattcccaagctccagatggacatgtgacttggacctggccaatgactggcattcgccagccacagtcattggtatagggtggaccctggcattccctggccacagtgattggtgtaggatggacacgtgactcacagtgagccaatgagaacctggcctgggacttctgaggagggactggggttgctaagctggtggaacacaaggccagggcagccgaggtgggggcggcataggggtgccagttggcctgcaccaggggaagggttggcagagtgacaccaaccacggagacaggcacaggctcctgagaacggcgcctgaggcccgggatccaaccatgttaccccaaaaactttgtagtgatgtgaacagaggagctggccccacgcacctgctccccctcaaagtcacagagtgcctccacggggatgggcttgagcggagtctcccggcggtacttgaggggcaccacctgctggcctcgcttctgcagcccctgcaccacgtcctcatacttgtccagcaccttctcctggtcctggagagaacggggtcaggggcccaggtgagaccaacagccttccccctggtgggaggacgcagagcaggggctggattcagcaggtggggtgctgtggaggggcctgtacagggctgagggcaggcatggtgtagaggggtcccccgccccccgggccagcaggggtcctgggccatcgctcacatccagctcccgcagcagcagctcaatctggtaccggtccttgaagtcagggccatacttctggttcaggtccgagtccaccttgcgcagcagctcctgagcgtccttcacgtcttcgtgaaactaggggagaaggtggctctgttacagccaggaaaccactagaagcacctgggcttctgtcggaggcttcaagctcatccctcaggcggggctgggcctccggttcacctggagtccagcatgggaccctgtgctgagcctgaggctcctctgcgtggagacagccccaccctccctgagctggctccttaggggcctcactgggaaaagccaggtcccttcccacccatccatgagatgccacctctgtgacatgttttcttggatgtatcagtaagtcttgaggtgtctttgattcagttcctctctctgtactaggaacatccagacttaatactatagcttctttctaggttttgataatagcctcccctttttgttctcgaaaattctcttgcccattcttcagtctatcaactcttggttcactgtcagctatcccctgggctgagcacctgggctgcagccataaacaggacctgaagcccccactgtgcggctcagacagggaatgaggagtgacacggcgtcgcccacatccagctttccccagacacctcaatcctaagaattacccgcagcttcttaagaactctcattcctctggaaacagacaagtgtccagccacagatgagtggataaacacagtggtctagccatacaataggatatgattcagccataaaaaggggtgaagcactgaaaatgctacaacacggatgaacccggaaaacatgatgctcagtgagagaagccagacacaaaagggcagagattgcatgatcccactgattcttcatattcgttctaggtgtgacacttctggaacaggcaagtccatagagacagcaagaagaccaaaggtgacctggggctgggggagtgggaatggaaaacttactgcctaatgagtacggggttgttttttttttttttttttgaggcggagactcactctgtcgcccaggctggagtgcaatggcgcgatctcagctcactgcaacctctgcctcctgggttcaagcagttctcctgcctcagcctcccatctgggactacagatatgggccaccacacctggctaacttttgtattttagtagagatggggtttcatcatgttggccaggctggtcttgaactcctgacctcaggtgatccagtcgcctcggcttcccagagtgctggaattacagacatgagctaccgtgcccagccagggtatagggtttctgtttggggtgatggaaagttttgcaagtagatggtggtgatggttgcataacattgcgaatgcaatgaatgccactgaattgtacacttaaaaatgcaaactggccgggtgtggtggctcacacctgtaatcccaacactttaggaggccgaggcgggaggatcacctgaggtcaggagttcgagaccagcctgaccaacatggcgaaaccccatctttactgaaaatacaaaaattagctgggtgtggtggtgggcacttgtaatcccagctgttcaggaggctgaggcaggagaatcacttgaacccaggaggtggaggttgtagtgagccgagatggcacgactgcactccagcctgggtgacagggcaagactctctcaaaaaaaaaaaaaaaaaaaaaaaaggcaaattttgttttatgtatctgcatgtatattatagattttaccaaaattaaaaccctacacactcaccctgggccccatgtgacctggggaatcagactctggccctggtccccagggaagttggacaggggccggcaagcttgggacatgtctgcacacgccatcagaagcatgggtgctgggggcctgggatggctgccccgcaaggctcctggaccaaggagcacgaggccacacatgagccaggtaggcactgagcgctctcagagagtagcacccccggtgctggggggactcccaggaaaggtaagtacctggtggtagtcctccatgtacttgaggtggctctcctcgcagatgagcaggttcaggtactccttccagtctgcgtgcacagcctccatgtgcgcctgccaggaagagaaggggccggtcaccactgggcaggtactgcagacaccaagggagggactgctgggatattgggctggggcatggcgggggagggaggcatctggcatctgtctgggtgtggctaccacaggggtagccagcttctgctcaggagtgggaggaggagagaggggtcacgtcaaggagccaaacagggatgccacatacggatgcccaggctgtgcagtgcacaaagggcaagtgggggctgtggtgccttcggcaaatctgtacaaaggcactgtcatggaccgaacagtgtcccaccaaatccatgaccctggccaggcatggtggctcacacctgtaatcgcagcactttgggaggccgaggcgggtggatcacctgaggtcaggagtttgagactagcctggcccacatgatgagaccctgtctctactaaaaatacaaaaattagctgggcatgatggtgtgcgcctgtagtcccagctacttgggaggctgaggcaggagaattgcttgaacccgggaggtggaggttgcagtgagccaagattacaccatcgcactccagcctgggcaacaacagcgaaactccatctcaggcggggttggtggcattgtgggggttgggaagaatgcgaccttatttgggaataagatctttgcagatgtcattagttaaggatcctgaaattagggtgagccctaaatccactgactgatatccttataagaagagaggatacagagagacatggggagagaaggccatgtgaagacggaggaagggactggaatgatgcagccacaagccaagggctgttggcaacccccagaagccggaagagcaaggaaggcacatgtcctggagcttccagagggaatgaggccctaagacaccttgatttcagacttacagcccacagacctctgagagaatgaatttctgttgtttaaagccactaagtttgttttaacttgttgcagcaactctaggaaactaatacagaccccacaggggcttcagaagtccaggggctgagggcagaagtgtcaacggatcaggataaatggaggaggcagagtcagacacagcaagaaagagacagacagacacaagatgcagcttgcaggacccccagctccggggtctgcccgagctccaggcggcccacaggcagcggccaaccagaagccaccctgggggaggtgtctggtctcggggtgcatgaacctcaatggagttcctcccggggtgctcggccgccagcagctggtcgccctcgctgtgcagtttgttgattctctcctctttggcctccaggttccggttgatgaaattctgcagtggggggcagtggaggggcctcagtgcccagcctggcggtcccgtgctccttccagggctgcctcctccctgatgccccaggcccccagaacccacctcatactggcgccggcggctggggtagtcgaggttgcggtcactccagtcgtactgcatgcggcccttggcctgctggtccagccagtacagctcattggtgcagcgctgcatgtagtcctgcagcgaactcaggtgctgctgccgggcctgtgatgctgcctgaaggggccggggcaaggaaagggctgcgtcctcagcccgctgccactgctcgcttccttccctacctcctgcagggcccagctatggctggcctgaggacaagcccagctatgggtggcctgaggacaagcccagcttagccacgtccaggccagtcccccttagacaagtcacctgaacccctgaaactcattcattcattcattcattcattcagtaaatgtttactgagcatctactacatgctggacatggctccagacactggggatacagcaaacgaaacacacaaaacccttacggaactgacatttttgtgaaggcttagttcgcccatctgtaaatggggaagatgacagtcctgacctcacagcgtacagagactggcatatagttggtgctcaacaaatatcagtaactatagcttctacttttatctgtatcatgatcgtcttatagagggctggaaggaaagcaccactgtacgtctgagaagcgggtgtgcaagggaaaggagggatgtttgcattttggtacgtggggccctccacgcctgatgaacttctgcaacattgactcatttcatcctcaaagcgaccctatgagacaggaacatgtaggagctccatttctcagatgaggaaactgaggctcccggaggctaagtaactcgctcaaggtgtcaccactaacactaaggagcagaggaagcatggctccttatagcgacacaatgctgcctctgtattctctgtctgaaacattggcaacaaggaagcgtttgcataacacttatgcaatttttaaaagaatgcattctttaaaggtttgggaaggaaaatggaaagcttttgtatagaaagcaagtggcatcatacttggcacacagcagataataaagaaatgagcaggacaggctgtacccctggggcctgttagggttttccctgaacaaccagggcagaccttgcagccgctcaggaaaaggctggggcacctctcttcccgcctcaacccctctcctgattgaaacgtttactgcacgccttttttttttttttttttttttaaaggcagggttttgctctgtttcccaggctggagtggagtggcacgatcacagctcattgcagcctccacctcctgggctcaagcgatcctcccacttcagcctcccaagtagctgggaccacaggcatgccaccaagcccagctaatttttaaatgttttgtagagctggagtctcactatgttgcccaggttggtctcaaactcgtgggctcaagtgatcctcctgcctctgcctcccaaagtgctaggcgtgagccaccatgcccagctgcctatgtcatttttaaaacaatacatccttgtccccccgactccaagcttcccatcctctcctctccccatgaggcctttcccccagggagctcctcaccagcagtttctggtacttggcccggagttcgctgttctgctcctgaggacagagccgagggcatgggtcagggccaggaagcaggcgcggccccctccatccctgggtccccaccacaccagcacacgccccaccttgtccccgtccttggccaggtggggcccgatggccttgacctcattgtggaagatgttatgctcctccacttggtggtccaccagcggcaggtcagtcccaaagctctggttgttcagcttgtcctggccaggagggcagagaagcaataaggagagggtgggctgagggctggggacgtgtggccaccccaggagcctcgggggtgggcatgatggtgctctctttttcacggggccctgcagagccacaaggagatgctggccacaccttcaaccctgaggttctgtttgctgagcactgacctatatcatctttcatctcacagagcctcaggggtccacatggttactgtcccatctctcagatgaggacacagaggctgaggctgaatgagggccagtcacctgcccagggtcacgccagtaacattgggaaagctggccaggcatggtgactgatgcctgtcatccaggcactttgggaggccaatggggtcggatcgcttgagcccaggagtttgagaccagcctggccaatgtagcaaagccccatctctacaaaaatacaaaaaattagccaggtgtggtggcatgcacctgtaatcccagctacttgagaggctgaggtgggaggatcacctaagcctgggaagttgaggctgcagtgagccgtgatcatgccactgcattccagcctgggagacagagtgagaccttgtgtcaaaaataaataaataaataaataataaaactggggaagctcaggagtttgagaccagcctggccaatgtggcaaagccccgtctctataaaaatacaaaatattagccaggtatgatggcgtgcacctgtaattccagctacttgggaggctgaggtgggaggatcacctaagcctgggaagttgacgctgcagtgagccatgatcatgccactgcactctagtctgcgcgacagagtgagaccttgtctcaaaaataaataaataaataaataaataaataaataaataaaactggggaagctaaggcttgaacccgggacacctagctgcagtggctgtgtgcttctctgtggtgagcacccaggaaagggagcgacaggccagaagcctggccgcttccgccccagcctgcccacaaaatgtcaccaagaccccaacatgccagggttggaaagtgggacccaggagcagcagcgaggtgtggctgacaggggacagagtccgaatctccaccgcttgagctgtgtgaccctgacttcgtgctgcacttctctgagcctcactcttctcatgggcacactggaaaaccatcaggaccacgactgtctccctggtaagacccgggatgcccattacatgggtaggctctccctgcacacgcacagccccctccccagctgaaaccctggagccagcggccccgtccaggccataccagcttctcctccaccagtgccgcccagttgacctgtggatccacttccttcaccgccagcctgtagatctgcttgtgtttcccgcgcaggttggtcacacgctccttcagctggcggatactgatgggagagaggctcccacttagtggggctggttggcactgcctgcaccccaggaggggccccccacccagaccccggcctcagtgtcctggaaggacacagtgaccatatggccttgggttccagacaatcacagcatcctctcacccctcctcccatgcactttttttttttttttgagacagagtcttgctctgtcacccaggctggagtacagtgacgtcatctcagctcatggcagcctccgcctcccaggttcaagcaattctcctgcctcaacctcccgagtagctgggattacaggcatgtgccacctcgcctgggtaattttgtattttcagtagagacggggtttcaccatgttggtcaggctggtctcgaactcctgacctcaggtgatccgtccgcttcggcctcccgaagtgctgggatcacaggcgtgagccaccgtgcctggccccacccactttccctcaaccttccttcccccatcagtttcctgagggcctactatgtgccagaatgatagaaagttctggaataagcaggaaagatcttgttttctggagtctgccatccagcagggcccacagtgtggtgcatgccatgccaaggacaagtgccaagggtcgtggggcaccgagagagccctgcccttgccggggtggagatagggcatgggacaaggcaggagtcaggggggctgattcatccacgataaaatgaactgggagtcgtgagccaaggaagccagggacagggcaccaggcagcggaagagctcgctcaaaagctcacaggtcaggctggtggctccagaacaagggatatcaactccctaagcctccatttccccaactgcaaaatagggtcatcaagaggatcatgtgaggctgggcgcggtggctcacatgtgtaatcccagcactttgtgtaatcccagcactttgggaggtcgaggcaggcggatcacctaaggtctggagtttgagaccagcctggccaacatggagaaaccctgtctctactaaaaatacaaaaattagccgggcatggtggtgcatgcctgtaattccagctacttgggaggctgaggcatgagaatagcttgaactggggaggcagagattgcgctgagccaagatcatgccattgcactccagcctgggcaacaagagcaaaactacgtctcaaaaaaaaaaaaaagaaaggatcatgtgaagcctttggcacgtgcctggcacctaattagcccttgataacccctgactcgggctcccaaatgctgaacaggaccccccgccctggcccatagcccccaatggctcccctggggtaagaagcagaagggacctactcctcggcgatcatgtccccctgtgggtgcttcatgtgcttggcaatggccgcatccgcctctagcacatagagcagcttctcagagtccaacaccttctgcagggtcacgtcccggtgctcaggctgccgaccctcctgcagccgagccaggtcctgtgagggtcacaagagaggggacaatgaacaggagccgagagcgggcacggtggcaatgggaggggtgggaggaaaggggtcagcagggtgctccccttctttccctttgaataacgtcttccaggcttgtccatatggagcgcagtcggtagttccatctctttgctgctacgtggtatttctcaagttcactttgcaaagcaggtatttctcttatgccccctccagcctgtcctccagccactcagcaaacagagctcaagtacctactgtatgcaaggagttgggacacagctgtgaacagaagagacatggcctccctgcctggcactcacaacccagtctgcaaggccaccaggaaggccagtcaaaggatgagcctcatggaggtgactgcaagtccctccaagtcagtgtttatgaaagaaatgctccagaggtggaacgaggggacctacttcagctctggtggtcagggaagcctcttcgtggtggagacacaagctaagaacaaaggatgaaagggacagtgttccagccacaggaacagcctgtgcaaaggtcctgaggcaggagagagcgagctacgactgggccatagtgaaaaggtctctgtggatagggaggaaacagggcaggcggggggcggggagggtgagcagctagaacacacaatggctgcaaggagggatcctgcacagctccatttgtgcttaaaggcgatgcctccaggggctctgcagagaggacagcaagggtgtgggctgggagggcaggcagtggtctgtggcagcagccaggtgacagcgaggtggcaccagcaagaaggaacagagccggggggatatctggaaggggccgtcgatggttgctgatgagtacagggcttctgttcgtttagggaagagcaatgaatggcagccgggacagtaggtttctaatcacagcgggttaattcactgtgtcaatattcaagaagtctggctgtgagtctacaccatgctaggtcctggggatgaatccctgagggatccccagtcccgcaggggaggcagtgacatgtcactgaggggaatgagtgcaggttggctgacgctggggcactcagagccggccgccggtcccttcccctagctgggtctcagcattcccatctctataatgggcataaggaaaatacccgcttatgaagtgaactgagaaataccacttagcaacaaagagcaggaactacggaccgtgctccatctgaacaagcctggaagacgttattcaaaggcaaagaagccagacagagcccacatggtgtgggatccattgatgtgaagtgtcccgaacaggcaagtccagagagatggaaagtcactgtctcttaagtggttgcctggggcagggctgggaagaggcattaacagtaaataggcacaagagatcttgcacgggatgaaaatattctgaaactgattcatgggcgtggttctgccccttgctaaagttactcaaaatcattgacttgtacacttgcagtgggagccttttttaagtgaaatatgtctccatacagttgttttttaaaaagaaaaagcaaaaggaagaaaaacgagaaatacacaggggtgacgtggtgcctggtacgaagtaaagacttggcttcttcttggaggaagaaaatgtgtcaagagtgcctttgcctggctaagtctggaagggctgaagggtgaacaggcctgactccccagggggttggagatgaggctgatgtcccgaaaagccgctggaggccaggcacagtggctcatatctgtaatcttaacactttggggggctgtggcaggaggatggcttgagcccaggagtgcaagaccagcctgggcaatatagtgagaccccatttattaaaaaatatttttaaaaggtagctgggtgtgatggcatgcacctatagtcctagctactcaggacgctggggcaggagaatcatttgagtccaggagttcaaggctgcaatgagctaagattgcaccactgcactccagccttggcgacagagcgagaccctacctcaaaccaaccaatccaaaaagccaatggaaccaggcatcccccaaccctggggtaggctggcccgttaattacaacaaaacatcagcttcttgacttggagtggaatttttaaattttttttgtttttttatttttgagatggagtctcactctgttgcccaggctggagtgcagtggcacgatctcggctcactgcaagctctgcctcccggattcacaccattatcctgcctcagcctcccaagtaactgggactgcaggcgcccaccaccatgcctggataatttttttgtatttttagtagagacggggtttcaccgtgttagccaggatggtctcgatctcctgacctcgtgatccacccgcctcggcctcccaaagttctgggattacaggcgtgagccaccgcgcccggcctgcttggagtagaattttattcactccattatcaccagcttccctgagctgcagatcaaagattaattttgcaaaaggaggaagtccattaatcattgcctaattcgtgaaggtgcccggtgggaatgcaagttctctcaaaacactggctgagagagaaagagaacatctagctgagggaggctagtgttcgaaagttcaaagtcgggcagaactgatcgatggtgagagagatcagcatagggttgacccctgagggatatcaactagggagatggcccgggagctttctagacagttacccatcttgccacagacagtggttatctgggtacctattgatgcaaaaattcacccaggtgaagtctgcgaatgtagacacttctctagagtttatataagttataccttgataaaaaagttttttaaagtcacaggggccaggtgcagtggctcacgcctataatcccagcactctgcgaggcccaggcgggaggattgcttgagctcaggagttggagaccagcccgggcaatatagtgagaccctatctctaaaaaaaaaaaaaaaaaaaaaaaaatacaaaaatgagccaggcatagtagcatgcgcctgtagtcccagctacttgggaggttgaggtgggaggattgcttgagcccaggaggttgaggcttcagtgagtcgtgattgcgccactgcactccagcctgggtgacagagcaagaccctgtctcaataaaaaataaaaataaaaaattatagggactgatatatctaatctcacacacacacacacacacacacacacacacacacacacacacacacggacagatacatgataaagccaattcagcagacgttccttgtaggatcaggtggtgggatatgggtgttcgctgtacggttttctgcatgtttagcatttgaataaatgtgtgatgcagtgtatgattctgtttatgtgaaatatccagaataaataaatccacagagagaaagcagattagttgctgccagggggaaaggggaggtggggagtaactgttaagggtgtggggtttggctctggggtaagggaaatgtttgggaactagatcgaggagatggttgtgtaacattgtgaatgtatgaaatgccactgacttgtacacattacatggttaattttatgttatgtgaatctcccctcaattaaaaaaaatggaaaattcaacagaactgggaaatgaaataaatagtagtatctttagcaaaaagaacataagaaaaagattgtgtgatccatgtagtcttcaaagcctagcttcttttttcaagtgggttcagttgaagttaaaaaaataggccgggtgcagtggctcacacctgtaatcccagcactttgggaggccgaggtgggcagatcacaaggtcaggagtttgagaccagcctggccaatgtgatgaaaccccatctctactgaaaataaataaataaataaattagctgggcgtggtggtgcctgcctgtggtcccagctacttgggaggctgaggcagaagaatcacttgaacccgggaggtggaggttgcagtgagccgagatagcaccactgcactccagcctggacaacagagtgagagactgtctccaaaaaaaaaaaaaaaaaaagaaagaaagaaagaaaaaattgttcaggccaagcacacagtggctcatgcctgtaaatcccagcactttgggaagctgaggcaggaggatggcttgaggccaggagttcaagaccagcctggacaacatagcaaggacctctgtctctgcaaaaaaataaaataaaaatggttcaaaattacctattttgagtcaatacttcagggaaataaaatgagaaggttaaaccctcttccttctttctctctctctctctctctctctcacacacatacacaaaggtcaaacagatatacaccaatatgttaatagtcagtagatacctctggtggtggaattctacatgactgactttattgattgattgattgattgaggcagggtgtccctctgctgcccaggctggagtgcagtggtgtcatctctgctcactgcagcctcaaccttccgggcttaagcgagcctcccacctcagcctcccaaggagctgggattacaggcacacacaccaccacacctggcaaatttttcatattttttgtagagacgaggtttcaccatgttgctcaggcttgtctgaaactcctgggctcaggtgatctgcctgcctaggcctcccaaagtgctgagattacaggcgcgagccaccgcacccggctcatgattttaattcactttgttatgcttgtttatccatcgtgaaatgtgtgtgatgaacacatattatttttgttatgaggaaaaaagagacacacccccaaaagatgttttccatttaagaaggaaagaaatccaccaccacagggggcctcagatggcagaggatgtaactgcaaatgacaaggggagctgatgggagggaacaggtgtggggtggccaggcagaggccagggaggcaggaggtggaggcccaggggggcatggaggcgggggccccaggcaggaggccagggcaaggcccactcctggggcccctgcaggggatagctggtggcagagaacagagtctccacttatctgccccctacacccccgtggactgtgcccaccccagcccacctacccgcttgggtctcttggctgctgtggacaggccttcagagggtgggcaactgggccatcaggagcagccaagggggttggatacctatggctgggcctggggacagcagcttggccgggtagaccttgacctccctcctgacctccccaccctcagcctcccactcctctggtcccaccttttttttttttttttttttttgagacagtcttactctgttgcccaggctggagcgcagtggcacgatcttggctcactgcaacctccgcctcccgggttcaagcgattctcctgcctcagcctcctgagtagctgggattataggtgtgcaccaccacgcccagctaattgttgtatttttagtagagatgaggtttcaccacattggccagtctggtctcaaactcccgacctcaagtgatctacccacctcggcctcccaaagtactgggattacggccgtgtgagccattacgcacctggcctggtcccacttcttagtcgcccctgcatagggatgccagatgaaatacagatcaccacttacacttgattttcagataaacaataaataatgttttagcataagcctttccctaataacacatgggctttcctgctactaaaacatgatttgtgttctgaaattcaaatgtaactgggcatctcatattttatttgctaaatctggtaactccacctgcaggccgatgctggcaccatctctgtcactgactcatcatcccagccccttctaaacctcagttgctccagggtacaaaacaggcatcaacccaatcgcaccgggctggcgctggtggaaggtttaaagagaaggtgaccattccagcggctcgtgagtccctcagggtacagaggcttcatgccgttgagtccactgggcagttgttatccccatgttacagaaagggaaactgaggcacagataggggaaagtgatttgcccagctattttatctctcttctccaaaaaaggtggagaaagacctgcaccctgagtgctggcagcagtaggatgagcagtgagaatgatattgacgataatagccctgtcctatacctgcataatctcatttaatctttacaaccaccccgccaaatgggaaccatcactcctgcctgcttagagagaatctcgttcatggggaggtgggatggctcacttgtccaaggtcacccagcaaggacaaggctgggctgtttccatagagcctgaccccatggcactcctccaggcaggagacgctttccacagggcccaggaagagggaggaacttagtatccgggaggtactagtattaacgacaatggccaggttcctctcacagagcagggcttcctgaccttggcacccctgccctacagtgcacggtagggtgttcagcagcatccctgtctcccctccccaactggacgccaggaggaccttccttccaagcagtgacaaccaaaatgtctctgcatgttccctcggggccacaatcacccctgggtgagaatcaccgattccaaacagatcctggtcctgaacagggctggcagcacggggcacccaggtgggagtgggagtgggggcactcacactctgcatcttggcctctgtgtccacgatgttcttctccacctggtcggcattcttctgcagctgctcgatcagctccgagagctccttgttagagatgctgcgggcagaagccgaggggagatgggcggggtgcctggtgggtgggggctatgtccccaccagcaccccatcctctggctggccccggccccacgctctgagcaggagctgcccacagagcctttgaggtagttgggctgttcccatagggcaacatcactaaagccacagagacaaggcagcgcctggcaggcggtcagcctcctttttttttttttttttttttttgagatggagtcttgctctgtcacccaggctaaagtgcagtggcgtgatctcagcttactgcaacctccacttcctgggttcaaatgattctcatgcctcagcctccccagtagctgagattacaagcatgcaccaccaagcctggctaatttttgtatttttagtggagatggggttccaccatgttggccaggctggtcttgaactcctgacctcaagtgatccacctatcttggcctcccaaagtgctgggattacaggcgtgagccaccgcgcccgcccagcctccactttgatcattctctctaatgcttctattttttatttttattcattcattcgttcattcattcattcattcattcattttattgagacggagtctcacactcttgcccaggctggggtgtagcggcacagtcatggctcactgcagcctctatctcccaggctcaagcaatcctcctagcccagcctcccaagtagctgggactacaggcacatgccaccactcctgcataacttttacatttcttttggtagagaaggggtttcaccatgtcacccaggctggtctcgaactcctgagctcaagcaattcgtccaccttggactcccaaagtgctgggattacagatgtcagccaccaggccccgactacatatttttttgtgagagatagggtctcactctgtcacccagactggagtgcagtggcgtgatcatagttcactatagcctcgaactcctgagctcaagcaatcctcctacctccacctcctgagtagctgggaccactggcaccaccagcacacccagcttctaatgcttctattttgccatgttggcaaaacgcaccatatttgaaaaattgggagataactcacataccgtaaaattcacctgtttaaaatacacagtcactggcttttagtactacacattcagaatcgtgcaaccatcaccactatctcattccagacatttttatcaccccaaagctccacacccacaagctgtcactccctattccccacccgctccagcccctggcaaccaggaatttactttttctctctatggatttgcctattctggacatttcatataaatagaatcacacaacacgtggccttttgcgtctgccttctctcagcataatgttttcaagctttgtgcatattgcagcatctattagaacttcattctttttatggctgaataatattccatcacgtggctacttcacattttgcttattcattcaacagctgacaaccatctgggccgtttccacctttgggccatcgtgagaatcacgctgctatgaacgttcgggaacaagcttttgtgtgagcagtcttatttttaattacctgatatttttctttcaacctactcgttttattttagagttaaatgtgtttacaaaggtaacttctctccccattttaatcagaaatcagaagccctcaccatgagtgaattagctgccaaaataaatttcatgggaacgcagtggcactgggttccgtggtgacactgggctgcccgctgttacaagtcaggaggtgtgacagccgtggtggcgtcaggcccagcctttctcctgatcttctcagagcgcctgaaagagacttgaggcccggtgtggtggctcatacctgtaatcccagcactttgggaggccaaggcgggcgaatcacctgagatcaggagtttgagaccagcctggccaacatggtgaaaccccatctctactaaaaatacaaaaattagctaggtgtggtggcatgcgcctgtagtcccagctactcgggaggctgaggcaggagaactgcttgaacctgggaggtggaggtggcagtgagctgagattgcaccactgcactccagcctgggtaacagagcgagactccatctcgaaaaaaaaaaacaagaaaagaaaaaaaagtcttgaaagcagactggccctctccctcactgtctctgtgtcccctcctgtcacatttgtctactgccccccgtcccccagaaccacagacagaccactctggaaaatgctctaatgggagttagttaagactttggccctggggttagctgtgggttcagatcttggctcccatcagccacttagtggctgtgtgacttggcccagctcccttgcctatctgtgcctctgtctcccaatccgatggactagagtaacagtcctttcccggggccagggtggcaggggttatgaatggaagtgaggttacactaccaaaggactgtgcatagagccgggcacagaataagtctgaacaaaggtttgtgattttagttgtcaaggagccttagagatcacccagctctgcctctgtggttttgagaccgagtctcactctgtcacccaggctggaagtgcagtggtatcatcttggctcgctgcaacctccacttcttggggtcaagtgattcggctgcctcagccttttgagtagctgggattacaggtgtgagccaccatgcccagcctccttctgttgttttctttaaacaaagaaagaaagggaaaccaacttggccattgtcacccagttagccagcgatgatagctcccctgtctccactgaagacccacagtggggcctgagtggctaggcacgcagaagttgccttctactcacactcattaagcacctgctgtgtgcgggccctgcacctcacaaagacaagcctctccctccctgatccaccccacagaccaggaggaaatcagtatttatagaaacagtcacgagactgaggcaggcctggaggctggggatgcccaggggaacctctggactggctgggtggggacagcggtggtcactgaaggcttcctggaggaggtggtgtcggctgggtgctaaagcaaaaggaagaatttggtgttcctgtgcagaaggctccaatgaggacacgccatagagagaggcaggtcctggcacgtcccgtggggtgggccagggcggggttcttgaccgtcaaggcagaggggaccaccagccctttcgagtgatgctccccagatcaaggttctggggcctagcatgaaaaattcagattcccggccactaacccagacctgctgaacccaggtctccagagctgggcccaggaagctgtattattattactatttttgcaggttccccagggtacctggacacctaccggagtcatggaccagcaatgcaggtgctgttgatgttgggggcattgggggcagaaatggcagcagccaacatgctggggatccatccgtctaggttccacaccttgcttaagggccagctttgtggcagacctggatacaccggagctgggggatcttgagggaacaggacccaagccataccttctgcaaggtcaactgggggcagcctgtcccaaagtggggtcccaggaacccaactcttacaagtcttattcttccttggtcaaggcacttaggaaaaccccatccttgatatgttcatgagccagcaaaggcactgacaagtcctgcagtggagaaagccagtgtttggcggggtggccaggaaggcttagcagtggggggctttggatggaggatctcggtaagaagggataaggtgggcttctagaacagccaggtcaggggtccacccgactcctccctcattccctaaccccccacttcctggttgggcaggccacatggagaatgtgagtttctgggcccccacactcccaccccagtcactgaccatctgccaggccagctgcacctagaggcggtgagtctcaccccaaatatttaacccctgactctgcagtgcatcgttagggtctgtactgtggctcaagtgggggcctttgtctctcttgggcccagtcccacctcaggcacagggccagctcccaaaccagccctttcatggattgtggcagatgcaagaaaagccaccttctggactctatcctggctgggcctgttgttccagccgaagccccccagaggacatgggagttgtggggcaatgaccactgcctcagggaccttggactcctgatgggacaaagctgtgagcggtagcaggaagctatgagcagacaggccaggcccaaggcccactgggctgcttgctgcttagacagcctcaggcaagtgccctaccctcgtacagcctccgcttctccatctgtcctctggcgatgaccacaaaggcatcctgggcatttgccacttgctgtgggctttgccagacctcagacatattcacaggcaccagctcaatatcatccttgccctaagtccccggggaggttggtgtgcccctttgaagaaggggatgaagaaaccaagactctgagacatcaaagcacttgctcagggtcacacagctggtgaaccgcgattctccccgcaagcaatctcactccagaggcatgtgatcgactgggctagaagttactcatggggatgctaggaaaatcacaccaataacaatctccaccatcgtaatatgagctaatacttactctctacgtgccaggctcctcactgtttctgactcaatcttcatgacaaccctgagagctgggtgttagcatggtaggtaattgtattattatccccgtttatgggtgtggaaactgaggatcagagaggttaaataactctcccaaagtcacccagcaattagatggcagagccaggactctaggcccttaacaattccatgtgacgatcttacagggctcccagcacacagtaggtacttcacagattaatttaaaatgccaagagcccaaaaccacaccgggatgccacttttcatccactacaatggctataataaaaaagacaataacaagtgttggcaaaaatgtggagaaattggaaccctcgtgccttgctagtggggatgcaaaatggtgtacagttgtggaaaacagtctagaaattccacaaaaagttaagcagtcaccataagacccagcaagtccacccctacgtattttttttatttttattacttatttatttttttgagacagggtctcaccctgttgcccaggctggagtgcactggcatgatctcggctcactcagcctccgcttcccagactcaaatgattctcctacctcagcctcccgagtagctaggattacaggtgtgtgccaccacacccggctaacttttgtacttttagtagagacggggttttgccatgttggccaggctggtctcgaactcctgacctcaggtgatgcacttgccttggcctcccaaagtgctgggattacaggtgtgagccattgcgcccagccttattattttttgagacagggtctcactctgttgcccaggctggactgcagtggtgcaatcttagctcactgcagccttgacctcccagtctcaagcaatctttgtacctcagcctccgagtaactgcgactacaggcgcctggcaccgtgcccagctaattttttttttttttcagagagggaggtttcgccatgttgccccagctggtcttgaacccctgggctcaagcaatctatctgcctcggcctcccaaaatattaggattacaggcgtgagccactgcacccagcccacccctacatatctatccaagagaaatgaaaacctatgtctgggctggatgcggtgactcacgcctgcaatcccagcactttgggaggccgaggcaggtggatcacctgaggtcaggagttcgagaccagcctggccaacatggtgaaaccccatctctactaaaagtacaaaaaaattagctgggcgtggtggtatgtgcctgtaatcccatctattcgggaagctgagacaagagaatcgcttgaacctgggaggcggaggttgcaatgagctgagatggcgccactgcactccagcctgggtgatggagcaagactccatctcagaaaataaaaaacaaaaaaacaaaaacaaaaaaacaaaaaaatctatgcctgcacagaaacttgtacatagatgaatcacagcagcatgattcataatagccttttggcctccactttttagtggaaacaactcaaatattcatcaactgatgaaaatataaaccaaacgtggtctatctctattattcggccaaagaatgaaggcaggactgacagctgctacagcctcaggaacctcgagaatgttatgctcagtgagagaagccagacacaaaagctcacatattattccattgataagaaacgtccagaatgcagaaatctacaggagcagaaagtggatgagtggttgccatggcccaggaggatgtaaaatggacagtgattgctaaggggtatcagatttctttttggggtgataaaaatgttctaaaatcaatcgtggggatggctgtacaactctgtgactatattaatatccactgggctgggcgtggtggctcgcacctataatcccagcactttgggaggccgaggtgggcagatcgcttgagaccaggagtttgagagcagcccgggcaacatggtgaaaccccatgtctactgaaaatacaaaaaattagctgggcatggtgatgcacacctgtagtcctggatactcgggaggctgaggtaggaggattacttgagcccagggggttgaggctgcagtgagccgagatttcgccactgcattccagcctgggcaatgagagtgagaccctgtctcaaaacaaaaacaaaaacactgaactgaacactttaaatgagtgaactggatgatatatgaattacatcacagtaaagctgctacaaaaaaaaaaaacacaaaaaaggcagctgggcatggtggttcaggcctgtaatcccagcactttgggaggctgagtcgggcagatcacctgaggtcaggagttcaagaccagcctggccaacatggtgaaacctcgtctctactaaaaacacaaaaattagccaggcatgatggcaggtacctgtaatcccagctacttgggaggctaaggtggaagaattgcttgaacccgggaggtggaggttgcagtgagccgagattgcaccactacactccagcctgggcgacagagcaagactccatttcaaaaaaaaaaaaaaggcaagtgccatttagaaatgacaggggtttgtttcttctctcctgagtcaggtcctgcctcttgtctcattctccagggaagctggccagctgcaggtaatcccccagcagcctggaagatgctagttaactcctagagagctatttgtcctgcccactgcgaagcaagtcacatatatattagctcatcaatcctaccagcctctaagtaagtaccattattctcaaaagttggaggattacaactttaagtgagtgaattgcatggaattcatataccatgcaattcactcagttacagatggggaaattgaggtacaaagaaattccatcatttggccacagttccactgccagcaagcaaggcagagctgggattcgaatccaggcctccggaagcacagtctcagcgtttttgccctgtagctttgcggtcctgtgttccccccaccatccagctggccgcaggaatcaaccatgtgtgccccttggagagctatggagccccatgctaggaagccagcaggaatgtgggtggggcaggaacctgcaggaaaggggacaggtcccaggagtgctgggaaaccggctaggctggtccagcttttcatctcggtaatgagccgcatcggggcagccagacgtggcacccctgggccatcagccccactgatggaggccgagacacagccctgtcctgcccatgcagacacagacagcagccacctgcctgagccaggaacacaaagatatcccccctccccacacacacaccggaaaagggaaagggcctgagtgacagccgagggtacacgcccagccctcccttttcttactcagagggtaacacggacacacgtgctgagggcagtggccgctggccctcgaaggggcctcagaagccatccagccccacctgctcattacccagatgagcaaaccaaggtcccggacgtgaagtcactacccaggatcacttgggagggcagcctgtgtaggagaaagacttcaggtctggagtcagatagggttcagatcctgactgcaccaaccagcaatgtgaccctgtgacagtgtgacagaggagctacactgtatttcttttttaatctttttatattttcttcaaatttttaaatagagatggtttctcactatgttgaccaggctagtcccgaactcctggcctcaagtgatcctcccatctcggcctcccaaagtgctaggattacaggtatgagccacaatatgcctggccagccactctgtatttctgagtctcagtttcatcatctgtgaaatgtgagcaagaaatcctctctagttatgttcatgtatgggcccaggcacaggagtgcacacctgtaatcccaccactttgggaggctgaggcaggagcatctcttgagcctaggagttcgagaccaaattgggcaaataggaagaccttgtctctacaaaaaatacaaaaattagccagatgtggtagtgtgcacctgtagtcccagttccttgagaagcttaggtgggagaatcgcttgagcccaggaggtcaaggctgcagtgagctgagtgagatcgcaccactgcattccagcctgggagatggagaaagaccctgtctcaaattaaaaccaaaaaaagtgtatttgtggggtgggggtaatcagggtcacttttagaaacacctcagtcaggccaggcacggtggctcacgcctgtaatcctagcactttgggaggccgaggcaggtggatcacgaggtcaggagatcgagatcatcctggccaacctggtgaaactccgtctctactaaaatacaaaaaattagctgggcatggtggcacacacctgtagtcccagctacttgggaggccgaggccggggaattgcttgaacctgggaggtggaggttgcagtgagctgagattgagtcactgcactccagtctggcaacagaacaagactctgtctcaaaaaaagaaagaaagaaagaaggaaagaaggaaagaaaagaaagaaagaaagagagagagagagaaagaaagaaagaaagaaagaaaggacacctcggtcaaatttcaaagacacctttgtggttcaaggactgaactggaggttcagagcagcgtccctgaaacagacttgagatcatttatactctttttaaaattttgaaacagtcttgctctgttgtccaggctgcagtgcagtggcaaaatcttggctcactgcaacctccgtctctggattcaagtgattctactgcctcagcctcccgagtagctgggattacaggcgcacgccaccatgcctggctaatttttgtatttttagtagagacagggtttcgccatgttagccggggtggtcttgaactcctgatcaggtgatctgcctgcttcggcctcccaaagtgctggaattacaggtgtcaaccaccatactcggcctcaactaattttttaatttttttgtagacatggagtctctctctgttgcccaggctggtcttaaactcctgagctcaagggatgctcctgacttggcctcctaaagtacagggattacaggcatgagcccactgtgcctggctcatttacattgtttatacaattcgggccttgctggctgtttcaccagtgggcctgaatgaggacccagaacttggttggcagcagaaacagccccctcagccttgttgacgctgtgggtcaggggctgcctgctagatgggttttgcaagcctctacgagtcacctcgagtcgactgaggctgtttttccctagctttttccttctgggctggggatgccagagtctgggacaatcctgagcagtctcacagagccccattttcttggcctggtctgcatatgaggctcttgatgcaagcaaggaaaaatggaaccagcaggtcaggaggctgcccggttcctcctcggagttccagggctgtgtttgagggtactcccagggaccagacaagggcttcctgggtctgagcccgcaggcttgagcctgaacagccatcttcttgtgtcccaggacatactcagagcagaggaaccactagggagggggcctgggggcctcagatggcatcaggtctcctggctctgtcgccaggagtcagagcctcagtagacacagcccgacctgctttattgattgattgagactgagtctcactctgtcacccaggctggagtgcagtggcatgatcttggctcactgcaacctctgcctcctgggttcaagcaattctcgtgcctcagcctcccgagcagctggaattacagacatgcaccaccacgcccggctaatgtttgtatttttagtagagatggggtttcaccgtgttggccaggctggtctcgaactcctggcctcaagtgatctgcccgcctcggcctcccaaaatgctgggattacaggtgtgtaccactgtgcctggccccagcctgcattagaggtggcaactcgaggctgaggacccagtggctcagtaagcccagctgcaaagtggagagctgggactcgaacctaggactgtgtgctgtcctggccgccaggacagcacacagtcctcagagggccagcagggatgcccgtgagaggagctgggacagaggtagcaccctggccttgacacaccaccgatgctccacgtgggcagagaaagataacacaggtgtctcgggggaccctcgctctccacctcctgggtctctcttcctgctttaattttgtgcgggtgccactggcactttctttcagctggaagggcagtgtggcccagtggttaagcacccagaccaaagccagacagcccggggtcaaatcctgcctctgctcttaataaactgtaaattacttagcctctctgagcctcagtttccccagctgtaaaatgagagtcatcacagtatgcatgccacagggctgtggtgggggtgactgagagaacagatatggggtgctgcctctgaggagcccggctctgccttgacctgggtccaccatccagggatttaggctccttttaaggagctgataaaagccagaagccagctgggcgtggtggctcatgcctgtaatcccagcactttgggaggctgaggtgggcagatcacctgaggtcaggagttccagaccagcctggccaacatagtgaaaccctgtctctactaaaaatacaaaaattagccgggaatggtggtgggcacctataatcctagctactggagagactgagacaggagaatcgcttgagcctgggaggcggaggttgtagtgagccgagactgtgccactgcactccagcctgggtgacagagcaagactccatctcaaaacaaaacaaaacaaaaaaaccctagaaacaaacaaaaagccagaagccaaggcctgaagttagaatcctccagcacctgggagatgaaagcagacccccggccgtccacactgttcacgctgatcctggtgcaagcccagacgtgctttgcttctgccctgtgaatgttgccttgccggggcacgtggaattcacaactaacctcagaatttggaaccatctcctccaacatctgcgaggagaggctggtgcccatatatgggtaatgaggtgtcgggaggacaggagatcctgcgtcccagatgcccactccctgggcctagctgggggacaaacgcacagcccgcttcagctgtcttgggtttgggctaaggatcagagtcagtaggtttggggatttgaagggtacagggtgttcccactgctctgagaacgttcttccgtccgcataagggaaactgcagaaggggagggtggggaggacctgtctacccggttatgccaacagatccctgagacctgtccctgcttctccctccactggttctacctgggaacgcgtctcctgcgcatcctcctccatctgcccctctggcctcaccttgatcaaagtcaccacttcttacctggcccaatgcaacagccacccactctcttttctgagagcatttgggagcacaggtaagttttagtttggatgatgggatgatctggttgcatcatacaaagacctaagagttggggagatatgcttcccggcctcctgcccccaggagagacgtggaccctccaaggacaccatgaatggcaaccttccagccatcagcgacctggaagggggctccctgggtgggggtggcttcaagagccacccttgatgtcttcagctgtacctgttcaagtcacatggcaccaactggcccattctttctaccctgcctgcaggggaggaaactgaggcagcctggccagggcagggaacgtagcctgtgttgtggctctaacccaggtgtgggctcgggcagattccttagtctctctgtgcctcagtttcctcatctctgagacagggataggaattgatcccactgcagagggttgagataattcaaggagataacccttataaatgaaagcgctttgggtgtggccgcaccatgattaggataactgggtttcatcctcttcctccgtgtcactggtgggggccttgccagggcagggctctttgtctgttgttcactgccatgtccgtagcgcccatcagactgaatgaactatgctggcttttggaataacagcatgtattactccacctgtctcagccttaatttctttcaacataaatggggttatcatgcctgcttgtcacggaacaagcagaaagacactcaacagctggaaaacattcccacaggagttcaggtattaagttgctttgtatgcaaggccagcactgttcaacagaaactgaacctgagccacacagaatttacatttttctagtagccacgtgaaaagagtaagaagaaatgagcgaatttttttctattttatttaacctaatatatccaaaatatgatcaatttgacaggtggtcaacagaacattattaacggatattttacattctctttttcacactaagtcttcaaaccctggcacacagacatacgtgcacagcccatgtcacggggccagtaattactgaataggactgcgagattctaggtgattctggggcacccggacctgctttgctctaagcccgcagtgaccacagtctctcagttctgctgtaggaaagctgatgggcgctcagagcatcttccagtctcactcggtgcctggtacccagggacacctaataaatgctcattctctttgaaccccgtgactcctcctgcccacactcactgattagatgtctgccccaggacagggtctcctctgtgggtccctccctggctgcctgactccaaaacaacctggggctccccactgtgcccactggagcctggtgcctgggtgtggaggaccctggcacgaagaccgcagcaagacacccttccccaggtccccagagcccctgcaaccctgtccataggccatggggctgtgctggaggcacctggcctgctcacagccatccccttctccaggctgcgagagcagccaccccggtaacagatcatactttagcaacatcggaggggccacgttcctgccatcacctccaccccagctgtccctgtcgcccagaactgctgtgtcccctgctggctcacagcccagcctgcactctcctcccatgtgtggacacaggtccctgcaggctcagcactccctgcctggccagggccactggcctttgatcacatctgcagttccttcctctgggggttaattctgtctcagtgggtgtgtattggggttgcattgctgctggaatgtctggaacgcacaggagggtacacccctccctggaaccagcctcacctgtcccagagcccagagaaggggctgggcctcctgccaccacggtcatcctcttctggcgtcctgcctgcctggagggccagcttgggggaggtgcacctccggtgccgagtagccctctgcccctaccttctttaaacactgcctggctcctgaaacatctgccctggctctgacacaaaggcaaccaccgtggacactcaggaaataactgatgaatagtaacaacactgagggcacctactgggtgcccagcgaccgctcagtccttttgtgcatcacccattgacgtctcatagccctaggaagtagccacccttagtgttactggggctcttaatcctacctattaggctattaaatttttggacaaaaagaacttactcacctttttgggggcccttctataaccttaattccacaccttgcgtagggctgggctcaataaataggtgttgaactgagcagatgttttaatgcaattcggtaactcttatgtctctgtgttctaggtgaagataactgaggctcacagaagttaagaaactggtccgagtttacacagctgggaagtggtggtgccaagattcgaacccatgaagacgggcttcaaaaagccaccttctcagtacaaaggggacatcagtatcaatccacacccaccccttacagacaaagggacaagagacatcggagagacaggatgatgggaccaggcattcaccacccagggaagcagagtgatttacagtttgttgtcattttcatcagtacaattaatcccagtggttggttgggtaaggattagtgatggtaaacggagactgagtcattctcctaagttgtccccacaagggactcccagcctgtccctccaaacagacctttcaggcggaagcaactgccattgagtgagcaccttcctggcccacaccctaccctagcaccggaagcaggtttcatctctgatccttataacaactagttgaggtacgtgctatcatagctccattgcagatgaggaaactgagcctcaggaagaccacttgctcagggtcaataggttagtaagaggtctatgcttgtaactgctgcagccccaactgggcactttctagatattcagtaattgccaaataaattttcgaccccaccccaccaactctttgtcatctctctgccccttacaggccctggcaacaggcccttcaccattaacaagcccccagagatatgaattgtccacatgctataaaatacctgctcaatttcacacctatttatggagccccaagcttatgtaaggcctggaattaaggacaacagaaggccctctcccaaaagatgagtaaatcccaactattcaaaagcttgtaagctagtaggtaggttaaggaaaaacaccccaatgggtataattacaaagatttggcttggcgcggtgactcatgcctgtaatcccagcactttgggaggccgaggcgggcagatcacgaggtcaggagattgagaccatcctggctaacatggtgaaaccccatctctacgataaatacaaaaacaaaaatagccgggcgtggtggcaggcgtctgtagtcccagctacttgggaggctgaggcgggagaatggcgtgaacctgggaggcagaacttgcagtgagctgagattgtgccactgcactccagcctgggcaacagagcaagactctgtctcaaaaaaaaaaaaaacaaaaaaaaaccaaaaacaaagattttagatcacttacaccagggtattttcatccactgtgttccatttaggccttataatctaactttaatgatgaaaatatactcaatccagtaaaaaccaggaaaagagcaaaatggaaacaaagggaaagcatgataaatagggcactatggtggagtaggttcaaacacattagtcattacaataaatgtaaatgagttaattttgcctattaaaagataaaagactctccggtgagattacaaaacacacaccttccccaagctatatgccattttataagacacacacacttgaaactaaatgatacaggaaggttgagaataaagaatggagagtgacataccaggcaactgatactgaagagagaaagcactgtccatatatctcaaagacaagagggagcgaggcaatccatgtaactatgtggttcccaacagctgcacatcaaaagaatgatgtctggacccatgtccatggagattttgacttaactggtcttggaaagggctctgacatgctgttcaaaactcctcaggtgattctaatgtacagccagggatgagaacaaggaactgaaccacagcaaggtttaaaagaagcaagatgccgaagaatcctagatctctataggaaggaagccctgtgagaaagcagtacacagaatgtgcccaatgaataccagattgattggtcaattgactgattctctcactactagaaactcctgtgctaattagacagtaaatgtcctcacacccagctattaatcctgtggaaatatatcctaagatgagaaggttgctggtgtagtaattccaggtctgtttttaaggcctaatctgtttctgcccagggaaggccgccctgcctccaggcctctgatggggcctagggttctgtgtcaggtgagtgcttttgggctccttttacaaacatacagaagttcaagctgcttcaggtaacaccaaggcaggtcttgaagacagggcaacacagcaagaccctatttctaccaaaaataaataaataaataaaattagctgggcatggttgtgcatgcctctagtcctggctgctcaggaggctgaggtgggaggattcatagctcactgcagctttgaattcctagactcgggggataaacagggctcaagccaactttggtgccccaaggcatcaggatgtcactctgggttcaggaccactggagaaagagcaccagcctcctttttcattttttgagacagagtcttgctctgttattcaggctgaagtgcattgctgcacttcactcactgcagccttcaactcttgggctcaaacacaaaatatattttgtatttttagtagggacagggtttcaccatgttggccaggctggtctccaacacctgaccttaggcctcccagagtgttgggattacaggcatgggccactgtgcccggccatctcagcagttcttacccagacactttgagagggctggcagggtgtcctggccgccccgcccatcctttcctaggcagagggtttttgtcatgctttgtaagataaaacacaccagagctgctggctgagcctgcaaggccgcagggctgtgggagaaatagaacttgcagaattttttgctgcccccactgcctgggctaggatttcaggctgataccttttagggtttcaaattctctgccttcgccatggcgatggtttgtttcccatcgaagggtgggaaaggattccaagtttgtaccacaaagaagagacagggcttcaaccctgcttcaatctcagataagaaactctatttggctgggagcagtggctcatgcctgtaatcccagcactttaggaagccgaggcaggtggatcacctgaggtcaggtgtttgcgaccagcctggccaacatggtgaaaccccgtctctactaaaaatacaaaatatagccaggcgtggtggtgggcgcctgtaatcccagctacttgggaggctgaggcaggagaatcacttgaacccaggaggcagagaggttgcagtgagctgagattgtgtcacttcactccagcctgggcaacaaaagtgaaactctaccttaaaaaaaaaaaaaaaaaaaaaaaaaaaaaagatctgccgagagtcctggagcgagtcactcaaactctctgagcctcacttggaacgagagctgagggtagaatttatctcagacaatgtaataatcataatttagggtgatggttttaagctagcacccaacctcaaggcctttctgtgttcatacctttcccagttctggtcccctcccctctcacttccttgcagagactctccatttttgtctccccatccagaacctgcctgcttgccttccaggactgggccccctttgcttcctgaggtccctcttcttcctctcccagaccttttattttgctatggactggactctgagacccaggactcagggcttgcctgcaggctcttcccacgctgtgccccccgccagctgtgccccacgccagctcgccttctctactccacccttcacctaaactggaaaactcgtgatctactcagacatgcagaaaagtactgaaaagaatcagccacgcatgtccccaccaccacggtttggttgatgttttcacagtaccatctttgctgcagatttttctaaaaaggaagagaaatgttattgttcattatcctttcaggccccttcttaggagtagcagaattttagatttactggttcttcctaagcctgttttattttatttatttagagacagggtcttgctctgttgcccaggctggagtgcagtggcacaatcacagctcactgcagccttgaattcctggactcagggatcctcccctctcagcctcctgagtagctaagactagaggcatgcaccaccatgcccagctaatttttttttttttttggtagaaatagggtctcactatgttgcccaggctcgtcttcaactcctggcctcaagtcatcctcccgccttggcctcccaaagcgctaggacaagtgcgaaccactgcacctggttccctaagctttccaatacatagacacatctgcattcaggaagagtaagtggaattgctctgtgtatgtttctaaaaatgtatatatgcaagcatcatctttgcatccttcatcaacttgctttgcttgctcactgtcatgccttttcgggtcgtggatacacacatccccgtcaccttctgtcaactgcactctctttatcctctcatctccaactgatccccgggttcggcgtggaggacctctcctgaagaagcctgtgtggctgggtcagggccctcctttatctcactatcactccgcattgctgccagctgtgtactcagccaactctctgctcaccgtcctgcacgcaggaggtgactggatggggacagggcagggggcagcctgctcaggcctcgcactcctttccactagctggaacccctgccccattcatccccacctccgggctctgctggtcctggggtgtgaagcgcagggcaatgtatgctctcttgaaatgctgagggaaggggagaatcttagcagtcccccatggcttactctcattcattcattcattcagcacgcgtgtagcaccagtgtctgggggaaggcagccacacagccacatgtggctaccccggagtcacatagctgctgagataagagctaccaaggagaaggggagtccatagaataggtggatctaccccagcagagaggttggggaaggcttccctgaggaacagaaggtaaacctggaagtggaagagaagcagtgaaaaggggtgggaggggcattctgggcaacaggaatggcagagggaaaggccttgtggccgggcacagcgtggaaacaagacggtgacaggcacatgttgatgtgcagggcaccagctcccagggcctaagagcaaagagaggtctggggcaggggttaagcagctggaggtatggtcagatttatgtcgtaaggagctccctggctgccatggggagaagggactggagcgctggagtggaagaaggaacagtgaagagggactggaggcctgctgggctgctggctctgcaggcagggagaagtggggatccatttaaagggaaagggcctgcgtgcagtggctcatggctgtaatctcagtgctttgggaggctaaggcaagaggctcacttgagcccaggagttcaggaccagagtgggcaatatagtgagaccccatctctacaaatattaaaaattagcggggcacggtggtgtgcacacctgtagtcccagcttcttgggaggctgaggcatgaggattgcttgagcccagcagttcaaggctacagtgagctatgatcgcaccactgcactccaatctgggtgatacagtgacagcctgtctctaaagaataaagaaagaacacttaaaaaaaataggttggggtagggaagggcagggctgggacctgaagagagctttgtcccacccggaggcagaaaggggcaccaggtggcctcccgggctccagaggctgcagcacagcaacccatcagaagccgggagaacaaagaccagaggccgtttccccattcgctcccaagacaggccggggcaggcaggctgggaggatgcaaggtggtgccggtaacaccggcacagacctgccgggagcagagagcagctgcacgctgggaagccagggttctcttccccagacgaggagctttggaagctctctaaagcagcttctcccccaggtcccctacttccagggcctcccccaaccacacccttagggtattgcttaaagggtgtggacggagctgagtctctcccccaaaataccctttcccaacatgatccgcccgacagtgcctgaaatgctaccattagcagctgttcctccaggtaagctcagctctgtcctgaatcgaatttatccagtctcattccttcttccaagagaactgggcaagggatggaggggcaaagctagagagaagagaggtagagggggttgctgggggtagaggcagtgagcacaaacaccaatgactctaccatttggcctggagcagtccccaggcacagttgctgccagatccaggtacgagtggggaggcctcatttgcttccccaggcccccctggacttccagcatcagccatttgtgagctgtgagctcaaggtgaatgtgagccctctgtgaaacaggacacttccacctgcatggcaggcccgctgtcagaatgagatgtaacatccatggccttgctgggctcacagtatgtgcctgagaaatggcggggcggctctctctaagctgttacccacatgggtcccctcccatatcgatcaggcgttcctaccaacactgatcgatgggtgcatgtgcgtgtctgcttgagtcagctccctggtcagctctgggcttggctcagtcatgaatcttttttttttttttttgagacggagtctcgctctgtctcccaggctggagtgcagtggtgtgatctcggctcactgcaatctctgcctcccaggttcaagtgattctcctgcctcagcctccccagtatctggctgggattacaggtttccgccaccacacccagctaatttttaatatttatttttgtagagatgggatttcaccatgttggccaggctggtcttgaactcctgacctcaagtgatccgtccgccttaccctctcagagtgctgggattacaggcgtgagctaccgcgcccagcccgtcatgactcttaatagcagtgtgtgcttcctagtattggctgctatgatttgccgggcactcgctctgaaccaggtcatgggctggacccatcatgtgcatcccctcatttgatctacccagcagcctcaccaactgggggttgctgttgtcaccccacctcatagatgaagaaactgaggctcggagacattaagtgacttgcccaagatcaaacagcttaagagacccagagctgcggcctgaactcatgcccagctagcatcaaacactgtgttcttgcttttttttttttctttttgagacagagtctcactcttttacccaggctggagtgcagtagcacaatctcagctcactgcaacctctgcctcccaggttcaagggattctcctgcttcagcctcctgagtagctgggactacaggcacccacccccatgcccagctaataaaacactgtgttcttaaccactaagaggctcagggtaccccaggtgcctcccagtagagcatgcttcccttttgccagctctcccctcaaagcctggggtcctgcctcccatgcaggagcgctccatcagggcggccccagtgttgcaagacccgtctaggcaaggccaggctgctgggtgtttactgggacccaggtctgggtggaggggcaagattaatcccattcaacaaattcagaagcgctggggctcagggatgctatgtttcttttcaagcagaggcagaattgagcctgactgcagagctgggtcttggccactccatcccaccccgtgacaggtcagatgcctcctctgtgaagtcctccctcacctcccagcatctgtgctctgactgtgacaactctcacttgaggcctgtcacaaagtatgtgagtggccagggtggagacctcatctgtccggctctatgctccattgctcctgcctggccccatcagtccgacgctcatgtaaccatacatgtactgaagcttaactccatcttatctctgtgatgtgactgccagcgactcaagtgcagggaggttgtccacgtctcctccacgaccacgtgctaaaacccagcaacagtgcctatggaattgtgcagtgcacagcctgtccaccatgatatcaagtttaaccctgggtacaccacagctagcttgcccgcatttgcttaataactgtaatcgtcacagatgctattacctgcggccgcttatcattcacaacctttcccctgcattatttcatttaatcctgagccaacatcgccaggcaggcaccgtgcttattcccatcccacaggtgagaaaacaggctcagagaagccaagcagctcctctgaggtcgcacagccaggagggtggcagcgggtctcctccagggcctctctactaggctggaggctgtcctcggtcacctgcaccatctggcctgactctgtcattagctcaggtgtgaacatcaactcccacacctgtcattaggaacccgggcaacgggagcaacggggttcacaccctgtcccggccctccccagcttcagctgctaaaaggcagacaaactggaaggggtggctttctcggtggggtgttccgttcactaatccacactttgtagtccaaaggcctgactaccttgggtatgaaagtcaccacttggggctcctgggtcccctgggctcggaaagggctgctaccctcatccgggcacctcctgtgtgctacagcactgctcctcccagcagccctatgcatgagacactcagtattaccacccgtgctgtgcagaaagggaaaacaaggcttcgagaggctccagggtggagatgccaggatcaacagtgaggcattctgctctcagtgctggagctcctactgccccccatgctgaatctcaccagcaattttgtcctcccccagacaatggagcgggcccctggaaaactcagagtgaaggaataacttggggatccactccctgtgaccagcgaccacagcctagagccgcaagtctgtcccctccacccccccaccaagacacttgctatggggctggctgggcatcaggcaatgttcaagagatgcgtttgagaggatggggtacagggctacccccaccccacaatccagtctgcgaactagtccccactaaggggagggggcagagggatgcactgggcttggagaccacccggggaggcatctgacatctgctcagggctgtggctgtgctcattctgtgctggggtggcaaggctcaaaggaatggtcttgcaccccaggctggggagagaatcaggagggcttcctggagaaagagacgtctaaatggagatctgggaccaatggctatcagcctaggacagaccgtggctgccttgggccagatatacagagagtggcaggaccccaaatctttgccaccccagaccctcccagtccctgcagctataaaggatgggatgcctttcatcctcatgcttctgggaaagcccgcacccctcccagcttgtctgggttcattagaaccttttgttaggtccaagctggggccttcaggatggagagctgcacgaaggagggaggctgggaggaggcagagggcggggcgaggcctggccccaccactggtatgtgggtgtctgcatgtgtgaaggactggatgggtctagtctctggggtggagaggacagaacggttctccacggctggcacggagcatccaattgtgcaatgccccagggaacagtgcagggactggacgggcctctggttgggtctgagtgccagctggacgcagccatggaggaggggtgtgcaggccctgcccagtctctggggttgtgaaagataggggaggggtggggaaatctctaaaggcgggtaatgcctctgagcttgaaagagcccaaacggagatacgggtgggtgggatcacagggcaggggggtttctgaaagggctggaaggccccggaatggagtgtcgcactccagcgtgctagggccccgccgcctgcacctgtccgactggtcggcctaggccggactgcaggggttgagtgggagccctgggcccagaggcctctccttgcctagggaagaagtgaggagctgcttgagggcacagtgggggctcccagtgagagcagcttgggggcagaactcccagacaggagagccatgtaatgtgcgggcccctcacctgcctgaagcctcttgtccgagaagctggcaaaatggtccttgctagcccagagcccccactctattttccgaagtggggatataaggcaggggctggattcccaccccctccgtcaatctcagcatctccaccaggctcccctaaaccggttattaagtgaacacattaggcttatcaaaagggacgtgggctgcttctccctgcaaacacatcaagacatgccattcccctcccaggccgccctgggaacccgcggctcagagacgccgccagtttcggggctggggtgggggcagggagccacacccctgcgaaaccgagcttcgaagaggaggccccgaagccgcccaacctccgctcagaacccagagggtggggaggtaagggggtgcctccccctgtgcccctcgacccgaccccacaccccccagggcctccgggcgcggctctggcgcgcagggtggcaggtgccgggaagtgcagcggcgggtggcccgccccctccggacacccatccctcgcctccccgacgccaggaacacttgcgcggtctcagaggcgctggagagcgccccccgacgccagctcagtttccctgcctcagggcgccccctggacggagcttcctgggtcgcccgcagcgaccccgccttgagtgcccggtcctccaaaaactccgccccctcatccaggtgactattcccggtcctgtgcgaccctctgcgcaagagcgaccctgggacacgggggtgccctgtacccccagctcagctgcccgtgccctaggccctcaaggcaatgctccctgggctcccggagtcccctgtgttatgctccccctcggggaccccagccagtcccttcccacctggcggcgcttcccagcttcagggtggcctcggtcccgcgttcccgagagtcccgcactccgggttcagttcccggttcctggacccccgtaccccccattcctacactgcccgggaggtcttccaggtcctgtgcgcccacaggggcaagagcgtcccggagcggagctgtgggcgcctcctcacctccgggtctgcacagtggggctgtatttgcctttgtttctcttcctgaagagcgagttcatggtggcgctcggggtgcgggcggcggcggctggcgggccgggcgcgcaccgaggggcgggcgggagcgcaggtgagcgagcggcggcgcggggagcccggactgcggcgcggcagtggctccgggtccctactcgctgggggcggggcgcccgccggccactggctctgcgggccgctccccgagaaggtggtgcttaccttcccgaggaggggccaccgcgcgggcggggcttggacgcgggggtggggacactgggtcttggccggacgccgcccacccccagccgggggactccggaggccgggcaggcactggggcgcaaaggccgccggggcgagcgctcgcagccccaccctcctcgggcccggcgcgcctctggccgaggccttcacctggttctgcgctaccgcggaactcggcgctcctggtgctttggcggacacccagctgggccccgcaagacaggtgcggcagagacccgcacggattcatgtgccctagtagctagcgaattgcactcagatggtggcaattgagggaagggggctgaactgccgagggcgccggcctgagttcaagccctgccacccccaggttggctgacactcctgggcaaggtgttttactgctcccagccacagtttacttctttgtcaaacggtgataaccaccaccccatccgaaaggcctgtggggatgtccctgcaggtaatgcacgcaaagcgctgagcgcagtgccctggcctgaatctgctctccgcttgccatctcgggtggacaaaaactcctttgaaacttcaataactccaggccctggcactagaagagcgcttcatagctggtcataaaagctgctcgattgcggctcagaacaacgacgttgcacaattctgccagcatgtcctggcccagactgtgtgccagtggaggaggctgcccttagacagaaacctaatctgacctgaagcccggatggcacacaccaccacacctggctaatttttaaaaatttttgtagaggcagagtttcaccatgttgcccaggctggtcttgaactcctgtgctcaagtgatctgccggcctacagcctcccaaagtgctgggattacagatattagccaccgtgcccagccaaccttattcttaatggggcttctatgggtgggcttaacccatttatgcctgaggttgcaattttttgaattgataaatcataccttggcagtgaccttgagcagtaggagataactcccacaggcgtcacgttccaataatggaccactaggcgtaaatagaggtgtgattcctcctaaagttgtgcctgcctgcctgccttccttctttccttcctctctctttcctttcttgctttcttgctttctttcttctttcttctttgagactcagttgcccaggctggagtgcattggcacaatcatagctcactgcagccttgacttttggggctcaagcaatcctcccacctcagcttcccgagtagctggatccacaggtgtccaccaccacgcctggctaatttttaaaacctttatatttatatatgttttttgtagagatggggtctcgctgtgttgcccaagctggtcttgaattcctgggctcaagcagtcctcccaccttggcctcccaaagtgctgggatttcaggtgtgagccactgcacccagccctaaagttgctttcaaaatgtgtgtgtccaaatgtgcatttttctgggggaggatgtattgctcagtggagtcatttactcattcaacacatgtttcccatcactctcacagcctcagtgtgcctggctctgcttgttgtacacggatgagaaaagggaaaagaacaacacaaaaggggctttctctttgggagctttcaggtcccggggcaggggacacatattaaaaatgttaacttggatgggcgcggtggctcactcctgtaatcccagtactttgagaggtcgaggcagggggatcacctgaggtcaggagttcaagaccagcctgaccaacatggtgaaaccccgtctctcctaaaaataaaaaattagctgggcgtggtggcgcctgcctgtagtcccagctacttgggaagctgaggcaggagaatctcttgaaactgggaaggggaggttgcagtgagctcatatcacgccactgcactccagcctgggaggtcacagtgagctgagatcgtgccactgcactccagcctgggcgacagagtgagacttcgtcaaaaaacaaaaacaaaaacaaaaacacgttaacttttctttttctttctttttttttggagatagggtcttgctgtgttgctccggctggagtgcagtggcgtgatcatggctcactgcagccttccttgacctcccagacggaagccgttgtctcttctcagcctccctctcaagtagctgggaccacaggtgtgcaccaccatgcctggctaattttttttaaattaattaattattattttttttttgacagtctggctcttgtcgcccaggctggagtgcaatgacacactctcggctcactgcaacctctgcctcctggattcaagcaactctcctgctgccaccacgccctgctaatttttgtatttttagtagagacagagttttgccatgttggccaagctggtcttgaactcctgaccttgtgatctgcctgcctcagcctcccaaagtgctgggattacagctgtgagccactgtgcctggcctttttaaatttttttaattaattaattaattatttaattttttttgagacagagtcttgctctgtcgcccaggatggagtgcagtggcatgatctcggctcactgcaagctccgcttcctgggttcatgccattatcctgcctcagcctcccaagtagctgggactacaggcgcccgccacaacgcctggctaattttttgtattttttaggagagacggggtttcaccatgttagccaggatggtcttgatctcctgaacttgtgatccacccacctcggcctcccaaagtgctaggattacaggcgtgagccaccacgcccggcctttaatttattttttttagaaggagtctcactctaccaccgggctggagtgcagtggtgcaatctcggctcactgcaacctccgactccctggttcaagggattctcctgcctcagcctcccgagtagctgagatcacaggcacgtgccaccatggccaactaaattttgtatttttagtagagacggctcaaactcttgacctcagatgacctgcctgccttggtctcccaaagttctgggattacaggtgtgagtcactgcacccggccgcctggctaatttttaaaattctttgtagagatgggctcttactatgttgcccagggtggtcttgaactcctacaggctcaagcaatccacctgcgtcagcctcccaaagtgctgggattgcaggcgtcagtccctgcgccggccaaattgtgaactccttgaaggggtctggggacatatgggggagaaagaccctgggagaggcggtggttctaacattgttgcaccttagaatctctacaggagtttgtaaaaggcatattctggggccctgggacccttgacatcctgattgggggggtctgaagagggaggggcctaagaatctgaaatctggacaagcttccctgggtggtctgaggcctcagtgtgtgcagcctcccagctgctcaggcagacagccctgaacagacctccccagcaaacccagtccttccccaactcggctctgcctggctcagtttcgggtgccgcccccaggtgggcatttctcattggcaggtaagggcatgacaatgccctccctcgtccaaaagtgacttccttgcctagatctcagggccccgaagggatgcttcctccagccagctgatattgggagcaggtgttagagaggagctggggtttcagaacacaggtgtgcggggagtcaccttgcacccgcagaagcctgaactcaacatggagctggctcagcacacagaccccttccccataccccaagaggggttcccagggaacttgtgcgtccttgctgtcgccccctggtctgcctatgcctggacaccctctcctttctcgttccccatacctttccccacaggtgggctcttactccgggctcagcatgccttgaggatggtcactgcagcagtgttgctgaccttgtactaagtgtgcatcctgggatgcttttggcaacacagttgctaatggagaagctctgtaaagaaactgctgcctatttggagggggatggtccggtaaccagggctgcctacaccaggaagaccctgcagctggaaaaggggcagatgtggagaccatatgtagactaacatggagtggagtgccagatgcaaagtgcaaaagaaagagggaaagacagagtgtgtggtgtgtaacatgcttgtctatgcacaaaaaacttctggaaggatacatgagaaaccgttgctgaatctccccaaaaaggacaagaaagaagtttgaatttcttttctttttgagatggagtttcactctcgttgctcaggctggagtgcagtggcgcgatcttggctcactgcaaccttcgcctcccagccattctcctacctcagccccccaagtagctgggattacaggtgtgtgccaccacgcccagctaattttgtatttttagtagagatggggtttcaccatgttggtcaggctggttttgaactcctgacctcaagtgatccaccgccttggcctcccaaagtgtggggattacaggcgtgagccactgcgcctggccattttttttttttttttttttgagatggatggagtcttgctctgtcacccaggctagagtgcagtggcgcgaactcgcctcactgcaacctctacctcctggagtcaagtgattctcctgcctctgcctcccaagtagctgggaccgcaggtgcatgaaaccacacccggctaatttttgtattttttatagagacgtggtttcgccatgttggtcaggctgctctctaactcctgacctcaagcaatctgcccgccttggcttcccaaagtgctgggattacaggcgtgagccaccacgcccggcccagatctcggtttgaatccccgctcagtccctttcagttgtgtgaatacgggcaaatcattttgcctctctgagcctcagttttcctcatctgggaagtgggcgcaaacctagcatcaacttcacagggtgaaaggctgtgtgttaagcattcagtatgtcccctggcagttaggtagcccctaacgaaggggagggaattctctctgtagctagagactgtgtgtttgcgggactgacgggcacaagtgactacaggagctccaaacagtgtcaaaactctcggcttctccaacctgccaaatcccctttccctacaactcctaggaaggttaagagttggtttgcgggagggaaccagatcagggacctctaggtcagcagtgaattctagctcagctgctgaataacagtgacggcattgataatagtaatgtcacctcttgtttattgagggctgactctgtgccaggcaccatggcacgtgcccaaccacccccactgggtgaagcagggcagtgctccctgcctgggaggtagccacttccttgtcttattttctttaattaattttaagacacagggtctcgttctgtcgcccaggctgcagtgcagtggtgtgatcatagttcactgcagcctcgacctcctggactcaagcgattctcccacctcgacctcttgagtagctgggactacagatgcacaccaggaagcctgggtaatttttaaattttttgtaaatacggggtcttgctgttgcccaggctggttgagaactcctgggctcaagtgatcctcccaccttggccttccaaactgctgggaatacaggcatgggccacggtgcctggcctctcttgtcttacttttcagggaaggaaatgggccctgagaagcacagggcccatttgggctggtacctgggtcagcctgctcctggactgagctcttgaacctctgcctccctccactcttcagagttctaattcctgggctcgggcttggggcagctgggctggtctcccgctgactcagctgagcctggcccaggagtggcgggtagaattagcagatttagggaggaatttgagtggcgcttcaccatccctcccctctccattctctaggagctgggctaggagctcccatggctgtgtgtgtgcgcacatgtgtacacacgtgcacacaccacacgtttgtgggcaggccggatggggtgggagatccgttctcaccccatgcatcctcctctgggcagatgggatttgtttggatccgcgaagccctctcctgccaagtgactcatcccctctgttgccgtgggtggagggccagcctgccggggtgggggagggtgcttgctttcctcgagtttgctcgcaccttcagggccatttgttccctggcaaccaggccaccctcagcgaccctgaaacctgtgttcctgcagccagaccaggcagccagctcatgggaggccaccaacttcggaagggttcctcacgcccgccctccttgtttgccatcactgttgccctagcagctggagaggtgtttggggtattcgcctgtgaaccagtttgaaacaagaggggcagcattcgcccagcccgggacagagggacatgtgggatatatcccgagccctctccgagacagccattctcccatctgtggctgtatgcaccccaacttggggtgcatttacaaatgcagattccagggtccctccctggaagagattacggttgggtgagtcttggcagggccgagaaatctgcatttatttatttattaattatagagatgaggtctcgctgtgttacccaggctggtcttgaatgcctgggctcaagtcaatctcttgcctcagcctcccaaagtgctgggattacaggcatgagccaccaaggaatctgcattttttttgagacagggtctgactctcttgcctaaactggagtgcagtggtacaatctcggctcactgcaacatccgcctcccaagctcaagcagttcccctgcctcagcctcctgagtagctgggattacaggcatgcaccaccacacctggctaatttttgtatttttagtagagatggggtttcaccctgttggccaggctggtatcaaactcctgacctcaaatgatccaccagcctcagcctcccaaagtgctgggattataggcgtgagccaccgcacccagccaggaatctgcattttaacaaacacctactccgtgggatgctgaggcaggtgagtttggggccaccctgagaaacacggctgtgaacagaaacagatgttgcagtaactccagccctggtctgcccacagccgggatacacttacaggtttcagcctgaaacctgggtttgaaacttggctccacctcacaccttagccgtgtgaccttgggcaggtggctctcttaacctctctagacctcagtttccccatctgtaaaattgggaagagccggtgggcagggatgtgtgcacagcccctggcatgaaggccctgctcctgtccctgctccgaggggacaggagggggctggcccagcttcacccctgttttgtaacatgtgtttacttttcttacaggacaattcaaggagtggaaaattgtgctggccctccagcccacatgggctgactcacgctcagctctgggctgggggccctgtgagctccccacagttctcctggggccagaggggaggccaggccctggcagctggagcaggagagggtctacggtgagtcatgctctgcctgcccctgagtcatcccctgagaatgtgcctcaggcccctacccgcccgggccccctggcagaatgccacttctccctgcctgccaggcagccccgccctcctgccggcccagggagccgctgctccgatgaccgcctcctggctctctcctgaatgcacctgtacagccctgtgtgttatcaaaatattgaaatagctcccaaccggtagttaaatagcggttgctctgagcccctggccaccctggtttttcccctccccagccactgaggggttagccgtgggctcagcaaagggttcttcgactctgccccacccatggctggggtccaccgtgactatgaaaagcccatcagcccatcttgcagatccaggtttttgggatttcagacacttcatcttgaaccctgggccacattcctttttcttcttctctttgagacagggtcttgctctgtcaccaaggctgaagtgcagtggcatgatcacaagtcactgtagcctcagactcctgggctcaagcaatcctcccatctcagcctcctgagttgctaggaccacaggggcgccaccacgcctggctaatttaaaaaacttttttgtagagttggggtctcgctatgttgtccaggctggtctcaaactcctgggctcaaatgatcctcctgcctctgccacccaaagtgctgggattataggagtgagtcactgcgcccagcccccggggcactttctgacacaacctgctacacatcttggatcccacttgtcaagcctggccctaggcctctcaggggtgggtacatcaagtgaggaagtcacactgtcagggcagaaagaggggctgggtggggccggacaggctctgctggctcaggatcccggcaggacaggctgcccaacccagccccaaaactcccatcttctgtccaacgcccaagcctgcttcctccctgccccacctcacctcacactgcccagactggtggggctgcatttttggggccggtgccaggtgtgatggaggacagcccaggtcaggaggtcagggccccgtttcctcccaagccaggatgactcagtgatggacagactaggccacaaggggccgaacacaaagccaaattagggtttagtttgaagccaacctgggtttgaaccctggctctgccatgcacccagctgcgggactgtgggctggtggcttaacttctctgtaccatggggaagagccagtgagctgaggtgtcaaatctcaactgatctatttcctaactgtgtgaccctgggcaaatgtcttcacctctcttaacctcagtttccccatctgcaaaatggggacactctgacacctgctctgtagggtcttgaaaagtctcaataaaggaagacatggaatcatggcaaatagtaacttttgttgggcatttactataaaccaggccacgtgctgagtaccaggcttggaggctggcactttttcttccagcttgattgagatgtgatgaacatgcaagaaagggcacattttaaaaaattttaggctggacgcggtggctcacgcctgtcatcccagcactttgggaggctgaaaaggttggatcacctgaggtcaggagtttgagaccagcttggccaacatggcgaaaccctgtctctactaaaaatataaaaattagccaggcgtggtggcgggtgcctgtaatcccagctactcaggaggctgaggcaggagaatcacttgaacccaggaggtggaggttgcagtgagccgagattgtactgctgcactccagcctgggcaacagagtgggtgttcagtgtcattgttgaatgaataaatgaatgagtgggaggaccagtgtactgttgtgatcccggagaaggtccccttaggggaggaccaggaaagggttagtaggtcctaagttaaaactatgatggaagagaagaggttcattggtttgttcatccatccatccatccctccatccatccatccatccctccatccatccatctatccatccatccattcatccatctatccctccatctctccatccctccatctctccttccctccctcccttccttcctccatccatccattcatccatctcttcatcccttcatccctccattcctccatccatccatccatccatccatccatctcttcatccctccattcctccatccatctcttcatccctccattcctgcatccatccatccatatcttcatccctccattcttccctctctccctcccttcctccatccatccatccatccatctatccatccatccatccatcccttcatttgtcaaatatttactaagcacctgctacgtgacaagtcctgttctaggcactcaggattcaagatcaagtacaatagactcaggttcctgctcccagggagcttgctgtgggagacaggagtgggaatggacaaacaatgtaagtttgaggtccccttgggtggatcatggcgcctcttctgtgtgccccaggagacaaagtctgcagtcggcacagagtcaccgtcaggtgggggcccagggacactatgaggaaagtggccagactccagtctgagggtggttgaggacccggtgaggaaggggaggccttagcttgcagggcgtcaggttccctcatcgtgttttctgcatcactgacatttcccaggagccaggctcctccccaacccccgtggaggatctcgacctcttgcccccacaatacctcccacaagtcactcatccatttattgagcacctactgtgtacccggctctggggatatagtagcaaacacgatacatccctcacatcctgggggccccctgtcttggaagggaggagggacagaaaagcaaacagataaccacattttttacaaatgaaataacctaagtgcccatcagtgggggaagcggtggtaaattacaaaactgccctagtctgggaggaattcggggaggcctgtgggcctcacagggaagctgagggtgtagcaagtgaaaaaaggaagctgcctgctattaggtgtcgtgttttgccatttccgcttcagaacggagctgccctgtgtctccgtgagctcgtcctccacctgcctgcctgcctggctctgcctccactctttgttcacgctctctgctgagctcaaacattcctgctgggcccaggcagccaagcccccatcagccgcctcccaggccattctctaatcacaagctcaggcttaatccccacacacgcccaggactccgctctgggcaaatactcctcctttcagccctggagtccctgacctcccgctacccagaccatcctgtcccctgtccccagccaaaaggcccccctccactggttgggggtggggagacctcagtgtagccttgtccaataaaactgcctgtgacaatggaaatattctgtatacatggaggcggcaagccacatgtggctactgagcacgtgaaatgtgactagtgcaactgaggaattgaattgttaatttttaaaaattcattttaatccattaatttattttttgtagagatgggagattctcactgtgttgcccagggtgccttgaactcccgagctcaagccatcctccggactaagcctcccacagtgctgggatgacagtcgcctgccgccacgcccagcctgaattgttaattttattgtttatgtgtattgttatttatgtaaatatagagcatattcatatttacagaatttaattaatgcaaacgtaagtagcagcgtgcatctggtggctgtcgcagggtccacctgggcccaggcatggagaagaggacagctcgggtccctggtcctcttcttggcaggggcagcctagaggggctgggtggcagctgaggcctcaggcactgagctggggggtccctggagtcgctgtgttgatggggctgagctttgggtgttggtgcctgtggcccctccccagcggccagtcccttgttctgacccctgcttggtggtcagaatcacacactgagagctcctgaagacctgagctgaccttcaggtgggactgtccggctccaatgacaagaggtcgttttccccaggttcctctgtctgcatccgctccacggatgcgctctctaggaacagcttccccttcctggttctcctgggtctccctttccattcctacagcatctacctgggcaagagatctagggtctcaccccctcacctccagattcctgaggtcactttggtggcctccctcctcctggctcctcctccgtgctctctgcacccttccccctcctccaccgtggtcaactacaatctattcccaacacagcaaccagagggctaaagtgaagtcagcagactcccctgtcccatacctcccagacactctgagtacctcagcatcagagccagataacccatgagaccccctccctcaggctcccctcagagtctgctctcttccccgccacttccctcccactaactctacccccgatacactgaccgcctccccaatactcaaacacgccaagtatgctcctgcctcagggcctttgcatcggctgcccccttggccccactctctacgtggaccccctgctcttcttccaagcctttgtgccaagtcaccttctcagcgcagcccacctggtccctacattgtaatctgccctgcacttcccaccctctttccctgctcaccaatcatggcactcagtgcaatctaacccacaacagaagccactcacggatacaaaaaaataagccaggtgtggtggtgggcgcctgtaatcccagctactcaggaggctgaggcaggagaatcgcttgaacccgggaggcggaggttgcagtgagctgagatcgcgattctgcactccagcctgggtgacagagtgggactgtgtctcaaaaaaaaaaaaaaaaaaaaaaggggagtgaaggcctgacatgcgcttcagcatggttgaccgtgagcacattaggctcagtaagaaaagccagatacacaacggcacatattatacgatcctgcctgtgaaatgttcagaggtgaattcgtagagatggaaaggagactgtggctgctggggagaggggagtggcgagtgactgctaaggggcacaggtgatgatagtgctctcaaattgaccatgctgatggttgtgcaactctgaaactaccaaaaccggctggatggcactctttttttttttatttttttttttgacagggtctttctctctctctctccttttttttttttttttttttttttttttgagatggagctttgctcttgttgcccaggttggagtgcagtggcgcgatctcagcttaccgcaacctccgcctcccaggttcaagtgattctcctgcctcagccttcctgagtagctgggattacaggcatgcatcaccacgcccggctaattttgtatttttagtagagacagggtttctccatgttggtcaggctggtcttgaactcccgacctcaggtgatctgcccacttcggcctcccaaactgttgggattacaggcatgagccaccacgcccggcccctgttttttatttttacttttttttttttgagacagagtcttgctgtgttgcctaggctggagtgcagtggcacgatctcggctcactgcaacctctgcctcccgggttcaagcaattttcctgccttagcctcccaagtagctgggagtacaggtgcctgccaccatgcccggctaattttttttgtatttttagtacagatggggtttcactatgttggtcaggctggtcttgaactcctgaccttgtgatctgcctgcctcggccttccaaagtgctgggattataggcgtgaaccacctcacccggccttaaaattttttgtagagactggagccttactattttgcccatgctggttttgaactcctgggctaaactggtcctctctccttggcctctcaaagggctgagattacaggtgtgatcccctgtgcccagccaagggtattgctgtactgctgaggctggagtgcagtggtgtgatcattgctcactgcagcctggaacttctggcctcaagcaatcctcctggctcggcctcccaaagttcggggatgatagaggtgagccatcagacccagctgaattgcatactttaaataaatgaattctgtatctccaaaaggcagagttatcaccttcctatactgtgttggccaccccctcaaatgtccaacgtcaagtcctcactccccttcaccctaaattcccgtgggaaatgcccctccttctaagcccgcacagttacaaacatgtacccgggtcctctggtggtccctgtgcaattacttttcctcacgcaatttccaccaaccttcaggataacactatggttaaccccattaaaaaaaaagtttccaatgtgatttttttttttttttgagacggggtttcactctgtcacccaagctgaagtgcagtggcacaatctcggctcattgcgacctctgcctccaggttcaagcgattctcatacctcagccatccgagtagctgggattataggggcctgccaccacgcctggttaatttttgtatttttttgtagagacagggtctcaccatgttgtccaggctggtctcgaactcctgacctcagatgatctgcccaccttggcctaccaaagtgctgagattataggagtgagccactgtgcctggcctcaatgtgattttttaaaacaaggctaatcaggtgaagcagtgggagtggagaaaacaaaacaaaacaaaacaaaacaaacacatctgcaacgggttgagacaattagttgtaaacaccactgcactcagaccagctcctgttattttttttattgcagtaagatatatataaaacattgcccatcttaattaatcatttttcagtgtgcagttcagtggcattcacattattgtgtaaccatcacaccatccatctccaaaactcctttttttttttttttttttttgagagtctcgctctgttgcccaggctggagtgcagtggtgcaatcttggctcaccataacctccgcctcctgggttcaagcgattctcctgcctcagcctcccgagtatctgggattacaggtgcgtgccaccatggccggctaatttttgtatttttagtagaaatggggtttcactatgttggccagcctggtctcaaactcctgacctcgtgatccgcccgcctcgggctcccaaagtgctgggattacaggcgcgagccactgtgcccggcccagaactcttttcatcttctaaaacccaaactctgtgtccattaattaactccccatgcccctccccccagcccctagccccgccaccgttcttctttctgtccctgtggattgggctcctctaggtgactcagatgtggaatcactcagttcttgcccgttcagcataatgtcctccaggttcatccaagtcgtagtgcgtgtgggtgctttattcctctctaatgctgaataatttttcatgttacccctatttttttttttttttgagatggagtctcactctattgcccaggctggagtatagtggcatgatctcagctcactgcaacctccacaatccgggttcaagcaattctcctgcctcagcctcccgagtagctgggattacaggggtgcgccaccacgccagccaatttttgtatttttagcagagatgggttttgccatgttggccaggctggtctcaaactcccgacctcaggtgatccacccacctcagcctcccaaagtgctgggattacagccgtgagccactgtgcacagcccatgttaccccatgttaaaaggaggggacattggctgggcgcagtggctcatgcttgtaatcccagcactttgggaggccgaggcgggtggatgacaaggtcgggagatcgagaccatggtggctaacacggtgaaaccccgtctctactaaaaatacaaaaaaattagccgggcgtggtggtgggcgcctgtagtcccagctactcgggaggctgagggaggagaatggcatgaacctgggaggcgaagcttgcaatgagccgagatcacgccattgcactccagcctgggcgatagagtgagactctgtctcaaaaaaaaaaaaaaaaaaaaaagaggggacattgaggcaacaaagctagggggtggcagggtcagaacgcacatcaaggttggtctgactcctgtacccgccccaagtgcccggccacctgacccctcccacagggccacccctcccatcccctgggccaccctcctcccgctgtgttccattctctcctttgggcttcatgtagcagttggtggagcccagaagtctttgtgaagtgaatggacttgggtgcccggctgggggtcaaggtgggtgggtcctggctgtgtagccccctgggtcagactgcctcagactcagcctctgctcagtcaaagctgctcccatgaccaggactgttccacagagttgtgcaggttacaacctatacacctgtacgtaacagccctgccaaccatcatgatagccctggagattcccaaatccaggaggcctcagggctctgcttcgagaaggggcaagaagcaacacaacgtagaggccacccgggacgaatgagatgtcccccaggaagcagataaacagatggatggtttccaggggctgcgggaagggaggaaggaggagtgacagcttcatgggtatgagtttccttttggggtgatgaaaatgttccaaaactagaaagtggtgctggctgtacgtgcatcttgtgaatataccaaaagccagagaattgtacactaagaaatggttaaaatggtaacttttgtgttatgtgcattttttttttttgagatagagtctcgctctgtcacccaggctggagtgcaatgacatgatcttggctcactgcaacctccacctgctgggttcaagcaattctcctgcctcagcctcctgagtagctgggattacaggcatgcagcacactaagaaatggttaaaatggtaacttttgtgttatgtgctttttttttttttgagatggagtttctctcttgttgcccaggctggagtgcaatggcatgatcttgactcaccgcaacctctgcctcccgggttcaagcgatcctcctgcctcagcctccccagtagctgggatttcaggcatgcatcaccacacccagctaattttgtatttttagtagagacgaggtttgttcatgttgatcaggctggcctcgaactcccaacctcaggtgatctgcccacctcggtctcccaaagtgctgggattacaggcatgagccatcgtgcccagctgatttttttcttttttttttttttttttgagatggagtctcactctgttgcccaggctggagtgcagttgtgtgatctcagctcactgcaccctccacctcccaggttcaagtgattctcctacctcagcctcctgagtagctgggattacaggcatgcgctaccatgcctggctaattttttcatttttagtagagacaggtttttgccatgttgtccaggctggtctcgaactcctgacctcaggtgatccgcccacctcggcctcccaaactgttgggattaccggcatgagccactgtgctcggaccattttgccacaataaaattaagctggggaccgtaccctgcttactgcatcttcttcagcttcagagccatcccagggcccattatgtattccagggtcttaacccccattctcaatgtcacactgagccattcaactcaggacattcccagcaggatgccttccaggaacatctgcctttggatggggtccagagttttactcaaacaaatgcatcactaatggttgaatcttctctggcagtggcccatctgctgggaagacattcagagacatgaggtggtttctggggttcccaaaacccacctccacaaaaggcagcattggctgggtcattcttgcagggcaggtgggaagcagcagatagaggctaaagatcctgccctgggactgagttcatgcccagcacccctggggaatcagcctatccttgcagcgccttcttgtcctggagccagggtgcctggagatcttgcagttcagggcttggaaatcacatcttcccggagcatcagctgcagctctaggagaagaagtcattggagaacgagagtcctgggtatgagttccttactagctgtgtggccttgggcaagttattcagtctctctgtgccttgtgccttagtttccctacgtgtaagatgaggattaaaatagttttgactgtatatgggcttttaattgagatgaaagccacgtaacagaaaattaatcattttaatattgtggccccaattcagtggcatgtgcatttgcaacgttgtgcaaccaccacctctatcacattccaagacattttcattgctctggggttgctttgaggattaaatgcattcgtgtttgtaaagctttagaatggtgctaggtatagtaagcgccaatggagtgtcaacaagtggtaggaataattagtagaacagtaataataggcaactgggccaggtgtggtggctcatgtctgtaatcccagcactttgggtggctgaggcgggtggatcacctgaggtcaggagtttgaggccagcctggccaacatgatgaaacctgtctctactgaaaatacaaaaattagccaggtgtggtggcaagcgcctgtaatcccagctactcgggaggctgaggcaggagaattgcttgaacctgggaggcggaggttgtagtgagccgagactgcgccactgcactccagcctgggcaacagagcaagactccacgtaaaaaaaaaaccccaaaacccaaaaaaagctggagtgagtgttggtggcgttattaattcccttccctggggctggaggaggagggagtggggttctcactcccctccaggccccagtttccactttgagctctctgtacccgcagggctgtcacacctctgtctcccacgcagtcattgtcctccctcaatgttgggcagcaggagaggcggacttaacgcctttcgtggtggtaacagcagctaacggtgttaacgttcactttgctctgtggcgatgcctgggcagagctgggcatttcctggatgagcccgggttaggacagtcatccctggatcccatgtcccccacctactcacccttgtgttactccaggagccatgggctatcatttgctgccaccttgcgacagggatgggaactttgtgtcccatttccgcccttgattacctaagccaagagtctgctgggcacctgctgcctgcctgccaggtccccagtaagatccttcccaacatgcgggcagctgaataaggcagccactgcccctgccctcagggagctcacagtctcctgagagagacctccaggaacccacagatatataaaacgaataaatgcaatattagaatgtgatgcaggctaggaagggaagagaggtgattttcacagggtgcagtgacatacttgaaatatatcaggggttgtccatctccctggccacctctgacttcccctgcttgaaggggtgaattcaccccacggtggcacgtagtaggtgctcagtaaatgttgaatgagtgaatacatggatgacagcactgtccagagccaatttcttgggtcttgtaggctaaacagatgaggagtggcaaggcaggacttctgggagcaaggttggtcccctgggagtcctgggagggctgaaaggggttaagtgtgagttaaaatgagagtgatggacaaatgtcactctcccaagggaggcccccttactccctgttttatttatttatttacttatttattttgagaccgagtcttgctttgttgcccaggctggagtgcagtggccaggtaacagctcactgcagctttgaacttctgggctcaagggatcctcctgcctcagcctcttgagtagctgggaccacaggcacgtgccaacacgcctggctaattttttttttttttttttgcgacggagctttgttcttcttgcccaggctggagtgcagtggcgcagtctcggctcactgcaacctccgcctccttgattcaagcgattctcctgcctcagcctcccgagtagctgagattacaggtatacgccaccatgcccggctaattttgtattttagtagagacggggtttcctcatattggccatgctgttctcgaactcctgacctcagctgatctgcctgccttggcctctcagtgtgctgggattacaggcgtgagccaccgcgccctgcctaaactaaaaaaaaatttttttgtagagataggttcttgctatgttacccagggtggtctccaactcctgggttcaagcggtcctcccgcttccgcctcctaaagtgtttggattacaggcgtgagacatggcgcccggcctcttacctgttttaaattgtcctttctctccgctggctccttgagcccctttcctgcttatttttctctcgttagagtttttcactacctcacacatcatatatttgccttatttattgagtgtctgtctccccaccgtagtataaactccacgagggcagggattcgtgcgtgtggctcaccggcggctctccagcgcctggacagggctgacccccagcaggcgctctgtgaaggtgtgcagagtgggcgaaggtgcatgcgcgggccgtggggcggggacaggtggaggagccagtcagacccaagtgcagcgggacgagggcgaggttaatctgagcaagaaaagcgtaaattctgcttatctacaaatgtaaacagtactgtcggccagacgcagggtccggggcgggtcggcccggactcagggtctgcttggaggcagagctagattagggcggggtcgtcctgtggcctaccattccccgaggctgagggccttggagggcggggccagtgaagggggaggggacttcctgaggtgtgaccaatctagagaaaggactgggctgagggcgtggtcaaacaagcgacatctaaaaataaggggcggggctagaaccagggggagttcgcctggggcggggccagagtggggcgggaccagttagggggcagggccaacctgggcggggccatggccggggacgtgggcgggaccaggtcaggggcggggccaggccaggatctccgctgtcccgggtcctggagctctctcggcccggcaggtttcgctcccgcccctccggccttccacagctgtcctggccgcagggtgttcaaggcgggacacaccaggctagagatccgcgatcgggccccgcctcaggtactgcgctccaggccaggcgggcgcgggtaagcgctcagctcccgagccaggcgggcttccagggcacttcccctaggctgcattcccaaaggctcccgagggcgagggtgagcaaagctgcggggacctgtgtgtgcatgcgtgtgcgattgcctctacgtgtgtgtacgtgtgtgtgcatgtgcgcacgggtgtgtgtgcgtgtgtgcacgtctgtgcacaccaggggaattgcgtgcgtggagctgggcaggtgcgtgtttcagggtgtgtgtgcaaagttggaggcgtgtgcaaaagcagtcccgtgtgggagggaaacctgcgtgtgtacatgtgtgtgatagagacagtgcctgtgaaatgtggtgaaggctgtgtgtgtatgtcagggtgtctgggaggaaaatgggagggcaggtgcaaggagactcgggggtgggctgtaggccagcaagtctgtggcaagctgcggggtgcatgcgtgaatagaaccgtgggagtgtaagaattgcaaatgtgtgtgtgtctgtgtgggtggccgtaaggcttctgggggccctcagtgtgaaggggtgggggtagaggaaagtttgggggtgctgactgctcttggaaggctgagcgtggtctggggccatggctaatgacagggaagctgttggggcttggcctggagtaatttggggggaatatcagccttctcaatttgaaggctggggagctgtgtgggtggggccaggggctgccccttacacttggtgggtggtgtccctgcttcccgaggtgggagctgcaacctcaccagtcactcctcgccccaggctctgtgcacacccctgcctggtgacctccattggtgctccagcgtgaacatggtgcaaagataccagtctcctgtccgagtctacaagtacccgtttgagctggtcatggcggtgagtgactcctgattcttgggcccccatgtgacagttggaggggcttgagatcagctatggcggtaggaagacggagctccttagactcccagatcagaaggaattagtgagttactcagctgacctggtgggtttaacttctatccagtgacctctctgtccaaccatcctatcctcggcccagtgaccaaaacacaaagtctttcttccttctccttgttgaagctgacctgctcccttactttagactctcctgatagaaaacaaaggtatcaggggccaagccactgctgtcatttcatataatggcatatcacagtgataaatggaatggtggtgataatgacaacagctgtttattgaatgtttacagcactgtcttaacagatgatgtttcttccaattcccgatagctgttattttcccatgtaacctccatgaaactgaggctttgacaggtgaagggatgacactaagttctgtatctacgcagaggtggagtcggggctgagatccccacaaaggagactctagaacctcacatttgaccacagagccctccttctgctcacagacccccttccctcccctttaaggaagctgacactgggacgagagagagaatgagtgggtaggtttgctttgtgatgtactctgtgttgtgcagcaagtcagttggaggcctagaattggctgccagatccttggcccccaggatcactggtcttttcaccctgggggcagaagctggacataggtggatgtggaattccttcttggctgcatccctctgcctctgagcacttcacttccctgctcagtaacatggggacaatgctacaaggttgcggggaggagtaaatgagatagttcttggtgctccttgctgtgtgccgggcacacagtaggagctcacaaaatatgctgtcgctgttattacaccgaagtcttgtaaattaatgtattgaaagtgtaagaaacattagcatccacccccatctgtcccaccccagcactgactgcttaaccccagccttctatccagggactttcatatctcttggtggctgtgtgtgcctgtgtgtccagtcctgtcttattctatgaatctacatgcgtatatgtttattgtcacacagaggatttaaaagcatcaccaaaatcatccacataccttgtgctgttacaggcagatggttctaggacagcaaagaggcaggaactggcttagggtcatattctagctccccaattgacgagctgagtgactgtggggcaagtcacttcacctccatgagcctccactccccatcaccaatgggaatctcctggcttccaaatcctggtgtcatgctgtggattaaatgagtcaatgtgtataaagctcctggtacggggctgacgcagatcaaatgctcactgagatccagctatgatcgttactgtttttgcaagtgcctgagtgactttgcttctgcgtaatgggagtggaacaccaggggatggtgaagagatccagggacgtgaattcagatgctttagggttctgctgtgctctgccatgctctggttgtatgtttttagaaagttgctgaacttaagccgggtgcagtggctcacacctgtaatcccagcgctttgggaggccgaggtgggtggatcacaaggtcaggagatcaagacaatcccgtgtaacacggtgaaaccccaactcaactaaaaatacaagaaaaattagccgggcgtggtggcgcgcacctgtagtcccatctactcgggaggctgaagcaggagaatctcttgaacccaggaggcagacgttgcagagagccgagattgcgccgcaacactccagcatgggtgacagagcgagactccgtctcaacaacaacaacagcaacaacaacaacaacaaagttgctgaacttttctgagccccattttcttttactttttccagactgagtctcactctgttgcccagactggagtgcagtggtgccatcttggctcactgcaacctctgcctcccaggttcaagccattctcgtgcctcagccccctgagtagctgagattacagatgcacaccaccatgcccaggtaatttttgtattttcagtatagacggggtttcatcacgttggccacgctggtctcgaactgctgacctcaagtgatccactagcctcggcctcccaaagtgctgggattacaggggtgactcactgcatccggcccctattcatatagccttaagtgctatattcatgggcatggcttattttcaagtgcaatgattgtaaatattttcagaaccctaaacgtgacaaattaagttggaatttattaagcacatgcagtagatggttttccatcctatagttaatgtgtctcagattcatggcagagaaccatgggtccttggactgtcagagaagggtggggacagtttctctcttcttatgaatgaatgaacaagtgcttgggtcttagaacatgtgagctgccagagccttaaactaagggtgattatttatgtttatcgaccacttattgtcacttggtaggactgggccctgtgcgaggcaaacagacacacacacacacaatcacttttcatcttcatgacaaccttatgaggcgcatataggcatacagtcatccccatttcacaaatcaagaaaatgggggctgggtgcttattcatagaataagacaggactggacacacagtcctgcactcgagcctgggcaacagagcgagactctgtctcaaaaaaaaaaaaaaaaagaaaaagaaaaaaagaaaagaaaacaaaaacaacagaaaaactatatgaatagcactagtaatgtactcgcattgcctgtattgggtatgttaaacatattttgtaagcttcaggttccacaaatgaaggcacggctccatttactcccttcgctgttgagtctctaggtactgacacctgtgggtagagtgaaaaaaaggctttcaaatctatattatctgtggccaggtatggtggatcatgcctgtaatcccaacactttgggaggctaaggcgggcggaccacctcaggtcaggagttcgagacgagcttggccaacatggtaaaaccttgtctctactaaaaatacaagaattagctgggtatggtggcaagcacctgtaatcccagctattcgggaggctgagagaggagaatcgcttaaacccgggaggcggaggttgcagggagccgagatcgtgccattgcactccagcctgggggaagagtgaaactctgtctcaaaaaaaaaaaaaaaaaaaaaacttccttatctgtacctgcgttaatttaagtcatttgtattttccagagggactgccacaaccctgtcattctatcttccatacagtccttgtctgtgaaatggtcccaagccacagcaacactgccaacaaagccactttgccgactgtttacaaaacattattgtccccaaaatagctgcataactcaacgtaacttgcacactgtggaagcacaaaaggggttttctatgcttaatgttcgtctttgtttcgcagttaaacacttgccctcagattgggtcagatgccggggaagtttcagatgaactcagctattttcactgcatccgagtgaccagaaaagctggcctttcagtttttctgtttaacaaaactgacttcagaatcaaaatgctcctagcttcttcaaaactccactgacaatgacacaaatgactgaaattgggcttgagtaattgattacaaaattgtgctttgaggtaacctttctagacctggctttaaacatttttaaaaattaatactctcacttaaaaaatttatctagtcaaataaacagagatttctctccaaatcccttcccacgaattttgcttctaaagagaaggattctagggtatctttcctcctcccaactattttttttttaagatggagtctcgctcgctttgtcatctaggttggagtgcagtggcatgatcttggctgactgcaacctccgccttctgggttcaagtgattctcttgcttcagccccctgagtagctgagattacaggcatgtgctaccacacttgactaatttttgtatttttagtagagacggggtttcaccatgctggccagactggtcttgaactcctgacctcaagtgttccgcccgccttggcctcccaaagtgctgggattagaggcgcgagccactgggcccaggcttttgctcccttttttctttctttttgagacagagtctcgccctgttgctgaggttggagtgcagtgatgcaatcatggctcactgcagccttgaactcctgggctcaagccatcctcctgccttagtctccagagtacagccttagctgggagtacaagcatgcaccaccatacccggctagtttttaaattctactatataaaaatttataaatacttttatagaaatgaggtctcactatgttgcccagcctggtcttgaactcctgggctcaagtgatcctcccaccctggcctcccaaagggctgggattataggcatgagccactgcgctcagccttcctttctttcttgatagcattccgtatcattgggttcaaaacaatgagcttttattatcttggtaaacagagaaaaacaattaagacaatggaggcagctggagtatccagtgttggagagggtccgtcagtcctttgaatgcccgggtcccagaaggtgtgtggggtggtggtgtctttgtggaggtccttgcatagaggacacaaaggccatgtggctcaggtcgcctgagtcccgaaggccatgctctgcccagtccattgtgagtcgagtctaggttatttgtctcttttctcaagtgggtggtaaagaaccagggccgggcatggtggctcacacctgtaatcccagcactttgggaggccgaggcaggtggatcatgaggtttggagatcaagaccatcctgaccaacatggagaaaccccgtcttccctaaaaatacaaaattacctaagtgtggtggtgcatgcttgtaatcccagctagtcgggaggctgaggcaggagaatcgcttgaacctgggagacaggttgcagggagccgagttcgctccattgcactccagcctgggtgacagagtgtgaccctatctcaaaaaaaaaagaaccagacccacaggctctctctctgctcgaggcctcagcacattccccaattcttcttcttcactcccgacctcaggtgatcttcctgcttcggcctcccaaaatgctgggattacaggcgtgagccactgtgccccacctcttcttcttttttcgatacggggtctcactgtcacccaagctggggtgcagtggcctgatgttggctcactgcaacctttgtctcccaggctgaagagattctcctgtctcaccctcctgagtagctgggattacagatgggcaccaccacgcccggctaatgtttgtatttttagtagacatggggtttcaccgtgttggtcaggctggtctcgaactcctggccccaggtgatctgcccactttggactcccaaagtgctaggattacaggtgtgagccactgtgcccagccactataatatatatttttaaaactacctcattcaggtgtgattgacacataaaaagctatatgtctttaacgtatacatcttgaatgtgtctggtgataagaagacacctgagggtacaatatttttaaggttcatccacatcttagcatgtatagattctgccttgtttttatggctaaataaatacttcactgtgtatgaatagaccacattttctttatcattcattagttgatggatatttaagttgttttcagtttggggggactattataaatagtgctgctataaatatttatgcacaagtttttgtatgaacatattctttccaaataaatctctgttgttggccaggcgcggtggctcacgcctgtaatcccagcactttaggaggccgaggcgggcggatcacgaggtcaggagatcgagaccatcctggctaacacggtgaaaccgcgtctctactaaaaatacaaaaaattagccgggtgtggtggcgggcgcctgtagtcccagctactcgggaggctgaggcaggagaatggtgtgaaaccgggaggcggagcttgcactgagccgagatagcaccactgcactccagcctgggcaaaagagcaagactccatctcaaaaaaaaaaaaaaaaaaaaaaaaaaaaagaaatctctattgtgaatggtaccggttattcaatgggtttttgaagattctattttaaattttatttaaggccagttgtggtggctcacgcatgtaatcccagcactttaggaggccgaagcaggaggactgcttgagctgaggagtttgagaccagcctgggcaacatagggagtccccatctctaccaaaaataaaacaattagctgggtgtgatggtttacacctgcagtcccagctacttgggaaactgaggcaggaggatcacttgagcccaggagattgaggctgcagtgagctgtgatgttgctactgcagtccaccctgggcaacagagtgagaccctgcctcaaaaaataaaattaaaaaaaatgttaaaaatgttaaaaatatttaacaaactcatacacagcactgaagttccgccaccatgcctggctaattttttctattttttagtagagacggggtttcactgtgttagccaggatggtgtcaatctcctgacctcataatccgccctcctctgcctcccaaagtgctgggattacaggcgtgacccaccgcgcccggcctcttttttttttttttttttttttttgagatggagtcttgctctgtcacccaggctggagtgcagtggcatggtctcggctcactgcaacattcacctcccgggttcaagtgattctcctgcctcagcctcctgagtagctgggagtacaagtgcccgccaccatgcccagctaaatttttgtatttttagtagagacagggtttcattatgttggcaaggctggtctggaactcctgacctcaggtaatcacccgacttagcctcccaaaatgctgggattacaggcgtgagccaccgtgcccagccccagacactgctctgagtctattcacttattaattcctcatagccaccccatgagatgagttctgtgggcagcccattcgacagaggaggagactaaggagaggcttatccagggctccaaagcaaacatgtagcaggtggggactcaacttcaggcagttcggcccctcaatttacaccccaactatgagctctaccatttttcagagctggatggaggatctgaagttactgagctggcgtctgggccaagtgcatggtcccagcggaggcagttaccatcaggatgcctttaccccttcgggaccctgcaagggagaatacagcccaagcctgcaggccctggcccctggcacaccggccaagcccgggagtgtttattcagcgctacctgtggccagccctttaggccagctcagaggcaggtccattatagcagcctgatctgtagcagaagaggaaattgaggctcagcaaggtccaggagactgtccctcagtgaccagtgtttatggtcccacagagccacaaaccgggtgacttagaacaacataagttcattgcctcactgttctggaggccagaagcctgaattcaaggtgtgggcaggcccacactccctctggaggctctagaaggggatctgctcctggcctctctcccagcctcggacagttccttgacttgggacagcagaactccagtcctcacataatgactcactgtgtccagatttccgtttttttataaggacaccagtcatattggatttataaggacactccaatggcctcgcttcaacttgattacttgtaaagacctgttctccaaatgaggtcacatttacaggtaccagggcttaggacttcaacatatctattttaggggttacatttcacagctgggatttgaactcagggaatctgaccccacagccagagctcacagccagactttccggattctggctctgacttttctttctttcgttttttttttttttttttttttttttttttgacagagtgttgctctgtcgcccagactagagtgcagtggtgcaatcttggctcattgaaacttccacctcccagggtcaagcgattctcccacctcagcctcctgagtagctgggattacaggtgcccgccaccatgcctggctgatttttgtatttttaatagagatggggtttcaccatgttggccaggctggtctccaactcctgacctcaagtgaccctgaggtcacttgaactcctgacctcaggtgatccacctacctcggcctcccaaagtgctgtgattacaggcgtgaccacacctggcctccttccttccttcctttccttctttccttccttcacctctcccctccccccctcccccttcccctcccttcccctcccctctccttcccttccctttctccctctctattttattttattatatttcttttttgagacaggggcttgctctgttactcaagctggagtgcagtggtgcaatcatggctcactgcagccttgacctcctggaggtcaagtgattctcccacctcagccttctaaatagctgagaccacaggtgttcaccaccacgcctggctaattttttttttgagacgaagtttcgctcttgttgcccaggctggagtgcagtggcgcaatctcggctcactgaaacctctgcctcccgggttcaagcaattcttctacctcagcctcccgagtagctgggattacaggcatgcaccaccacgccaggctaattttgtatttttagcacagacggggtttctccatattggtcaggctggtctcgaactcccgacctcaggtgatccgcctgccctggcctcccaaagtgttagggttacaggcgtgggccacggcgcccggccgcacctggctaattttaaaaaatatttttgtagaggtgagctctccctatgttgcccatgctagtccgaaattcctgggctcaagccatcctcctgtggtctcccaaagtgctgggatcacagatgtgagccactgtacctggccttgactttccataaacatttgtgcaccagcagcagtactgtggctttaggaatgacctggtccccttttgtccagccactgcccaggtgttcctgtggggctccaaagcccagtagcgtcaggtcatctctgttttgcaaacctaaataaggaagatggcttggagtagaacttcctaagcaaaaggcttttcctgtggaggaagggttacggaggtaaggttctgtccttcagcaattacatgttaaaatatttaaagacctggccttgttgtattgttaaacagcttgtaatttagccaatgcgttattaataagaagcagcctgtgaaggtaaattattgtggcttaggccaaaagcagttacagttggattcgctgttacggaggtagttttaacaaagcggccggggccttatttaaatgagtttaaattagctccctggagcctgtcatctgatcctgttgctaacagattaaggcaagcaatgttttctaccttgaatgctgctctgatttgcgctgggagaacagaggtgatccactgccctgcatagttgtcttctgatttccgagggccctgaaataagtgtaaggccctcgtgcattcatttctgtgtgcatttatttatgcattcatgcatgtgtgcattccacaaatattttttgagtttttgctgtgtgccgaaggctgtgcgaggtggattcctagcacttctttttttctccaatgtcagaggctcaaatgtgcactgatctagtactttcttttttttttttgagacagagtcttcctctgttgcccaggctggaatgcaatggtgccatctcgcgcatggcaacctccgcctcccaggttcaagcgattttcctgccttagcttcccaagtagacgggattacaggtgcctgccaccatgctcggctaagttttgcatttttagcagagatggggtttcaccacattggtcaggctggtcttgaactcctgacctcaggtgatccacccaccttggcctcccaaagtgctgagattacaggtgtgagctactgtgaccggcctgatctggtactttttgaaatgcattgttattctgttcatttgtttccttgtttacttgtttatatgggtatttttcattaagggaagctccaggaagaaaagactgtgtctgtcttgtctggttctttttctttccttttttttttttttttgagactggtctcaggttgtcacccaggctggggtgcagcggcacgatcacagctcactgcagcctcaaccttgcaggctcaagcgattgtcccacctcagcctcccaagtagctgggactacaggcacacacaaccatgctaggctaatgtttgtatcttttgtatagaagggtttttaccatgttgcccaggctggtcttgaactgctgggctcaagtgaactgactgcctctcaaagtgttgggatcacaggcgtgagccactgcacctggcccatctggttcttttgatgtggttcctgcccttatcgagccctcagcatagtctattgggggagggggtgacagacaaatgccatgtagaaccattcatcatggggaaaaacagggcattgtaggaacacaaagaaggacccactggaggccataggagggtcatttgagccagccaggctgagagttgcggggaagcagggagtggggaggtgggggatgttaagcagggtttagcctatgcaaaggccaatggggcagaacttgtctctcaaagaagtgaactagcttaatgggaccccagtgcaagttagaaagtggctggcagcgtcatcaggggccaggaagcagagacgttggaggtctggaggcattcctgagacacttggaaaatttaaaatagtgtttcccctctgcgcaaaatcctgacataccatgtaaatgtcaagctgctctaggctggcctcgctaagtcatccgccctcccggagccatcaggggaaccagctgatcctaggagtccctgggccccgctcctgacacgtgagtgagactctgcagtgggtttgtgcacacatgggtggcacgggctgtcgttctcccagtgccggagaggccagtcattctgagggtgagtcctcatgtggaggggacacggcttcccagcccaaaagtacatccaagtgtgcagaagtaggaaccagtaagaactagacctggctgggtgcggtggctcgtgcctgtaatcccagcactttgggaggccgaggcgggtggatcacgaggtcaggactttgagaccagcctggccaacatggtgaaaccccgtctctactaaaaatacaaaaattagctgggcgtgacggtatgtgcctgtagtcccagctacgcggggggctgaggcaggagaatcgcttgaaccgggaggtggaggatacagagccgagattgcaccactgcactccagcctggtgacagagccaaaaaaaaaaaaaaaaaagaactagctgactttggtcctgttgcagccatgggttagggaacttgttaaaaacaggcaaaactggccaggggcggtggcttacgcctataatcgtagcactttggaatgctaaggcaagaggattgtttgagcctaggagtttgagagaccagcctcggcaacacagtgagaccttgtctctacaaaaaattaaaatatgaactgggcatggtgatgtgtgcctgtaattccagctacttgggaggctgaggcaggaggatcagtggaggccaggaggtcgaggctgcagtgagccgtgatcttgccactgcactccagcctgggtgataaagcaagaccttgtctcaaaaacaaacaacaataacaacaacaaccaaaaaaactggcaaaactctccctctccagctttgttgttcatggctgattcattgtttaatccctgtggataaaccctgttctgacaactgagggggagttactcatttattcacctgcccaataagtatcttccagaacctagctctctgaaggtagagctttgggctgcgcacctgctgatgtcccctgggagtgtagatgtaggtccactcactctgagactagggagaccggtacttatgtgacttaatctcccagggatatatagaaagatggttccattttcctattttatttccctggcacctggccattcactcattccttcctcctttcattcctttgagaaatattggctgaacgtctacaatgtcccaggtgttgtacaaggcaccagggaattcagtggtaaatgaaacctacatagagacggtggcattgagactgtaaacaaacaaacgcagacataatgtcctattccaaaccatgacaaatgcttctgatagggctgtagaccatctaggaggtggcttattctttttttttttttaattgcccgggctggagtgcagtggtgcaattatagctcactacagcctcaacctcctgggttcaagcgattctcccacctcagctacctgagtagctgggactataggtgccaccgaacctggctaattttaaaatattttgtggagataggggttttgctgtgttgcccaggctggtctcaaactcccggcttcaagtgatcctcttgccttggcctcccaatgtgctgggattataggtgtgagccactgcacctggcttcactctatagttttttattgtgatgaaatacacgtaacataaaacttcccatttaagcatcttaagtgtacagttcagtggcataagtacattcacgttattgtgcaactgtctccactgtccatctccagaaccccttcatcatcccaaaccggactctgtacccatgaaacactaactctccactccctgctccccactgctgctattaaccactattctatttgctgtctctgcaaatttgaccattctaggtacctcatagaaaaggaatcatacaatagttgtccttttgtctctggctcgtttcactggacacaatgtcttccaggttcagccgtgtcgtggcaggtgccaggtgcctcactcctctttaaagctgaagaatacgtcattgtatgactccatcacctttcatttatctgttcatctgttgatggacacgtgggtgttttcccccttttgatcattgtgtaaatgatgctgctgtgaacatttgtgtacaaatatctgttttaagtctccattggtttgctcttgtccattaagaaaaaatcaacaatgtggtacctggcattgtccctttaattgctgcagcaactccagagcccacactcttaatggcagtgctatgctgttgctcattcattcgtcctgtaaatgtctattgagtgttgactatgtgctaggcatttttgcaaagcactgcaaattcagggatgtcaggggctggtgatgctacttcagcagttgtgatgtgtgaaggaataaaacaggcatacatgagtcagcatccttttcctctttttttctgagaaaaactgagcctcagagaggttgctttgagagcatccagctgtcaagtggcagagctggggtcacatgttgaccctgtgctgtgtctctgcccctcccccacgcgccgcccttgtcctgtcactgagtccaggtgccctggctgcagacgctgttctgaccctgtgtctccatctcatgtgtgtcccgggctggctttgctgggatgagcagtggcttttcagctccagggccatctgggtacagctgcaatgatggattgtctgcaacagtcatgtcagggcttccggaacagtgtcagcctggttctgccaggcccacttcccttcatcagctgggtgacactgctgccattggatggctgatgactcattcagcaagctctagttgagcacccctacgaaaagttggggggtctaccccatggcacagtcttcagaagtgaaaaggaaggaagcactgatgcacgatgcaacacagatgggctgaaaacattgtgctgagtgagagaggtcagaggcagaaggccatgtcttatgtgatttcttttttctctgtctcttttttttttttttttttttgagacagagccttgctctgctgttcaggctggaatgcagtgaggcaatctcagctcactgcaacctccacctcccgggttcaaacgactgttgtgcctcagcctcctgagtagctgggactccaggtgcatgccaccatgcccagctaatgttttgtatttttagtagagatggggtttcgccatgttgaccaggctggtcttgaactcctcacctcaggtgatctgccccctgaggcctcccaaagtgctgggattacaggtgtaagccacctcaccaggccttatatgacttcatttcttggaactatccggagaagggaatacatagacacagaaagtagatgagtcggatgagtggttgtctaggactggggtggcaggggagggggcggagatggggttgacttctgaaggatacagggcttcttttgaaggtgataaaaatattctggaataggtattggtgatggttttaagttcatgaatgtactgaatgaaacacactggactgcatactttatattttattttttgagacagggtctctctgttacccaggctggagtgcagtggcaggatcatagctcactgcaatctcaagccatcctcccgccccagcctcccgagtagctgggaccacaggcacgcaccatcatgcctgcctagttttttatttttatttttagagatgaggtcttgctatgttgcccaggctggtcttgaacgcctgggcttaagcgattctccgacctcgacctcccaaagtgctgggattacagggtgagccaccgtgcctggcctgacctgcatacttaaaaagggtgggctatatgatatgataattatattttaattttttaaaaaaacatttatttttatttaaacagtttttggggtacagcttttttttttaacatggataaggtctttagtggtgatttctgaaattttagtgcacctgtcacacaagcagtgtacactgtacccaatgtgtagtcttttattcctcactccctcccagtcttcccctcccaagtccccaaaatccattatatcattcttatgcctttgcatcctcatatatatatattttgagatggagtctcactctgtcacccaggctggagtacagtggtgtgatctcggctcactgcaacctctgcctcctgtattcaagcgattctcctgcctcagcctcctgagtagctgggattacaggtgtgtgccaccatgcctggctaatttttgtatttttagtaaatatggggtttcaccatgttggccaggctggtctcaaactcctgacctcaagtaatccgcccacctcagcctcccaaagtcctgggattagaggtgtgagctaccgcgcccagcttgcgtcctcatatcttagctctcacttataagtgagaacatatgatatttggttttccattcctgagttacttcatttagaataatgacctccagctccatccaagttgctgcaaaagacattattttgtcacgcctgtaatcctagcactttgggaggcggaggtgggcggatcacaaggtcaggagatcaagaccatcctggctaacacggtgaaaccccgtctccactaaaagtacaaaaaaattagctgggcatggtggtgggcgcctgtagtcccagctacttgggaggctgaggcagaagaatggcgtgaacccgggaggcagagcttgcagtgagtcgagatcatgccactgcactccagcccgggtgacagagcgaaactccatctcaaaaaaaaaaaaaaaaaaaagacattattttgttcctttttatggctgagtagtattccgtggtgtatatataccacgtttctaaaatccacttattggttgatgggcgtttgggttggctccatatttttgcaattgtgaattgtgctgctataaacatacatgtgtatgtgtctttttcacataatgacttcttttcctttgggtagatacccatatttcaattttttaaaaaagagttggaggaggtgagtagattgatatcacatctgtgctgaggtcccctagacttgcagggggaaggaaaggggttgatagggagactcctgaagagtatgacaggcgatgggggcaccttactcagtggctgcgtagtggccaggcccccaaatcaggcctgcagaatagaaaagggaagggagagcattgggctggaagatgttggtgcagcttggatattctttctgcattcttactggacgttttggcgtaagtggcattccagcttcctttgaatttggatgaggaagaacaggaaggaaggaaggaggggaggagggatcatctgtcaagtgattagcagaaatagctttttgtactttacagaatctcactcatttttaaaatttaaatttacttaaatggtgatgtagaatgaaccatgtgccaggcactgctctaagcacattgcatgagctgactcctttattcttctgacaagtagcaaggtagctacttttcttacttccccttttacacacaaaggaattaaggaactgagagcttgatgattttttcacacagctgatgagaggcagagcagagatcccaacccaggccccagagcccactctcttaagggcggtgctatgctgttgttcattcattcatcctgtaaatgtctattgagtgtggactatgtgctaggcattttgcaaagcactgcaaattcagggatatcagcggctgatgaccctatttcagtagttgtgatgtatgaagcaataaaataggcccacctgagtgctagttgggaggttctatgattattgcactttacaaatgaaagaggggttacccagcctggaattgggcaagtctgggtgggaattcagggctatttagctccagcctcccatctccagatgctaattgtgtcaatatggattttccaggatggggacccgtaagaggcagccctgcttggtccctgcctgccccactgtggccctgcagctgtgggctctgggctttggaccatctccttttctgagcaggcaggcttggatgtcctctccagccacctggcagaagggctgtaactgaatccttctgtggccttgtgttcctgagagcaccaaaccatgtgtttgtttagcagggagaggctcaggtctcatttgtgggtggtcaagccaactgtagggacaggagccggcagctgaggctcttaggcagggacaaaactagtggtgtgagctggtttccaacacagaaaggtcccgtcagctgtttgatcccgtaggaccttgggaggtatgaaaggcacaggggctgggccctgtttggtctctgccagggcctctcccagggcagggtgcctgcggcccacagtttctcaaggtcacagcaatgtttaacaaggaaagaaaataaatgtaattattccagaatacaaaaagaaacctgcaggcccaggtgcagtggctcacgcctgtaatcccagcactttgggaggctgaggcaggcagatcccttgaggtcaggagttcgagaccagcctggccaacatggtgaaaccccatctctactaaaagtacaaaaattagttgggtgtggtggtgggtgcctgtaatcccaggtacttgggaggccgaggcaggagaatcgtttgaacccaggaggcggaggcggcagtgagctgagatcgtgccattgcactccagcctaggcgaaagagtgagactccgtctcaaaaaaaaaaaaaaaaaaaaaaaggaaaaaaaaagaaaagaaaaagaaacctgcagagttaaaatgaacacatgctgaattaaatgcctaccaagggcaacttcatgccaggctgtcatctggacctcaactgtgatgagctcatgtatatgtaaatcacggaaagtggatgcattttaatgtgtgtgatgtgattgacatgggtagagcccaggacctgtgaaggcctcacaaccatcctgcgaagagaggtgctctataaccttccggggctccctggtcccttctaggtaaggtccctctccacttggcaggcgtttgaattttattcagccagtgtttttattttatttatttatttattattattatttttgagatggagtctctgtcgctcaggctggagtacagtggcatgatctcggctcactgccacctcctcctctcaggttcaagcaattctcatgcctcagcctcccgagtagctgggattacaggtgcgcaccaccacgcctggctaattttttgcatttttagtagagacagggtttcactatgttgtccaggcttgtcttgaactcctggcctcaagtgatccacctgcctcggcctcccaaagtgctgggaggataggtgtgagccactgtgcacagcctttattttattttttaaagaaacaagatcttggccgggcgcggtggctcacgcctgtaatcccagcactttgggagggcgagacgggcggatcacgaggccccgagatcaaaaccatcccggctaaaacggtgaaaccccgtctctattaaaaatacaaaaaaaatttgccgggcgtaacggcgggcccctgtaatcccagctaacttgggaggctgaggcaggagaatggcgtgaacccgggaggcggagcttgcagtgagccgagatcccgcgactgaactccagcctgggcgacagagtcagactccgtctcaaaaaaaaaaggaaaaaaaagaaacaagatcttgctctgccacccaggctggagtgcagtggcataatcatagctcattgcagccttgaccttctatgctcaagcgattctcctgcctcagccacctgagtagctggtattacaggtacgtgccaccacacttgggtaattttcttttttaaaaatatttatgtatttatttttgagatggagtctcgctctgtcacccaggctggagtgcagtggtgcaatctgggctcactgcaagctccgcctcctgggttcaggccattttcctgcctcagcctcccgagtagctggaactacaggcgcctgccaccacgctcggctaatcttttgtatttttagtagagacgggtttcaccgcgttagccaggatggtctcgatcgcttgacctcgtgatctgcccgccttggcctcccaaagtgctgggattacaggcgtgagccactgcacctggttaattttcttattttatgtagagatgaggtctcactattttgcccaggctggtctcgaagtcctgggctcaaacaatcctcctgccaggattacaggtgtgagccacttcacccgacctcagccagtgtatttaatatcttctccaagtcagatgcaggaaggggatcttcaggcaaagaggctggaccctcagaggtgcccatggtcaagctggggagacagacacattttcaaatgcatggggactgtctgaggaacaagggcacagggagggtcagaaatgggttgagtatgagctgagggtatgaaccaggcttccgtcctgtgtgggagtgtcttgagtgttgggctgtccttcagagatcaaggcactgtttggttctagaagcaacacagtgcaccaaccccatggtctgactgcaagggggtcaaattgcagcttgatccctcacaagctgtgcgactatgggcaagtgacttaaactctctgagttttggcttctccatctgtcaaatgcggagggtgagcgctacctacttcatcaggagcagcacacggtatgcagtgagcccagtgtatgcctcggctattgccattactgcaatgatggttaggcttgggcagctgaaaattgtccaaatgtgtccttttggtactcatcggcaccttttggtcatctgaaattaaaggaaagttttctgcctgaccagccacccgctataaacattcaccccaggagaaggcaaggcagttctcccggggcctggagatgaggcattgattgtccctggagagcccttgcgctgggaggagctgcttttcttgctcctgtcattttccctgcagcaggaggatgaggtttgaaagcagcagacagaacctgaggttggtttctgccgaggtccctccatccccttccctgcatccccttctctgccatccagggaggtgaacctccttctcatgccccaccggccccatcctcagcccaccccgatcctcacttctccaggtcccctgctttgcgagttacaggccagtgggactcagcatttccaagccaccgatgcttgtgacgtagccagagattctgaggcaggacacagtgattcagggttgtcgtctgggtcagacaggctcatgcgccaatcccaccactccccggccatgtgctgctgggcgagtcactctgtcttcctgagcctcaacttgctcatctgtaaaatggggaaatgctagttcccatctcaccagggcattgtaaggatgaagcgaggcagttaacactttataaagtccttaacaacagtgtccaacaatcgtgaaagtcctctgatgctggacaactggctctgggatggacgccttccagacggagcctcagctcgaatgtccccccgaaacatgtggctctgtcactggatactgggagaagtaccttcctttcctttcgaagtcagagaaagtcatgccccagcagaccagcctcccctccgtgcctgttatctgggggctccagaccgggcctttctaacaagaggtttgttaggatgggaagtgagtcaggaactctggcctttgactggctgcgtgtgctgagtctgtggctttatcccctccctgacaccctccttgaggctctttgggccaagtgcgtgttatgttcttctttgctggttagcattgttagcgccaagggtgtgccgaggaccaagcccggcacaggtatgaggttgtgctttggaaaagcaggcgatcctccttcacaagtctcctgttacaaggcacgataaacgctttcaaagaaataaaatggtaaaaggaaggagaactgaggaagaggcagtcgtgcctaggagggggaagggagggtgtcccgggaagaaggaccagcatggatgaggccctgaagcctgagcgtctccttggcccaaatccaggcctcctacccctccagaaagccccatgtctcatgcctcccatccccttcactgtcaagaaattgatcagcgttccaagcatctggaacagcaagtgcaaagtccccatggcagggacacgtcgatgtattgttctaaacgcagcaaagctggcgtggctggagccagatgagggggctgggatgggaggtgggtgggcagggcagatcacacagggcccgaggaccaccataaagagtgcaggtttattctcggcatcaaggcccgttctttctttctttatttatttatttgagatggagtcttgctctgtcgcccacgctggagtgcagtggtgcgatctccactcactgcaatctctgcctccctagtagctgggattacaggcatgcaccagcacgtctagctaattggttttttttttttttttttttttttttttgtatttttagaagagatggggtttcaccatattggccaggctggtcttgaactcctgacctcaaatgatccatccacctcggcctcccaaagtgctgggattacaggtgtgagccaccgcgcctggtctcgtcaaggcctgttctgtgtatatcctcccccgaaatcatttcgtttgggaaacaggagggagactgagcagtagaaggaaggggagaaggtcaggggtggtgtggccgctgcctggcaggattctgaaggacagagggtggaaaagggaggagaagatgtgaccgcttggcccggggggacagtgcctggctctgtttctgagctgcccatgacaacaagcccagctgctgagcaaacggttcttggagggagtggggactgggcccaactgggattcaaatccaggttcaccatcccgtgctgtgtgacttggggtaaattagtgagcctctctgggcaagtacatgagacatatacgcactttccaaatgatgaaacaggcccagagaaaggaaggggcttgcctcgctggaaggaggtggagctggacttctaaccaggcagtctgaacccctccagcctccactggctttactctgctctctgtcctccgtggggagatgatttcctttgaaagtgggtccagcgtggctgagatctacagggcagacacagttctcagggggtctccttgccagctcgctgagtccagaccccaggatccccatggtgcattctctgggggaacgaggcctccctattccaacgctgatgtgtttgtcgcagcaactgacatggagatatggcaggaggcagctctgtcctcctggccctggtggaggacaggcaggctggccttgcccagcctggggtgacaccaagggctcctgggcatgtatccatttcttcctcggcccccccctccccccgcctctcttcctgggagccaggagggaagggggaggaggtgtctgtcctcagatgccggcactatttttggagcctgccttgatcccaattccggggcacgtgggctgtgacaggcgctaggagcagaccccgctggaataaggaataaggtcagccacagatgctgggatacgcccccaccaccctgaccctggcccttctagaactgggcacggacccttgccctccctgagcgtaggttcatgggcttgggggcccctcaagctaccttcacccagctctacacccccgcctgggaggacctccgcccgcacagaagcaagcagccccagcacagagcctggggctgacctgaattggctccgaggacagtgaggggcccttccctgtgaagggcacagtggcatggaatccagcttaacctcctgtgctcgtggccaaatcctgtgtgagacacacggagagactgtggaggaaataatcctggccatcccttctccagcacccacagcagtttgctcagttctcaggacgactgtgtgcaacagggcactgagaggttaagtaacccacccaaggtcacacagcttgtaagtggtagagctgggatttgtacccaggcagggctcgagtctgtgctgtcagccagggtgagaccctctaatggctcacaggaagcacattactgaatatttacatgaacatatacaaaaaaaattatgtaatagatatattcatatataaaataaactccttaaactactcatatatttatttatatatttatttttattttgagatggagcctggctctgttgcccaggctggagttcagtggcacgatctccgcttactgtaacctctgcttcctgggttcaagcgattctcctgcctcagcctcctgactagctgtgattacaaacatgtgccaccatgcccagctaatttttgttgttgttgttattttttagtagagacagggtttcatcatgttagccaggctggtctcaaactcctgaccttaaatgatctgcctgccttggcttcccaaagtgttgggattacaggcatgagccactgctcacagcatgcccatatatttatatatggaatatattatgtatccatatatgaaataatatatttacatgggtacatttatatatacattatatatttatagatatgtatagatatgatctatatttatttatattctatctatgtttataaaattatattatacagaacaccttatatttacattgtgtatagaaagatatatgcacactatataaattgtgtatatttatattaacatatattcatatatatttatatatacacttaaataatatatgtatacatgtggccaggcgcggtggctcacgcttgtaatcccagcactttgggaggccgaggtggacggatcacccgaagtcaggagttcaagaccaacctgaccaacatggtgaaaccccgtctctactagaaatacaaaaattagcagggtgtagtggcgtgtgcctgtaatcccagctacttgggaggctaaggcaggagaatcgcttgaacctgggaggtggaggttgcagtgagccgagatcgcgccattgtactccaccctgggtgacaagaacaaaactctgtctcaaataaataaataaataaataaataaataaataaataaatagtatatgtatacatgtggattcatatgtgtgtatgtgtacatataaacacatacacttggagagagaaagacacttttttaaagaaacagttttattgagatacaattcacatatcatacaactcattcatttacagcacataattcagtggctttcagtagattcataatattgtgcaagcttcaccgcaatcagctttagaatagtctcattacctcgaaaagaagctctgtctgccttaaccctcatccctcaacacccccaccatctctttcctcaccactcctggtccctggcaaccactaatctactttctgtctctctctatttgcccgttctgaacatttcatataaaaggattcatgcaatatatggtattttgtgattggctacttgcactcagcataatattttcacagttcatccatgttgtagcatgaatcagtaccttgttcctttttaaggctgtataatattccattttatggctagaccaccactgatttattccctcatccgttgatggacatttgggttatttccactttgcctattacgaataatgttgctataaatatttgtgtatttttttgtgtggacttatgttttcatttctcttgggtacatacctatgagtggaattgctggatcatatggtaactctttgtttaattgtttgaagaactgccacactgttttccaaaggggttgtatcatattacatacacgtgggagggtttgggggcttcaatttctccacatcctcaccagcactagctattattatgtcttttaaaagttattatagtcatcctagtggatgtgaagtggtatttcattgtggtttggatttgcatttccctagtgactaatgatgttgaacatagtttcatttgcttttttgtgttggtatattttccttggggaaatgtctgttgagatcttctgccattttaaaattgggtcatctctttattgttgaattctaacactcgtttatacattctagatgcaaatcccccattttctacacacacatgtacacatatgtatgtatgtataatttgcaaaaattttctcccattctctgggttaccttttcactttcttgcttgtatcctttgaaacacaaaagttttaaaatttgatgatatccagtttattttttcttttattgtttgtgcttttgatgccataagtaaaaaaccattgcttaatccaagttcataaagatttattcatatgttttcttctaagagttttgtagtttttaaaaaatgcttttaaaaaattattattattattttatttgtttatttttttgagatggagttttgctcttgtcgcccaggctggagtgcaatggcacaatgtcgcctcactgcaacctccgcctcctgggttcaagtgattctcctgcctcagcctcctgagtagctgggattacaggtgcatgctactatgcccagctaatttttttctatttttaggagagacagggtttcaccatgttgaccaggctggtctctagctcctgaccttcggtgatccacccgcctcagccccccaaggttctgggattagaagcgtgagccaccgcgcccggctccaacttcattctgttgcatgtgtatatccaattgtcccggcaccatttgctgaagagattattcttttctcatcagattgtcttgacacctttgtaaaaaatcagttggtgataaacgtaagggcttatttctggatgctaaattcttttccactgagctgtatgtctccccttatgccagtatcacactgttttgattactgtagcctgatatatctatatatttatagatacaatatatatttatatacatactatctatatttataaaattatattatatagaaacaccctatatttacattgtgagtagatagatatgtgcacagtctatataaattgtattattttttcttttattgttgaatagcctgatgttggtataaatatttgtgtataatttttttgtgtggacttatgttttcatttatcttgggtatatacctaggagtggaattgctggatcataaggtaattctatgtttaactgtttgaagaactgccaagccattttccaaaggggttgtaccgtattacgttcatatgacagggtttgggggtttcaatttctccacatcctcaccaacacgtgctgttatgtcttcttcttcttcttttttttttttttgagacagagtttcgctcttgtcgcccagactggagtgcaatggtgtgatttcagctcactgaaacctctgcttcttggtttcaagtgattcttctgcctcagcttcccaagtagctgggattacaggcacctgccaccacgcccggctgctttttgtatttttagtagagatggggtttcaccatgttggccaggctggtcttgaactcctgatctcaggtgatccacctgccttggcctcccaaagtgctgggattgtatgcgtgagccaccacacctggcctgctaccacgtcttttaaagtaaatcaggaaatatgagttctccaattttgctctttttcgattgcttttggttatcttgggtctgttgtatttccatatgaattttgggataagcttgtcaatttctgtaaagaagtcaactgggatgtggatattgtgttgaatctgtagactagttggggaatattgccatcttaacaatgttaagtcttctgttccatgaatatgggatgcctttccatttatttagggctttaatttttttcagcaaatgttttgtagtgttcagagtatacattttacacttctttttgttgaatatattcctaagtattttattctttttgatgttgtaaatagaattttttcattttattttcagtttgctcattgttagtacatagaaatacaactgatttttctatattggttttatatcctgcaaccttgctgaactcattgattagttctaatctttttgtgtgtacgtgtgtggatgctttaggattttctatataaatgttcatgtcatctgcaaatacagatagttttacttcttcctttccaactggatggcttttatttcttttacttatctagaacctctagcacaagctcgaatagacacgaagaatgcacattgctaccttgttcctgattttaggggaaagcactcattcaccagggatgttaactgtggcttttagcagatggctttaccaggcggaggaagtgcccttctattcctagtttattgaatctttttttttttttttatcatgaaggggtgttggatttttctcaaatgcttttcctgagaaataccttattttaaaatgtccccagagtccctgtgcttccttctgagggcaaaaactcaaatgcagaggcaaaacttatgtgccaaatcattgtccaggctctgctgtgttgggctctaacaggtgctagctggtggaacgattgttggtaatgacggcaaaatccctgccccttccagtggccagggctgcctttcccgtctgataagtgacacagcagataaggaggtcgcgctgggggggggggtccctctgccccccccaccacggccgctcactgccgctctgcccccaggcctacgagaagcgtttccccacgtgcccacagatcccagtcttcctgggcagcgaggtcttgcgcgagtcccgcagcccggacggggctgtgcacgtggtggagcggagctgccggctgcgcgtggacgccccgcggctgctgcggaaggtgggcggccctggggctggggggcggaggaggggacctgttgcggaggtgcgggagggctgggcgcgggagctggggaccagggcggcggggtccaggaggtggagcaggggcgtgtgagttgatatttggatggaggttccaggatgagggtggcgggaccagggcccaggaggggcgagggctggaaggctgggctggggagtagcgggaactgggcggggttcgcggggccagggccggagctgggtggtgaagatgggttggcggcagggcggaagtcgggggttggtgtcctgggtccgggctgggtgggcggtggcgcaagggacctgggactcagggcagggggtgactggggcaggcccgccggactcgctctccattcctgtgtgctccacgccgcccacccacctccgcctccccgccccttcccttgcagatcgcaggtgttgagcacgtggtcttcgtgcagacaaacatcttgaactggaaggagaggacgctcctcatcgaagcgcacaatgagaccttcgccaaccgcgtggtggtgaacgagcactgcagctacacggtgagcccaggccaccctcagcgcccacgcccggcacccacctgcgcccggcacccacctgtgcccagagctgtgtccccacattccttgagcctctgccaagccctccctcctggggcattgtcaagaaagatgcaggatgcttggttgcctttgcattccgatgaacaacccataatttttttagtatgtctcaaatattgcttgggatatacttatactcaaatgttatttgttgtttatttgaaattcaaacgtgactggacatcctgtgttttatctgttaaatctgacaaccctatcctctccctcctctttcccctccctcctttccttccttctttcattaaattatgcctcagtttcctcacgtgtgaaatgggcttaataatcatgcctactacacaggtagtatgtggcgcctttagaccagtgcctggcacatattaagttctacgtaaatgttacctttgactataattaataataatcataattattctctagtatatactgattgagcacctactatgtgccaggcaccctgccaagtgatgagcacccagcagtggaccaggctgcctgaccactgccctcacggagggtccattccagtggaacaaaacggaatcagtgtgtgtgcatttgtcacagctaaggctggatccagcagggagatgtgtgggagtcagagaaggtggtaggggcactgaagctgagtgctgaaggatgagaggagctgctcatggaggactgggaacagcattttgggggtgggaacagcatgagtgaggtctgccaaggtgaggccatggggcctagatcttgatgactttagaggctggaatgaggcacctgcaggcattcactgatgggacccagctctgccactttcttgctgagtgacgttgggccacactgtctgtatctgtaaaatcgggacattggcagatcctgccttgctggatcgttttcacgatgataactccaggatagcaatggtagaccattgtacgtgtttttttttttgtttgtttgtttgttttgtttttttttttgtttgtttttttgagagacagtctcgctctgtggcccaggctggagtgcactggcataatcttggctcactgcaacctccgcctccttgttaaaaggattctcttgcctcagattctcacgcctcagattcccgtgtaggtgggattacaggcatgtgccaccacatccggctgatttttgtatttttagtagagatagggtttctccatgttggccaggctattctcaaactcctggcttcaagtgatccacccaccttggccttccaaagtgctgggattacagacatgagccaccgtacccggctccattgccttttctttctacgcctccaactcctcttgggtcctccaggagcttgggctcagggtgttcagatcttctggggaggggcaagcaacagttgttgaaacccctcttagtgtgtgtggtgtttctcagaatgagttctatcaatagctgagtcagcagcacctggggctgcttgcgaaatgcagattcctgggccccaacctggaagtgtctaggggcaggcccaggaatctgcatattttaacagactccttggtaatgtttctgcccacagacgtttgaggaggactaggtctggatccataaaggagctctgccaatgaagttttctttttgcaaacatacagatctataaatgtttattgatatataaggatatgtaatatatctttatatagataacatataatatacaactatttaaaaaatctatatctaaattttatgtgtaatattgatatataatttatttatagattatataaatgatacactgaacaattgtatttattttattattttttttttggagatggagtcttgctctattacccaggctggagtgcagtggcatgatcttggctcactgcaacctccgcctcccaggttcaagcgattctcctgcctcagcctcccgagtagctgggattacaggcacccaccaccatctctggctaatttttggatttttagtagagatggagtttcaccatgttggccaggctcgtctccaagtcctgacctcaaatgattcgcccaccttgggctcccaaagtgctcggattacaggcgtgagccgccatgcccgacctaaacataagtatttctaactaattttctatgtatgtgtataatattgaaagggcagggctgcagatttgagacccacattctcccggcttctcatgagaaggctttttgttccctgacagtttgaactttgcatcgttctctgggtgggggccccttggtcctgctaccccatccagggttgccaggcttgatctgctttccactgcaggctctgcctgggcccaggtcagtgggagagccctaggggagggcagggtgcccccgacattgagtccctggcatgacccctgcctggctttcaggtccaccctgagaatgaagactggacttgcttcgagcagtctgcctcactggacattcggtctttctttggctttgaaaatgccttggagaagatcgccatgaagcagtacaccgccaacgtcaagagggtaagcggtgggttgcgttagttactggaggaaggtgcacacacctgctctgccatcaacagctgcatgacccctggcaagacccttacccttcctgggctcagtgttatctgttaaatgggtactctagtaatgaccaaatcaccacgagataatggatggaaagtaactggtctgtaacaggggcaccctaatcctcgctctggcaccatgagatgtccaggcttatgtggtgaattatctggacaacagataattctgtggtgctttttttttttttttttttttttttagataaaatgatcattgcttgctctaaagacctcagatccatccctgagtaaaaacccgttcttgtgatgaaacagatgaaattaactttaataacaaatttttaaacaatgtgttatcaatataaaacttaattctccgaggttggaggcccagttgagcccaggaatttcagagcagtctaggcaacatagtggactccatctctaaaaaaataaaataaaataaaattaggtgggtgtggtggtgtgtgcctatagtcccagctgctcaggaggctgaggcaggaggatctcttgatcctgggaggttggggctgcagtgcgctgagatgacactactgcactccagcctgggcaacacagcaagacactgtctcaaaaaaaataaacaaaaacaaaaacaacccccaacccaaaaaactgattactgagctattttgcattctttgtttcgtaccaagccttggaaattaggtgggtgttggacactcgcagcttctctccatcccgaccagacacatccagccactcaatagccacgtgtcggggctgggacctgagccggctgggggtgactccctgtggtgatcctgtgacccccctccatcctgccccgtgctcatgtgtcttgggtctctctggcttccaggggaaggaggtgattgagcattacctgaatgagctcatctcccagggtacctcgcacattccgcgctggacgcctgccccagtccgtgaggaggatgcccgcaaccaggctggaccgagggaccccagctccctggaggcccacgggccccgtagcaccctggggcccgctctggaggcggtcagtatggacggtaggtggtacagcccaggccagtcagccctaggaggctgctgcaggtcctcttgctccatggggggccctggggcatgttggggagaattgcctgccgtcccccctgggaatgggtctgggtcttggaacgacaccgcctcctgcctccactgagtgcttttctctctctccatcctggtccaagagcagaactcatttgtttcttttcttttctcttttcttttcttttcttttttgagacggagtccccctatgtctcccaggctggagcgcagtagcacgatctcggctccctgcaacctccgccccccgggttcaagtgattcttctgcctcagcctcccaagtagctgggattacaggcatctgccaccacacccggccaattttttctatttttagcagagatggggtttcaccatgttggtcaggctggtctcaaactcctgagctcaagtgatctgcttgccttggcctcccaaagtgctgggattacaggcgtaagccgttgcacccggcaaaaactcatttatttctagatcaggaattaacctctggtgccttgacattgcctctttctctggttttactatttactaacttagcaattattatgaatttactaattattacgattgctattgctattttaaattatacgagtaatgcatgatcatggtagaaaaaaattcaaactgtaaggaagatgtaagaagtacgattcttttcctctccctaaaggctaacaatagttttgtgtttctatgtcctgaagctgtttaggtgcatatatgcacataaaatgtatatatacccacacacatatgtgtgtacatgcatacatacatgtgtgtcttatgttgaatacgtgagaacatatacattccatttgatattttgcttttttttcacttactaatgttgcctgaaaaactttctgtatcagtgcctatgtcttcttttcatacttcatagtatggtgtggttgcaccataactaatttattaataaatattaattatttatttagagacagggtcttgctctgttgcccagcttggtatgcagtggtgcaatcgtgtctctctgtaaccttgaaatcctgggctcaaacgatcctcctgccccagcttcctgagtagctgggactatataggcacaggccaccatgtctagataatttatttttacttttattttatttttaattaattaattaattatttttgaagtggagtctcactgtgtcacccaggctggagtgcaatggcacgatctcagctcaatgcaacctctgcctcccggcttcaagcaattctcctgcctcagcctcctgagtagctgggattacaggcatgtgccaccacacctgactaatttttaaatctttagtggagacagggtttcaccatgttgaccaggctggtcttgaactcctgacctcaggtgatccacctgccttggcttcccacagtgctggaattacatgtgagccactgcccatggccttgattattttgaattagtctatttagctagttccctattgaaggaaacaaccctatttaggtcgtttcagtttttaaaaatacaaacaacatggtacatgtgagtacttaataatttttttaaaatgtctgtaagtatatacaaagcataacattttaaaagtggaattgctggttcaaagtttacatgcaagtaaaattttggtagatttaaccattaggcttccaatgaggttgtaccaatcattgttcccactgaatgtgtaattgcatctattcctgacttcactccagctccccacaaaagtcttagtaaacatctcaaacttctgaaagggaataaaagtagtcacttgttgattagtgacaagttttttcattatgagcaagatcaggcatgatttttcatgtttagtgactgttttcctttttttttttttttttaataatacatacttgttcttgtcctttgtccattttcttatttgcccattgctttcttattggtttgtaagagctctttgtatatgaaggcaactagccttttgtcacagttcaagcttttatggacatggaaaatgtttacaatataatgttaaaaggaaaaatcctaggatacaaattgtatgtacaccacaaatccagttctagccatgtgtaagatgtgtactcaggttgataatgtttttcctttagggccactgccgtgcagggacttccctaactctgacacacttgggtggcagtgccatggaactaataatacatctggggctctgtttagggagaatgaaattcattcatacaacatgtattattctttttcttttttttttatctgtcacccaggctggagtgcagtggtgtgatctcagctcactgcaacctccgcctcctgggttcaaacgattctcctgcctcagcctcccaaggagctgggactacaggcgtgcaccatcattcccggctaatttttgtatttttagtagagacagggtttcaccatgttggccatgctggtctcgaactcctgacctcaagttatcctcctgccttggtctcccaaagtgctgaaattacatgcaacaagtatttattctgcaccgactgtgtgtgctggttggctgttgttgtatgtgcacattttttttttttttataacagcgcccgctcctgccccctcctgtgcacgctctctgtggcctggtcccctgtaccttccccattttgcacaggtcgctccttccttctccatctgtgctgtccgccagcagcacaggcactcagggtggcgggcagaggacatcctcatgccccttctgccctctcctgaatcactgagtctttgtgctcagaagtagaaaaagccttcacatctgcccggggccggaaggatgctgggagctccggcctctctcgtttttctccctcatcccatcctcactccctccctgattccagcatctctgcctctgaccacacaaggtctggacaattcgccctctgccaacattctcccacctctgtttacctagatggctcctggcacagcagttggcgtgaccccccactgtgggcttttctgttttgggggtgctgctggccgttcattcagcctgttttcttatttagccatctgtctacaaagaactggctctgcccacggaggctgctgctttgtgtgacgtctccgcccactgctgagatgccacgaggcctctgcacgccagcatctgccaccctcatggctaagagtgggggaacaggactcaagcttggggcctggcctctgcacactggcaacattccgactacaaccgcccagttgtgggggacaaggctgcacagtgggaatgttccctgtggttcccaggctgctaaagagagcatggctgtgttgcaaggtccaggctctgttaaaagctgctgtctgtcaaaaccccacaatggggcctggggatggggcaaagcaaagagaactggtgtttatcagccacctcctttgtgctgggtgcacaacatgcatttactcattcgagttactccacctctctaggcctcagttttatcttctctctctctctcttttttttttttttttttttaagacggagtctcactctgttgcccaggctggagtgcagtggtgcaatcttggctcactgcaacctccatctcccaggttcaagcgattctcctgactcagcctcctgagtagctgggattacaggtgtgtgccaccacgcctggctaatttttgtattttaatagagactgggtttcaccatgttggccaggctggtcccaaaatcctgacttcaagtgatctgcctgccgtgggctcccaaagtcctgggattacagtcgtgagccaccactcacagcagttttatcttctctaaagtggggataatagtgacgcctgcctcacaggggtgtggagagagctcagtgagaccaggtggcttctgagaaggtagtgagtgtaagcccatattgttaagaatccttagaacatccccagagggtgggaattatcttcaattcccagggtcaaagaggagaaatcccatctcacagtgagatccaggtttgcctgatgatgcgttttcagaacccccttggacatgggctggagaaatgaatgcattcagagtccggtggctgctgtctggggcgggggcttagcctggtttggaaccacgttttagagtcagtgaggcagccagtaaggaatggcacacagaccacatggtaaagagacgcagcgtctccctcttgtcctgaagctcccccttctcctccaaggggacaagctggatgcggactacattgagaggtgcctgggccacctcacgcccatgcaggagagctgcctgatccagcttcggcactggttacaggagacccacaaaggcaaggtgggtgcagggggtaccctggagcagtggatgaatgggcaatgactggtactcagcctccgtgcatgggaaggaaaggcgagatgataatgctgacacattatctcttgcttatttatttatttattcatttatttctgtgagacaaagtctcactctgtcccccaggcagtggtgtgatcctcactgcaaccttcgcctcctgggttcaagcaattctcctgccctagcctcctgagtagctggggttacaggcgcacaccaccacgcctggctaatttctgtactttttgtagagatggggtctcaccatgttgccccggctggttctgtaattttatctgctgggtcaggggataccgttctgtgggctttttacttctttgtctctcagattcccaaagatgagcacatccttcggttcctgcgggctcatgacttccacctggacaaggcccgggaaatgctgcgccagtccttgagctggcgcaagcagcaccaggtggatctcctccttcagacctggcaaccccctgccctgctggaggagttctatgcagggggctggcattaccaggacataggtgcgtgcctccacccacatcatgtatagggcatactttggtcactgccaaatgcactttatttattattttgagatggggtctcactctgtcacccaggctggagtgcagtggtgccatctcggctcaccataatctccgcttcccgggttcaagcaattctcctgcctcagcctccccagcagctgggattacaggcacccgccaccacagctggctaattttttgtatttttagtagagatgaggttttgccattttgaccaggctggtcccaaattcctaatctcaagtgatctacctgccttagactcccaaagtgttgggattacaggcatgagccaccgcacccggcccaaatgccctttaaatgccatgcttcatgctaacatcttactatttttccttttgactcttccaggcatctagaaatgctttgaagtgacaacctagctaggaagaaccagagctggaaggctttggggcttgaggaggagacatttctccactgggctgagtgagcccacaattactcacaataattgtgatcgtaaaggtaacaggtgcatacattttgtatgcatttccaagggcagttgtagcaaattggcacaatcttggtggcttaaaacagtagaaatgtgttctttcacagttctcgaggccagaagtctggagtcaaggcgtcaccagggccgtgctccctctgaaagttctaggggagaatccttgcctgctttttccagcttctggtggacccaggtgttccttggctggtggcagcttcactccagtctctgcctctctcttcacatggccttcccctctgtgtttctgtgtcctcgcctcttctcataaggaccccaggagattggatttagggctcaccccaaatccagtgtgattttatcttgagatccttaactaattaactaattacacctgcacagactctagttcttttttttttttttttttgagacagagtctggctctgtcacccaggctggagtgcaatggtgtgatctcagctcactgcaactccgccccccgccaggttcaagcgattctcctgcgtcagcctcctgagtagctgggactacaggcgtgcaccaccatgcttggctaatttttgtacttttagtagagatggggtttcaccatgttggccaggctgttcttggaactcctgacctcaagtgatccgcccgccttggcctcctgaagtgctgggattacaggagtgagccactgcacccaggcatgggtcacattttaatgtccccatggatatgagttttgggacacgattccacccattacaaatatcttttctggatttttaagttaaattgccactgaagcctgtgcctacgacactttccaatgtcctttatctaaacgttcatctagggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaataaacgttcatctatatcaagtagggtaaacgcttgactctcctaaagaaccggctggcatggtttctcttaacgatcaatcttcctaatttatggaatccaaatttatgaactccccttattgctgaaatttacttgtaacccccaaatcagtattcacagaactttttcagtcatgctgagacatattcagagtggcgaagtattggagtcgcccatcacgcatgctgtctgctgaagttgaatgacgcggctcctgcctttttgtttcagttctcataccctaaacgagtgtcctttttgtggcctatttaatgccacattgttgcatttttgggcttttctttggtgactttgctgtttaaaatgcctcttcgtgtagtgcagaattgcgcctagctttcctaaggatgagcaagtggccacgtgctccatgcagaaaacacccaaagtgctccactagcttcaggcaggcaccagctacagggctgctggccgtgagttcaatgctgacagatcagcaatatgcattcaagtgtccttaaacagaaacacaagccgggcgcagtggctcacacctgtaatcagagctctctgggaagccaaagctggaggatcgcttaagcccaggagttcgagaccagcctgggcaacatagtgagctcgcccccctccaccacatctccacaaaaaatacaaaaaaattatctgggcatggtgctgcatgcctgtggtcccagctacttgggaggctgaggtgggaggattgtttaagctggggaggttcaggctgcagtgagtcgagatcatgccactgcactccagcctgggtgacagagtgaaaccctgcctcaaagaacaaagaggccaggcatggtgggctcacgtctgtaatcccagcattttggaaggccgaggcggcagatcacttgaggccaggggttcgagaccagcctggccaacattgtgaaaccctgtctctactaaaaataccaaaaattagccaagcgtggtggtgcatgccggtagtcccagctacctgggaggccgaggtgtgagaatcgcttgaacctgggaggcagaggttgcagtgagctgagattgctccactgaactccagcctgggtgatacagtgagactctgtctcaaaaaccaacaaatcaaccaactaacaaaccaacagacaaaaaacaccacataaaacaaggttatatattgattggttgacaaaaagtattatggggccagctgcggtggctcatgcctgtgatcccaacactttgggaggctgaggtgggtgtacacctgaggtcaggagtttgagaccagcctggccaagatggtgaaaccccatttctactaaaaatacgaaaattagccgggtgcggtggtgggcgcctgtaatcccagctactcgggaggctgaggcaggaaaattgcttgaacctgggaggccgaggttacagtgagccgagatcgcaccactgcactccagcctgggtgacagagcaagactctgtctcaaataaatacataaataaaaatgttttgtagagaagaggtctcattatgttgcccaggctggtctcaaaactcctgtgttcaagcaatcctcctgcctctgccccccaaaatgctggggtaataggtgtgagccactgtgctggcccttatcctcattgtaacacttctgtttttctgcctttcacaataaggggcgtcagcccctcttggaagcaggcagggtgttagtaagtgaaggctggatcgggccttggtgggttgcagcctgaggaggtgaagctctcacctgcagctgtgacctgcccctcggaagcagtcctctaaataacgggctcttctttctgcttggccccatccacaaagatggccgccccctctacatcctccgcctgggccagatggacaccaaaggcttgatgaaggccgtgggggaggaggcgctgctgcggcatgtgagtcaggggcctcgttcctggacgccgtgcctggggccgggcctgggaaggactgtgtggggtaaagcagcgaggcggacgttgagcagcactgtctctcccttccaggttctctccgtcaacgaggaaggacagaagcggtgtgaggggagcacaaggcagctgggccgtcccatcaggcaaacacctgggctgggcacaaatcccccctaaacagcaaagacggagggtggagaggggtccactgtgcatatgtgctgggctgggcagcgtgccaggggcttcattctcccccagtttctacagtggtcttctgggccttgaggcagggcccgtaagcatccccgttttctatgcatggggaaactgagattcagaatggtggcccccatcgaagcttgtgagccggtcaggacagagctggatttgaacctggggtcctgtctggcttctagctcgaagactttatcctcccactccactcaacagtctccttgactttgctttttttttttttttttttcttttttgaaacggagtctcgctctgtcgcccaggctggagtgcagcggtgcaatctcagttcactgcaagctctgccttccgggttcaagcgattctcctgcctcagcctccagagtagctgggactacaggcacccgccaccacgcctgactaatttttttgtatttttagtagagacagggtttcactgtgttagccagaatggtctcggtctcctgacctcgtgatccgcctgcctcggcctcccaaagtgctgggattacaggcgtgagccaccactcacagcctgactttgctttttgagatcagctctccaccacgagttctcccttggctctgtcatggcacatccaggaacccagtgtcctctgcaggaacccactgtcctctgactcccccgcatttctgttcctgaactgtttcccggagccagtacttacggtggcatcgcccccaaaggcagcaaacctttctgagcagcagcttcctcttctgtaaagtggcttttttttttcctttgagacaggctctcactctgtcacccaagctggagtgcagtggtgcaatcacagctcactgcggccttgacctgctgggctcaagcagtcctcccacctcagcctcccaagcagcggggactataaatgtgcaccaccttgcccagctaatttttttttttgcagagatgaggtctcaccctgttgctcaggctggtctaaaactcctgggctgaagtgatcctcccaccttggccttccaaagggttgggattacaggcgtcagcctctgttcccagcctgtaaagtggcttttacaaatggattctcaaaaataataagggtttaaaaataatgcaaacacggatcttgcacttgctatgtagcaggtgcccttctaagcaccttgattcatttcctcctcctaaacagccctgtgagacacgggcaggcaggagctgctgcttcagcttttcagccccaaatatcccgatctttgtgaaaattaaagttcctttgctgtttgcagattttttttttttttttttgacagagtctcgttctgtcgcccaggctggagtacagtggtgcaatcttggctcactccaacctccacctcctgggttcaagtgattctcgtgcctcagcctcccaggtagctgggattacaggtgcctgccaccacgcctggctaatttttgtatttttagtagagatggggtttcaccatgttggccaggctggtctctagagattttctaaggacacgtatgttggggtggaagtgggaatcaatccattagtgtcctggccggaagcataattcaccccagatggctcaaatgagggagtgtcatgaagggatgctttggagaggtgtgtgcaggtttaagcgaacaaatctgggaggtggaggctcccgggcaccagccgctgcagtcaaacagttattttcctaatgaatgaatactaatgaaatggaggcacagagaggttcaggacttgaccaagatcacacagcaagtggcagaactgggatttgaaccttggccatctgactgtggagtgcatgctctcagcacctctgctctatttagtagttagcatcttttcaacaattaactcatttatgcctgaggttgcaatgttttgaatttttgcaatcagaccttggtgatgaccttgagcagtaggatagaaataactcccacacgcttagcattgcaataatggaatgctaggcctaaatggccacttgtgataaccagctataattgagggcatgtggtgtgcccgtccttgcagagagctttgtatataccatctcacttgatcctaacagcagttgcttcagatgaggactgttactacctttgccactgtcctatgagtaagtgggtctgtgccctgacctaaggctctcaggggtgcaggtgagacttgaatttgggcgctcagccctgaagtccacagtctgatcctcttcatcgcatgggctccctactgtggcaggagcccccatctgctcccagccctatctctcggagcctccctgttcatcccctgtggggagggtgttggtggccttgggaggcagcagagccaggtggagctggggctatttctgccacagctcctggacctgcctgctagacctggagggactcaacatgcggcacctgtggcggccgggggtgaaggccctgctgcggatgattgaggtggttgaggacaattacccagagaccctgggtcggctgctcatcgtgcgagccccccgagtcttccccgtgctctggacactggtaagagctggagcctgggccaggactctccctgggggtgggtgggatgggaggggttccgtctgcaagcagctctgctctcttttcctgtttcatttcatttagtaactttttggagatgaaactcacatagcataaagctcacactttttaagtatagactccagtggtctttcctgtattcactgagttaagcaattgtcaccactagccaatcccagaacatttctgtcgccccaaaaagaacccccatgcccattatcgtgggtctcaaattcctgggctcaagcggtcctcttgccttggcttcccaaagtgtttgtgttataggtgtgagccactgcgcctgacctgaaatatactctatattgtaacccggtgggtacacgcgtgcatgcacccatgtgcgcgcacacatacacccacgcccacacacacactcctctgaaacaagggtgcagccagccacttgcatagtgtgggcaaaagcctggaggctggacccagcttgatgctttggaggaactgaagaaacagtccagggtggctgagcaaaaaagagcaaaagggacgacagcacctgaggaggctggaagatgtacaggggcaatagggacccatggagggttcagtagcaggggagggtgggggacagacttaggggccaggaagttctctagcttttgtgggtgcttcaaggctctgttcaggtgaggctagggggcaggagctgcttctgaagctttttatcctgaattgtcctaatctccgggaaaattaagtccacctgctgtttggggtggttttgggagtgcgagcacatcagccggggtcctggctggaagtggacctcacccagatggttcaaatgaggggtgtcctgaaggggctccttgcagaggtgtgggcaggggaaggagagaccccaagcaccagtgactgcagtaagcctggccacccccaagaggagggaatgtccttgcagaatcctggggaaagctgggacaggggtgggggcagggagctactgggggtcagcctcagcctcctggggcccagcacagcacagagcgcagtggggctggggacaggagagggccctgcacggggggattgcagtttcctcacctatctcttggcttgtggcattccctgtagaactggcctgttatctgccatgccaagggctccttccttctttctctctctcccacttccttccttctttatcaacatgtggcttagagctcagtgttaaaatggattccatctggaataaacaaactgtggaatactgttccatccatgtaatggaatagcattcgtccataagaaggaaggaagcactgatcctccaacacggagggacctcgaaaacctgatgctcagtgaaaggggccagacacggaagtccatgtactgtgtgatctcctttatatgaaatgtgcagaatagggctgggcgaggtggctcacgcctgtaatcccagtactttgagaggccgaggtgggtggatcacctgaggtcaggagttcaagaccagcctggccaacatggtgaaaatacaaaagtacaaaattaaaatacaaaaattagccaggcatggtggtgggagcctgtaatcccagctacttgggaggctgaggcaggagaatcacttgaacctgggaggtgcagcttgcagtgagccaagattgcgccattgcactcaagcctgggagacagagcgagactctgtctccgaaacaaaaacaaaaaagaaacgcccagaataggcaaatccacagagacagagtgtagatgggtggttgccctgggttgggggaggggagatgggaagtgacggtggggtgggaatggggtttccttctggggtgatgaacatgtctaggtagaggtgctggctgcacaagctagtgagtgcactgaaagccactgaactgtgcactttataatgattaattctatgttgtataaattatatctcaataaaaaaatacatccatggtcaggcgtggtggctcacacctgtaatcccagcactttgggaggccgaggcaggtggatcacgaggtcaggagatcgagaccatcctggctaacatggtgaaaccccgtctgtactaaaaatacaaaaaaaaattagccgggcatggtggtgggtgcctgtagtcccagctactcgggaggctgaggcaggaggatggcgtgaacccgggaggtggagcttgcagtgagccaagatcatgccactgcactccagcctgggcgactgagcaagactccgtctcaaaaaaaaaaaaaaaaaaaccatccatcttgccttatgtcctggtttcagatcagccccttcatcaatgagaacaccaggcggaagttcctcatctacagtggcagcaactaccagggacccggaggccttgtggactatctggatagagaagtgatccctgacttccttgggggagagagtgtggtgaggcttccatgtccacagacagacctgggcttgaggagggggcatgcctagctgggaggctgggattcccggagtggggctgggaggtggaggggggctgggtgcggcatgtgcactctgcctagggcaggtcttgctggctctcagcagccacagggcttgctttagaagctgcttcaaagagaggtgatgctgttctgaggttgggccttactctgggtccttcaaacatagtgagtgagatagaagtttctggaagcctaaagattaggccagtcaaaggcttacgcattctatattcccatcaaagacattgccaagcagcagtgagttaacctgctcattcactgcaggggaggtgactcgaatgtatctgcagctctggaccctggagctgggactagcctccaacccacagccacacagcctgaaacgatcaggaacccccttcaagggaggcagtgtccaggccccttttattgcctcccctggggtgaaatgacaggctggggtgatcctaggtcacaactctgtcatctcatatggcccccagtggcccgggccctctttgtttctaacagaaataccagacagtgagcttgcgtcatttctggattttaaaaaagtcttttcctaggaatttttccaggcttgcctgttctctccgtttgtgatgtgcggcacacacgacttatttttagcaaacggttctgcagatctgagagtggcttatggaaagacactgaacagtgtcctgctaatcccagtgtttctacaagtgaaacggggtgggggtaatcattgtttggtggtggcagggggagttctgccaaggcctggccatctagggtgcctttggtttggggaaatctctcgatgagcacggtgcagtgactgttccacccccgcctgtgacggggagaggcagctgctatggggtgcggtgtggagaggccccccagcctggctgtcagtccggcaccggggtaaagggacatgagcatggggctgtgacgaacgtgggtttgtgccctggctcactcactttctgctgtgtgatcgtgggcgagtggcctgacttgcccgagcctccattccttcctctgtgaaacgggaagaataatagtctctactgcattggtggacctggggattaaatggggtcatggaagcccacagcccattcagtaaggggttgcaattatgagtggctttgggggtcacacatcacccttctgtgggtcaggccagccaggcctcaactggccctgacctgctgccctttatctctgacctgcagtgtaatgtccccgaaggagggctggtccccaagtccctctacatgacagaagaggagcaggagcacacggaccagctgtggcagtggagtgagacctaccattcagccagcgtgctccgcggagccccccacgaggtgccagggcctggccggggagggcccgctgagctggagtgtctgtcgtcttaggtcaggtgaccccaaaacacagcttgagatgaggattcttttttcttttctttctttctttctttctttttttttttttttttgggatggagtctcgctctgttgcccaggctggagtgcagtggtgcaatcttggctcactgcaacctccacctcccaggttcaagcaattctcatgcctcagcctcccgagtagctgggattatagacatatgccactgcgtccagctaatttttgtatttttagtagagacgggttttcgtcatgttggtcaggctggtcttgaaatcctgaggtcaggtgatccgcccgcctaggcctcccaaagttctgggattataggcgggagccacggcgcctggcctcttttttttttttttttttgagaccgagtctcactctgtcaccaaggctggagtgcagtggcgcaatgttggctcactgcaacttctgcctcccaggttcaagtgattcttctgcctcagcctcccgagtagctgggattacaggtgccagccagcatgcctggctattttttttttgtttgtatttttagtagagatggggtttcaccatgttggccagactggtctcgaactcctgacctcaagtgatccacccacctcggcctcccaaagtgttgggattataggcatgagccaccaagcctggccgagataaggattcttatgccagtgatctgttgcaggcgaggtctcaggagaaaactgaggagaggagggcactcctgtaaggaatgagcgtgtgcctgggaaaggagaccccagggggcacccacagcccctcctgccactgtgttccccaccccagctctactctctcggccgtgactctcagacctcgcctgtctccacacaggtggccgtggagatcctggaaggagagtcggtcatcacctgggactttgacatcctgcgaggggacgtggtgttcagcctgtaccacaccaagcaggcgcccaggctgggcgcccgggaaccggggaccagggccagcgggcagctgatcgacaaaggctgggtcctgggcagggattacagccgtgtggaggctccccttgtctgccgggagggggagagcatccaggtttgcattttctggaccactcattcgctcaccaagcagcactgagtgtccactgcgtgccaggcttctggggatacagcggaggacatactgggctgctggtccccagcctcagggaccctgcaggacagggcagaggaaagacacacagggtctcatgtaatgaagtgctcacctgcccaatggcagccggtgcaaaatcgagaaagcacggggtgctctgctgagaggtggctggtgtcttggggaggagcacagggtctggaacctgagtttccccatctgggaaatgggacttctaacaggatccaactgtatttgtttcttggggctgcagtaatgagttaccacaaactacatggcctaaaacaacaaaaatttattgtctcacagttcaggagttcacaagtccaaaaccaaggtgttggcagggccacgctccctctgaaggctgtagggaggggttcattctatgcctctgtcctagccttaggtaactcctggcaatcctgggtgtcattggtgggtagatgcatcaccccaatctctgcctctgtctttaaaggggtttcttctctgtctgtctctcttctgagtctcaaatctccctcccctctctcctgtaaggacactagccatcacagttaggccccatcttaaatcctgtttttttttgagacagggtctcactctatccatgatcaggaaacttttgcgggactgggaatgtagtgatatgatcacagctcactacagcctctacctcctaggctcaagcgatcctcccatctcagccttctgagtagctgggactacaggttcccgccaccatgtccaactaacttttgtattttttgtagagatggggtcttgctatgttgcccaggatgatcttgaatgcctgagctcaagcgatcctcctgcttcagcctcccaaagtgctgggattagaggcgtgagccaccatggctggcctcaccctaaatccttaaccacaaagactctatttccagataaggtcacgttctgaggttctggctggacatgaattttgggggtacactgttcaacccactgcattaactcaagcagggggaaggatgagcatattggaatttgaagttcaggttgcctgcatacattcaagtggcttcagtatggacgaagaccttgagttgtggctggatctgggagggggtgagaggggatgatgttccaggtggaaggaacagaaagaacaaaattgaagccgcagggagaaggcaggtggacacgagggtagcttgagtgctggggaggggttggaagttagtttggatagaaggggaggtgctaaggtcctgaggtcagtagtcagatttctgatgtgcactgtggtttcagaactgatgcaaaagaaactgtaggtcttgggccgggtgcggtggctcatgcctataatcccagcactctgggaggccgaggcaggtgaatcatctgaagtcaggagttcgagaccagcctggccaacatggtgaaactccgtctctactaaaaatacaaaaaaaaaaaaaaaaaaaaaaaaaaaaagcgaggtgtggtggcgggtgcctgtaatcccagctactcgggaggctaaggcaggagaatcgcttgaacctaggaggcagaggttgcagtgagctgagatcatgccattatactctagtctgagtgaaagagtgaaactccgtctcagaaaaaaaaaacaaaactgtagtcttggaacagaacttgaacgtgtaactggaatatgagctgcccctgttgatccccacattctccaggaggctggcattgcaggtggaatgtcactctctgactcccgaaatgacacatgcacacacgcagcaccagctccacgagcactggcagttgctgtcgatctcaccgaagttcccggtggggagagggtggagggccgtcctgcatgtccctcacagccactgctgggtcccactgaacttctcaacccagagcaacccaaagtggctcttcttgtaaaaacaaacacttccctttctcactctccctgatccctccacaaattctctctaagcacctgtgagctcccggcccaaatccctttcctaatccccttggtttgcaaatcccactcagcagagcaaaagccccacaaaatccaggtgtttaagcacctctgttgtcctgaagttgcacccccacccccaggcgtcagctcctccccagattaagagggaggctctggtcccagggatatggggataatagcaaggatggcttccagaggccctgacaggaggagttgctggtggactggagaaagggacagagggagaagagccccaatttccaggcctggtgatgagaagcccatgaaggctcagcctccttgacctgtcctctggagggcgcagggcctcagggcagggctgatgtgtttcagggctcccatgtgacccggtggcccggcgtctacctgctccagtggcaaatgcacagcccccccagcagcgtggcctgcagcctcccgggtgtggacgatgtcctgacggctctgcacagccccgggcccaagtgcaaacttctctactactgtgaggtgctcgcctctgaggacttcaggtaggagggctccggagcggggtcctgggcaggaaggaccctggggctgattgacaatgcagatgcctggcctcctgtctcccagctgggtcagcttctcccggggtgggaccccagcatgggtatggttggagttctcaggtgacacagccccgcactagggtgtgaggagagcccagctctgcgcgtctaactctgcttccgaagcagggattttccttcaaatgaaaccttgggcagaagctcaactttttggagcagttggaggggaggagaaggggagtcttaaacccttccatgtgggcttcccctcactcctagaattccatgggaatattttagaatattctaaaagggtgctttttagacaaccctccccaagttgttgctttcagagagacagggaactgtaatggttaagacctccagcacttcctggttgctgtgtgacctcgggcaaatcacttttcctctttgagcctcaggtgcttcatcccttaaatgggaaccactggagccccagtcttgtgggtttgtcatgaggatgagatggctgggggaagctgcctgtcacctgggcatgcggtgtgcatgccacagcagaaatgaaggagaaggtctggaggcggagcaggcagtttcttcaaggttttgcattctgtaaaagcacttatgattttgcaccctgcttcatgatggatctgcactggttttcatctaaaaatgatgctttaaattctttcccgtgggggtaaaattaaggctcaaggaaggtgctgagtctagacctcaaattccaggtggagctccaaggatcccaggagcatgggcacccagagtgaagaacactggggcagagtctttatccaaggaggggtcccatagtttgtcagggggctggcgattcactctttgtgaagctgcatgttttggccatcggtcctcagtgtgaggcgacaggctgaggcccagggggacacagaggaatagacacaggcattggaaggttgtctctgggagggctgattctgaggccgggcatgtggaggccagaggggtgggctgggccagacgctgcacaccaacctgtcaagggtggtcaccatgagaggaccttactgccctgtcctcttgtagcctcatgagaaaatcagttcaaaggctgtttcctggtcgccctcagggggcaggtggtggctcggatcgtggggggaccacacagatagggtctgccatcatgaagcagagaccaaaggctcacacccaagtataactatgggcagcgatggatgccatggccaaggccactgtgttagtccgtttccacactgtgagaaagaactacctgaggccgggtgtggtggctcacgcctgtaatcccagcactttgggaagccgaggtgggtggatcatctgtggtcaagagtttgagaccagcctagccaacatggcgaaaccccgtctttactaaaaatacaaaaattagccgggcatgcctataatcccagctactcaggaggctgaagcaggagaatgccttgaacccaggaggtggagattgcagtgagctgagatcgcgccactgcacttcagccttggcgacagagcgagactgtctcaaaaagaaaaaggaaaaaaaaaaaacctacctgagactgggtaatttataaagaaaggaggtttaattgactcacggttctgcatgactggggaagcctcaggaaacttactatcatggcggaaggcaaagggtcaggagagagagagagcagaggaagccacacacttttacaccatcagacctcatgagaactcattcactatcgcaagaagaccatgggggaaactgcccccatgatccaatcacctcccaccagatccctccctcaacacttggggattacaatttgagatgagatttacttgggccatagagccaaaccgtatcagccacccagccaggaggtgctcagggacgtaacctagagccttgccagagcacaggacgggcctggcctagggttgggagagagggtgggggaagtaatatggaacgtgacactggactgagatctaagtagtgtggtggtcacacaagtcaccagggggtctttttatttatttatttttggagacagagtctcgctctgttacccaggctggagtgcagtggtgcaatcctagcttactgtagccttgaactcccgggctcaagcaatcctccaacctcagcttcccaagtagctgggactataggcatgggctagcttgcctggctttttttttttttttttttttttttggagacagggtttcactctgtcacccaggctggagtacagtggcacgatatctactcactgcaacctccgcctcctgggttcaagcaatcctcatgcctcagcctcctgagtagctgggattacaggtgcgtaccaccacccctggctaatttttatatttttagtggagacaggtttcgccatgttagccaggctggtgtcgaactcctggcctcaagcaatccacccacttcggcctcccaaagggctgggattacaggcatgagccactgtgcctggccacttttaaaattttttgtagagatggggtctcactattttgcccaggctggtctcaaactcctggcctcaagcgatccccctgcctcagcctttcaaagtgttgggatgacaggcgtaagccatggcacctggcgaggttctgcatctctaacaagctccgggcactgctggtgctgccagttcccagaccatgctttgagtagcaaggccctaaagctgcactgtcctatctggtcgctgctagtcacctgcagcaatttaacttagcaaggagaatgaaataaaaggaacaattcagtgcctcagtcgcatgggccacatttcaagtgatgagcagcccatgtggccagtggctggtgtgttggactgtgcaggtgtacagcacgttcatcgcaggaagttcttggagggtgggcatggtgcctcacgcctgtaatccaagtgctttgggaggccgagtcacgaggatctcctgatcccaggagtttgagaccagcctgggcagcatagtgagagccccgtctctatacaagaaaagaaagttctcgaggatggcgctgccctgaggtttggagtaggagttaaccagacagctgggggaggagagaatgggcttctgcctcaggctcagcgcacacgaaggccactgcaagagctaggaggaggaccatggaatttgagtgcaaagagtaaggagggagtgagactggagacagggccggggactccctgggctgtggcggccttagggccatgcaagggcctcaggccaggggagcccctgatgggtctgtggcaggctgggctccatctggggagatgggagtgtggggaattcggtagtgcttttctcttcatggcgtcacttgcttttccctttgcatcggcctggggccctggggcctgatttgcagcatcaacagcttttccactgctgtgtgtcagcccaagggccttgtcactgtgagagggtaacgtgtgccacgcccttcctccccaggggctccatgtccagcctggaatcctgcaccagcggcttctcccagctcagcgccgccacctcgtcctcctcctccggccagtctcatagcagctccctggtctccagatagccgggcccagtgtttcagggccgcccgctcgcctccagtgtccagaaatgtccagaatgagaagccagctaactgcagggcctgggaccatgtgggctggagccccaggcctagatgctgcccaagttggggtgtctggagcggatggcaaggatccagaactggcctgtgggtggtgtcagggctcttgaaattgcaaggacagaaccatctccttccggcttcgtgtaaggaagaccaagccaaggccaaggtgtctaccataccacacctttgggacatccgggcttagcgacgtcagccaggcccatctcctctctgtccacctcttgctctgctttcgccatgcaggggaccatcactatcaggtgcccttctcctccctgcagcttgcctgcataagagagcctcttcctcccaaaggctccagcccacttcccagagctgagtcttagcctggaagggggagcgattgccaggtcaattcctgaaccaatcacagttgccaggcacactggagaatgctgattggccagcagggtcatgcccaatctggaccaatcaccgtgatccagggttgcagtgaggtgcagtgattggccagcctggatcacatgcacatctctggaaccaaccacctgctctcaaaagcactagtgggtgcctcgaggagtactggggtcccccctaagaagaaggaggaaggatgctggggaggcagaaatgaagggtgtttaccttggcatctgattgcataacgttctgttatgcagtatcaagatgtgcttggtgagcagttaagtgagttacaggcgctgctctttgtggggaacagcacatcctgaagtgaaaatccatgttccctgcacttggccagcatggcctaagcctgaccatccctgattggagagggtgggagagccctgggtttctgctaagttccaggcagtgatggggtgactgaggctgtctgtataccccactggagatgcctttctctcctagggaactgtttaattatgactgtttttggttgtaagccacagagacccatgcccaggtgcttcaacacaaaagcatgatcattcatgggtgcatagaactggccagtccaggagggcttgcttcaggtaaggctagatccagggtctcaacatggagtctcgattccccccgcgagtggaggctgctgtgtttgccctggggcagatatgactctggaactaggttcaatattgacatgagttcccctagttactacacaggagcgtcttgggtctccttggggcctgaggacatttctcctttcctttcctggactccccaaaaggcagccagtcaggggtcaccaacttgaagcctgatctggcctgcttttagtgttgcttttttgcctttagaatggtttaaaaattgaggcatttcgcatcgaaatcaggatttctggcttcccttaggcatttgggagcaccagcagaatggggtcactattgttgcatgaagacaacacctctgcacccctggatgtggccacgccagtccctaccccattgacttgcgcccagcccacattacacatcctcatgacctgcgtggcaggagtctcactgacatggctctgtcagcagtggctggtacccttgtctcctggccttgcttagagttggggctcatctctgctgcagtaactgagccaaggggtggttttgtggccacaagaatcatctttatgcaggctcagcaatgcagggccaggaaacttatatctacgccagcctcaaccccaaacccaaggaagagagaaagtgtcatcttttcagatacatccttcttcctgctgggagagagccttgcccaccttcctgttggctctctgtccgcttctcaggtatctgaacaaaatagattgctttgcactctgcgtcaaggtgtgtgtgcacatgtgtgcataagagaccgactgattggaaggagacgttctcaaaactaattgctcccatatcaccaggcatttattgctgagagcaacttgcaatattttcaactatctttaagtgaatttctagcttttctcttaaaaactaggtgttatcctacaagtatgctgggataagctgccctggcagtctttatacatttattgtctagccccagagaaggacacagaagccttttacggaaggaagctggaactgcctgttccagaggcgggtggggggaggggagtctgctatcagctgtccacccttaacagtgggggtgaggaacctcaggccctttcagttctgctcttgagagtgctctctccctagggaaaaccagcccaaactggcttaagcaacaaagcaaattccctgggtcctgtactagggatggctgaaggtgggtgctgcttcagatatggctggatccaggagcttaatgtcctcaggcctctcaactgcacccaggcctcttgactctgcatctctttgcatgctgacctcattctttcttccacctggcgggaaagatggctgccagcagccccaagcctataatttcaggattcacactctaagagatgcttttccatctcaaatctcatggaaggctctgattggcccagctcgagtcacatgcttattcctgtgggccacactggcaaggaactagggtcccgtgattgacattccctgcagaagccgcagcaggattggggagggccattcccccaatggacaagagaagctggaccacagaaccagcaggtatccatggtggcatctgctacggccggctctcctcccatgtggaggtctcggggacccacgtggaagcattatcaaggtcattcttcttgccttcgggaggactggaattaaaaataatccaaggaagggattgccaagcttttggcttttgaatttcccctgagccacaaaggctggaagtgccttggcttgggcttcttgcatcattagttcattaatccattgtgaccaggacagaagcaacccacaagcagcattactgttggtgtttgggcacctgggccttgaatttaggccaggactcaaaccccagccttcctttcactagctgtgtaaccttgaccaggtgacttaacctctctgtgcctcagtttcctcatctgtaaagtgaggatagcagtgcctacctcaataggttgtagtgggacgaaatgagggagtagctgtaaagctttcagcacagctcccagaacacagaaagcgctccattaatgtcagtggtcattctgattacttaatgcttcgcatccaaagactcgttttcttcctgaggtcgcctatccctgtttttcgttattgcacccagagaaaagtaggtgtcaagaattattgccctctgagttgggtgtgcagtctttctcttttagaaactgcttgtgtgggcggggcgtggtggctcatgcctataatcccaacactttgggaggctgaggccggctgatcgcttgagtgcaggagttcaagaccagcctgggcaacatagtgagaccctgtctctacaaaaaattaaaaaatgagccaggcgtggtggtgcgtgcctatagtctcagctgctcgggaggctgaggcagaaggattgcttggaggtcaaggctggagtgagccatgatctcacccctgtacttcatcctgggtgacaaagcaagaccctgtctcaaaaaaagaagaaagaagctgcttgtgttttctgggtaagtccacccatctgagggagtgtattctgagtggtatttcccttggcagttagaaaatgttttttcccagaggttgaagtatggagagtttgagactctttttttctaccctgcactctctggaattccccctccctgctgtaaaatttattgtccaatgagaatagtataattgttttcaacaaagtctctttgagccagtgaaacacgatgggtttttttgtttgcctgatcacttgctccaaccagcagcattaaatgttttccatttggataaacttgcatcgtcagcttcctaaaaccctggaggtttcccgtgggctcgttcaagaactttccagctgttgtttaaaagactttagagctagcttgttcagcctgtggcctgcaggctgcacgcggccccggactgctttgaatgtgctccaacacgagttcgtaaactttcttaaaatactgaggttttttgtgtgtgtgttttctttgttttttcagctcatcagctatcattagtgtattttatgtgtggcccaagacaattcttcttgttccaatgtggtccagggaagccaaaagattggacacccttgctttagagcatttgcaaccggagtgatatcacccccaaggggctgcatatctgtttaatgcaggtataattgtgtatcatatatattgtatacatatgtaatggattggatagcatgtccccaaattcatgtccacctagaaccttagaatgtgacctcatttggaaataaggtttttgcaggtgtaattagttaaggttctcaagattggttattgggccgtgtgagggaggatcacaatttttatatataaagcagaaataggccaggcgcagtggctcacgcctgtaatcccagcactttgggaggccgaggcgggtggatcacaaggtcaggagattgagaccatctggctaacatggtgaaaccccgtctctactaaaaaatacaaaaaattagccgggcatggtggcgggcgcctgtagtcctagctactcgggaggctgaggcaggagaatgccgtgaacccgggaggcggagcttgcagtgagccaagattatgtcactgcactccagcctgggtgacagagtgagactccgtctcaaaacaacaacaacagcaacaacaacaacaggaatgttctggaggctggaagtccggaatcaccatggaggtagggccctgctccttctgaaggctgtaggggaggacccttccttgcctcttccagtgtctagtggcacctcgtggcttgtggttgcatcactccagtctctgcctccatcatcatatggccttcctctctctctgtgtctcctcttcttgtagggatgccagtcattggatttaggacccatcctaagtccagtataacgtcttgagatccttaactaattccacctgcaaagatcttacttccaagcgaggtcacattttaaggttccggatggacatgaattttggggcatgctactcaacttattatgtatgcatacaatagctaaccagatacacagttatatctgcattaaacagatatgaaaatccctggtgcccatctctcctgggctgccctgccctccccctggggttttaccaaagtgccagacctggtgtcctggagagctgcatcccaaaacagccacagtcctgacgtcagaaggttgtgatgaaccctgtccagggtgccacctgtccttcccgtgagctctcttggggcacggagagtggagctggctgccacacagatcctgggactctgaaaagccttcgtcgttttggagctggtggctggggttgtcatttgtgagagcagagcaggtgtggtgttttgtgtgatggcacgagggccatctgtccacccagcttctgctccccagccctgcccagcacagctcgtcaggggagaggaggcggcttgcacttgcgtgtgttcatgggcggtgactcttccgtggatttctctggaactgtgggtggcgggtttcaaaggaacagccagctgactcgtgggtgcggcgggtatcgagaaagaacagccctgtgggggaagatggagctccggagggtgggcgggagctgggatcaggcctgagctgtggggccctgctgatgcctgtctcagccacagcgctttccttggaggcctcctggggcctggacccagagcgagcaaaacatgcccagggctccctgtggcccagaggctgcctctgggatcagttcttggggcacagacccctgggacctctgcggagccaggttggacgcaagcagctgcagtgggagctggggtagggcctgggaggaagggagcccagggcctccagggatgtcagaggctgtggctaccaacttctccctctcacttccctgcctcccttagtgcccagcccccaacaaggcattttggaggaatgcggatccccaaaagtcacatttttttttgagacagggtctcactctgtcacccaggctggagtgcggtggcatgatcatggttcactgtagcctcaacctgccgggctcaagcgaccctcccacctcagccccaagtagctggaaccacaggtgtgcgccaccatgcctaattcttgtatttttttgtagcggcggggccatgttgcccaagctggcaaaaagcacaatttgaaacctctaagccaggatttttttttttttccggacacagactgcttggagaatcccatgagaactcaggacacacacacgaatttcatttgttttggggccccaaagagtccttgaaagcccacccattgacgccaggatgggaacctttctggggtctttccgaatactaaagttctgtgcagagcaccccagaagctgagacgtgtcaccatggcgatggcccagcatgtggaactctcagggttcccagttgagctgcagagacttcagtgtgcagtccaagaccaccgtgcctgtgcctgggggtcttgagtcactactgtgggtgggggaggggacccttatgctgctgggatcggagcacatgaatccccagccggcttgcctgcagtttgatgactttagctcttgtatatttgtgtccccaccagcaccataggttggtactggaatctcagacacttctgcctcctgctccatgtcctatctaaggtctgccgtccaaaatctaaatgcctgagtcccaaaatgtgcctctcctgtaacaatacaagtgtcacacgtttgggttgccggagaccccaaaacccaatacaaattgcctcaagcaaaaaatgggaatttatgggttcatgtaattcggaagtccaagaatgatctggctggcttcaggtatagctggatccaggcattcaaatcatgtccccccacccccaccccaacaccctcagtctagtcgttttccacactggctcacccgctccatctcttggttctgatcaggtcttctccacactggagaagagttggtttccgttcctcctccttgtggcccaccttggcccaccttgtggccctccttgtgtctaaccttggaagttagacagtcccagcagagagagtttcttcttccagctgcagcagaagttccacgatgggctctgacgggctgacccggggcaggtgcctaactctggaccaatctctcaggcccacctgcaacttggggtgagaagacagtgccacccaaaccacctggatggagaatgggggagaggtactaccctgatagcaacacgctagaggctcacagccagggctcctgggttttggggtctccggcaacccaaaacgtgtgacacttgtactgttacaggagaggcacattttggggctcaggcatttagattttggacggcagaccttagataggacgtggagcaggaggcagaagtggccacctccccgggcactctcattaccatggaaggcttcaggtcacaagatgttgcaactttcccacagctccctgtggttgccagggcacattcggtctctgggtagggcagactggcactgccagggagtcaacccccaggagcggccctcaaccaatgatgaatgggtgttggctgataaataccccagcttcctcgcccttgtgtggtgcaaccaagacctgttctaccaactgtcccagaggcccccagcaggattgagcccctgttgcctacagtatagacttgctcactcctgcactctgcacaggctgccttccctccctgtcctctaccagtgcttcctggggccgcctccccaataaagtacttgctctcacctccttgtcttagtttctgcatctggggaatcctagcctaagacagggctgttgctagaagagagactggatgtcgggcaggcaaagaaaatcaataacacaatgacaaattaaaaagaaattacaggctgggtgcggcagctcatacctgtaatcccagcactttgggaggcccaggcgggtggatcactttaggccaagggttcgagaccagcctggccaacatagtgaaaccccgcctctactaaaaatacaaaaattagccaggcatggtggtgcatgcctgaaatcccagctacttgggaggttgaggcatgagaaacgcttgaacccgggaggcagaggttgcagtgagccgaggttgcaccattgcactccagcctggggaacaaaatgagactgtctcaaaaaaaaaaaaaaaaaaaattccaggggccacaggactcacaccgcttggcatgtttgagtcacctgacctgggacccctctaactttgctgtgacaggccctcttcaggtactgctgcctctgggcctggattccagtgcacaggactgtcacttttccaacttagccgccagcacaacagagatgtcccctcagaggtcatggttctcaggccaagggtcatttcaggatggtcatcatggccatcatcgtggccgtggcgtcagactgagagtgatccctgtagattccaggatctgcagccaggcttgggaactgctcttaggaatacacctgaatgactctaaggcgcctgactttgcagctcctttttaagaggcagagcccgtttcccttctccctgaatctgagctggcctggtgacttgtgcaggcgcccaccagggctgccagatctttaaagagaaaccagcaagctggaatttttgtcaatctctggactttttgagatggagtcttgctctgttgcccaggctggagtgcagcggtgcgatctcagttcactgcaacctccaccttccgggttcaagcgattctcctgcctcagcctcctgagtaactggattacaggctcccaccaccatgcctgttttgtatttttagtagagacggggttttgccatgttggccaggctagtctcgaactcctgacctcaggtgatccgcccacctcagcctcccaaagtgctgggattacaggcgtgagccactgcacccccgcccttatttattttaaaatctcttgacttttaaacatgggtaactaatttaaattctataaaaatactgtgaggaaaaactaagccctggtcattcaaattatggtcaggggccaggcgcagtggctcgaacctgtaatctcagcactttgggaggccatggcaggaggttgacttgaggccaggagcttgagaccagcctgggcaactcagtgacaccccttctctgcaaaaaaaattttaaaaattagctgggcatggtggcatgtgcctatagtcccagctacttgagagactgaggtgggagaatcacttgagcccaggaggtcaaaattgcagtgagccgagatcgtgccattgcactccagccagggcaacagagcgagaccctgtttctaagaaagacaagaagtgtggtctggggacctgaagcatcagcatcgtcagagagcttgttggaaacgcagaattgctggcctcaccccaggcccaaatctgcattttaacaagatctcctcgtgacctgtggcatattaaagtttgataagcactggattaaacaagcagggaacaggacttggctccaggatgccgttgtgacttctgtttcaggataagccacacctgctaagccctagcagtgacctaagtccatgattcagaatccacacaccacctggtggctccttttattatatcaatttattcaagtgattaaaaaacttcttggcagcaggatgacaaaacaggtctgtaaacatgatctcatccccccatcccttcttccaaggagcttcctatgacaggaaatcgaattctagttggcaaatccagtgatgaggtctgtagaaaaggggtcccgtgtcacagccaggaaggcagactcgtccctttaacccactccagccaggggtgctggccaggatgtgctgttctgtcatgacgtggtcactgagtctggttcgttggcagccccttccccaggaggagggagactctttggcagtgcggcagccctcccgggggcacgggcttctcggcagcagacacaggcaggccagaagcaggcagctgagcctctccagcgagcatggtattgctagggttgcaggtgccctggcaggtggccaggtgaggggctgaggcacaagtgctatcaggaacttggctgccccacaggggctgaggacacccagatggtccacgccagtggccttgaaatttcccctgcagaagccagaccgtggggaaacaagctttcgcgacgtgccaccccgggcagcttgaggcttcagtccttgaaggggttgtgggcgccccctggctgctccttctctgcggccagaggctccccgttcatctcctgcagcgggtggtatgcatagtccccatgcaggcgccggttcctctctgctctggacaggagcaaggacaggtttgctgcagtgctgatcagcaggaggaaggccagcgccagggtgagggctagccaggcggtcctgcagacaggagagaagccccaagtgggggactgctgggtgggctcagggcttgggtagcactggaggggcttccctctacccggcatagatagcactaaatcaggtgcctccagggaccacacagggaatgttatgagcaaaatggactaggtggggatggggcaacatttaagacatgtgcagggaacagcagaggcagtcatgacgtacaatgcaggtccgtgctgccccatctcctgattttttttttttttttttgagacagagtctcgccctgtcatccaggctggagtgcagtggcatgatctcagctcactgcaatctccgcctcctggcttcaaacgattcccctgccttggactcccgagtagctgggactacaggctcgaatcaccacgcctggctaattttcgtattttcagtagagaccaggtttcaccatgttggccaggctggtcttgaactcctgacctcaagtgatccacctgcctcggcctcccaaagtgctaggattacaggcgtgagccaccacgcctggcctgatattttaagagaagccattaaaaaggtttttaaggctgggcgtggtgctcatgcctgcaatcccagcactttgtgaggcttaggcgggcgtatcacttgaggtcaggagttcaagaccagcctggccaacatggcgaaatcctgtctctactaaaaatatgaaaattagccgggcacctgtaatcccagctactcaggagactgaggcaggagaattgcctgaacccaggaggcggaggttgtggtgagctgagatcgcaccactgcactccagcctaggcaacagagtgagaccccgtctcaaaaaaaaaagtttaaaaaaatgtgaatgttactgatttttagatgctgctgatatattttaactttttaaaaattatgtaagccaaataaaacacagctggatgctgggcatgggggctgggaggccaaggtgggaggatcacttgagcccaggactgtgcacctcgtctgtgcaaaatagtgagatcctatctctaaaaaacagtaagaaataaaattagccgggcatgggggcacgtgcctgtcgtcctagctacttgggaggctgaggcgggaggatcgcagtgagctgactgtactacagcacttctgcctgggtgacagaatgaggaaacctcctgcccccaccctgggatctcatctagcccagtttgcattctgagctccagtgggggatgctgacaacagaggctgggcactcgaaggccctgggctctgctccagggtccccaaagcagacagtggggagagctggtcccgcttcctctaaggcagggagctggcaggggacaagggcagagatggacctcacaggggaagggtgcgggagagaagggggattcctcccgccctggccccagctcccacagaagcacctacctggtgaaaaaggagagttctcccgccctcagggtggcttcaggtggctggagacactgctttactgtaacataccagagacaggctgaaggggccggagcaggagcgtctgcccatacccctccccttggagggataggtacctctggagacgctgcagttgccagtcttggggtcacagggacaatggtgctcacacttacaaggcctctggcagcccggcccatgccagccaaggggacactctatggaaaggagatgggaggagggaggagggaggagaaaggttggggcctccagtgtcagagcctttctcgacaggacaggatacctgcccctgcccatgtgtacagagccgggctaaaggtgaagcaccccctgccctccctggactagcccctgaacgtgaccttatttggaagcagaatctctacagaggcactgcagttaggatctcaagataagaccgtgctggatttgaggtgggccctggagccagagcccggggacccttgttttagccgagccctttgtggaacgggccgcagcagccacaggggagtcacacagtgatgtgcaggtgaggccggggcagaagacaagaggcaagcatttcccagaccagaaggtggagacagaagcagcagaggagcagtgggggctgccgggggccaccgtctccccatccgctagtggcgtggcagctcctaccttcactgcagttggacccggtccatccggcatcacagcggcagccggctgccgagacaagaccggggaggccaggtgagggcctagggcaaggcagggctgggcagagccccctccccagaacccccactcactctccgtgcacagtccgtgctggctgcagttagaggggccacagtccagctcatcacagccgggaccccgccagaagtgcccggtgcattggcagtgcccgtccacgcaggtcccgtggccgtggcagtcaggcggctggcagcggggttcgtgcacacacaccacggtggacacttggcggggacagcgccacatgttgtcctggctgtagagggatgtgatgtgtgaggagaggacacccccagacggcccctcaactccctccaggctgcccccaaccacccctctctccattctcacctgtctacctacctacctacaagatggcgtctatctatttttgagatgaggtattgcgatccttccacccgagcctcctgagcagctgtaaccgtaaggtgtgcaccatcacgcctgcctaatttttttttattttttcataaagacagggtctatgttgcccacactggtcttaaactcctgggcccaagcgaacctcccacctcggcctcccaaagcactgggattccaggcgtgagcccctgtgcccagccctctccagtcttttataggttcctccgctccctacaatccctcccagccctgggcctttcacatgtggtgccctctgcccggaaggctctcccacccccacccagctaccacctccttcagatctcagttcttattctgtcatcctcagggaggtctttgctgaccaactgaccctgctcctaggcctgggtagtactggcatcctgggggagggactgcagcaatttctgctctcttgaacccccggggcctggcacatagcaggcactcaatattggctgaatgagacaggctggggcagacctggacttcagccctcacgaaggcggctctcacgtgcttaccagtgatctgacgggtaactggccaaggtcccgttgagcacaaaggtggcagagccacccccatccaggttgatggcgttgaccacgtcctgtttcagcaggaactccgccatttcccacaggttgatgctgcggcacaaagcggcgctgctcaggctcagcgcccaccatcatttctcatttaactccttttccttccacagtgcagagcatcacgcccacagtgcaggcacatttctaagtggcccccgcccccaagcatgtctcatcctagcccccggaagctgtgaacacgtgagatcacacccatgcctgtgctgttacatggcataggaatccttaagggaggggaaacggcccggaggatctgggtgcagccactggaatcacaggagtgttcaacacagagagccttctctggctggtgacagaataggaagtgagatttgaaatacgagggggatgagagggtggccggacaactgggggagaggacacacatgggaaggaacctgggcagcttgaaggagctgaggccccagatggcggccagcagggaaaccaagacctcagtcacaactgaggaggcgacggggattcttccaacaacctaaacaagaggattctttccagataagagaagagccctgcctaaccagcatcttggttttgtccatgggacaccctgaacatagaacattccaagttgaccagcctggccaacatgatgaaaccctgtgtctactaaaaatacaaaaattagccaggtgcggtgactcacgcctgttaattccagcactttggaaggccgaggtagatggatcacctgaggtcaggagttcgagaccagcctggccaacatgatgaaaccccatctctactaaaaatacaaaaattagctgggtgtggtggcgggtgcccgtaatcccagttacctgggaggctaaggtgggaggatcacctgaacctgagaggtagaggttgcagtgagctgagattgcaccactgcactctggcctgggcgacggagtaagaccctgtctcaaagaaacaaacaaacaaaagaacattccctgctgagtgttgctaaatttgtgctggttatgcaaccagagcaaaccaaaacactctctttacaggggctagaaatgaggctcagggaggccgagggacttgtctacggcataggtgggtagacaagtcatcgatggctaagctgggattggaaccaagatcttctccctgctcactttgtgaccatttccttgtatcctatctagggttcaggaaaggtgaggcctaaagctgaagatgatgagttcttggaatcggcaaagatctcagaaccctcatcctgtgggaaggtgagggggccctgggaggggggacagataggtgtcaacatcccagaaagcaggtagagtcagagggtggctgtcattgggtcaacgttcctcctagcaggactgagccccggccggggggcctcagctcccaggactcacccacgctgctccgtttggccgtctgcatgaaagagcaccagctgccctttccggtcgtggccaatggccgtcctggctgatatcacattcacaaatttgctaaaggaacctgaaggaaaagcagcctggctgatcaccgccccttgggaggcctcctgcttcttgcctaactccacttcccactggtctgagctacctggtacctccctgggaagcacagcagcctccttgctcgtctccctgcctcccctctgcacatcccagtctccccagggcagccggggggtctcttcttacaggtaaaccaagctatgccagcctccaggtgaagaccctctaatggtttcccctgttcttagaacaaaatccaaagagccagcatgccctccccagcctcttcctcctcctgcctcagctcctgggtgtcccctcaccaccctgcagccactttgcacttcctgttccctctggctgggaactgtgcttttctctagcttgctcctttgtcagatcacctccttagtgaggccttccttgaccgcccactctttttttttttttgagacaaagagtctcgctgtgttgcccgggctggagtgcagtggcatgatctcagctcactgcaacctccacctcccaggttcaagcaattctcatgcttcagcctcccaagtagctgggactacaggcacacaccaccatgcctggctaatttttgtattttttttttttgtagagataggtctcactatgttgcccaggcaggtcttgaactcctgggctcaaccgatcctcccgcctcggcctcccaaagtgctgggattataggtgttagccaccacacctagcttactgcccactctaaaatggtcatggtatcctgtccccatcccagtattctgcatcccagtggttctcaaccttgagtgtcggtcagagtcaccatggaggcccgttaaaacatagactcttgggccttgcctctgattctgcaggtctgagggtgtggggctttgaaacaagctcctgggccacgccgatgttgcaggtccatgaagatttttttctcttcacttttctcttcctgtacccacagctccggtccccatctctcccctttcccctaactttatttttgtttctgagcacttatcaattcttttcagcatattctataactattttttgtcctatatattcaatataagcctatcttcctccccatgaatccccagtacccagaatagtgctgggcacaaagtagctgctcaatacttgttgaaagacttaagaacagctccgcccagcccactggtcctggttctcgagagggttgttgccaacagcctccccatccaacctgtctcctgtgtctcgtcacactctgtggcttggctctcgttgatgtagatgcttccattacgaatcagccacacgaccccactcagcagctgcacaaatgggttctcagtgtccagcacctcctcctcagacaggtacctggatccggggaaggtgggaagctcactcaccagcaggggcaactgcagatagtcaggctctttctccctagccatcccaacctggctgctagattccccctcatgccccaggaacctcctggggcctgagtgtagctgggacaacttaacagccctaggaatctccctgttgtcagagctgaagctggacagggttctgacaatacaatccccacaagcctttgcaaacagtctgtttcatttaacagaaatgaccatcccccaacagagctcaaatccatctatggccctcaatccccaggccatacccagcccaactaccacttgatccctgttacggcccttcattggcttccttgtttctccactgctctctcccacctggtcccactcaggatcagaacaagctttatcatcaacaaatactttttttttgagactcaaataatttttaagataattttaaataattcaaatcatcaatcttgccagggcgtggtggctcacacctgtcatcccagcactttgggaggctgaggtgggtggatcacttgaggtcaggagttcgagaccggccaggccaatatggtgaacccactcccccgttccccaccccatcccgtctctactaaaaatacaaaaatcagccgggcgtggtggcacacgtccgtagtcccagctactccagaggctgaggcaggagaatcgcttgaacccgggaggcagaggttgcagtgagccggtatcatgccactgccctccatcctgggcaacagagcaagactctgtctcaaaaaaaaaaaaatcatcagtcttgatgagttgatgtttctgacaccccactcctttttcagtccctcatacacacaagcccccctgagcctctgagcctttgtgcgtggggttcctttggactgaaacgctcttcctccagttctgaccttggctcacttagtgattcatcttcaagttcccactcaaaggtcacctcggagaggcgtgttccagatcaccctccctaaaatcaacactatttacaacgggttcaccccgttggttgctttgctgcacacacagcaatcagaatgtatgttagctatttacccggcttttgttgatttttctagtaatgggggagggctgttaaggcaaagactgtgttgttcacggctatctcaccggggcgcggcacattgcctgatacaagcaagtgctcaatgatactggatgatgaataaactctgcaaggaagcgattcctatccccattctgcagaggaggaaacaggggctcagcttggttaagtgacttgaacacggaggcacggctacaacccaaatctcaggccctctgccctcgacagcacggggctccctgcctcctcacccggtgaccagggtcccgtcgcggcggatcccgaactgcgcgttctgcagccccccggagctgctcacccgccgctcgtcgctcaccacgttccccaggcactcgcccgagttcatgcggaagaagccgccgttctgggcgacacggcagtcggccgcccgcgccgtctcctccacggtggcgcgtcgtctcgccgcgcagccgccgggtccaccgggctccagcaccgagaaggtgcgcaggggctcaacggcccgcgtcaggtggccggccaccgcgcggtccctgaagtgcgacacgaaggtgcgcacggccagaccgccggcgccgggagtcgcgggaggcggaggccaactctcgtgctcgcggttgccggcgcgcacccgtgtgcagtcccgggggaggcgcgcgcgcgcgcgtggatagggcagtagcaagtcgtcgtcgcgggaggccctgcggggacgggcggccgtgagctcagggggctgtcctcgtgagctcggaggacaggggggaccccccgaaccaggctggcccagggagctgcactcaccccgagtcgaggccgccggacgcttcccagaggaagccgaatagtgcaagccggaggagaagccagcgacccgtggaggtcgccatattggaccggggcctcgggtcatgtgggctcgcctcacgtgactcaagtcccagggtggccgctttcagctcggactgaattacctgcgctcttttcggctggcgggctggcgggcggtgctggtgatgttaactttttatctccaggtaatctcaaacctacaggaagttgcaaggagagcataaagaactctcgtagaactgttattcatgtttagcagtggtttaggcttgcctgatttactcaatcatttgtactttgttttttttttttcctgaaccaatggcaaccaaattgcagatgtcatgatcctttaccccatacctcgccatgaatctcctaagaacaagggcattttcttaaccacagggcaaatatcattaggacaactcccattgacatttctgtgatgtcatccacagctaaccttcaattgtccctctaatgtctttttttttcttttcctttttgtccgcccctgaccctgtaacccaggagttgcttttagttgtcatgtctctttgatctcttcatctggaaggctcctcagccttttgtcttttactaccttgacatttttgaagacagcccagctacatgatttgtgtgactcaatgcaaaatgaaaacgtggggacacttactaaaaaacccagaaaactattaagaatttcaagatggtcagagcaaatggttgcagcaagccagggaccttctgagtgagcccatgaagctggccctgagtatagaagccagtttattttgtagcatgtacttcaagcttcctttgagaggattcttctcttcaggcctcctgtcccagtgcagtgtccagggttgggtggtgtcttggtgccagtgcagtgcgtgggccattccaggagccacggcaagtctaattggcttgatactgttgcggtcttgccagtgcaccttaatatagcagtttctccttgtctgaactagtcccggggttctttgtcctacctccaagaaaactaaggagcgtggacacaagggtggggttggagcgaacgtttaataagggaaagaagaaagctctccaaagtggagacgggagtccgagtggattgtcgggttacagctgaatgcaaaaagctttttttttttttttttttaagacagagttttgctcttgtcacccaggctggagtgcaatggtgcgatcttggctcactgcaacctcaacaacctctgcctcctgggttcaaatgattctcctgcctcagcctcccgagtagctgggattacaggcacacgtcactgcgccctgctaatttttgtattttgggtagagacgaaattttaccatgttggccaggctggtttcaaactcctgacctcaggtgatccgcctccttccgcctcccaaagtgctgggattacaggcgtgagccactgtgcctggccgcaaaaaacttttataggacactgctctcctcctggtaactgagtaacttcttaccagtaaaactgcctgtgcagctccccttatgttatgcagctgtgggtatgtctctaggcaagtgcaaatcgctgcttctcttgtttgtgtaactgtgggtttgttttagataaggccccctcctccctgtgccggtttccatggagcccactgtgtatatgcctgaaaaggagaggaaactttttcccgggagcctgctaattatgcaaagaacaaagggcttctgcgctggaccctgtctgcttatctccgtgcaggtccagcctgagttttttcccaggttgctttatttttgccagtttctatgacttttcaggcaggccacttctgaggtcagaattttccccaacggatttttcttttccttctccctcactaccacaggtatggggggacacagataggggccaggccagccccttttcatccacagtcagcacttctggtgcttgatctcaggcccctctttgagccactgctcctttgagccagtccacggtgagggttagtgaactcagttagagagtgtccccccaaactcatgtccttaccagaacctcagaatgtgaacttgtttggaaattgggtctttgcagatgtaattagttaagatgaggtcattctggagtagggtgggccctgaatccaatctgactggtgttcttgtaaaagacacaaatacacacagaggaaagaagctcatatgaacacaggcagagattggactgatgcagtcataagtcaaagaatgcaaagaaggctagcagccaccaagagctaggagagaggcgtgggagagactcttgagctttgacagagaacatggccatgctgatgccttgcttttggaaactaatacaattcagggacctcaaaggggtcccgggaacagctctgacgctcctagttcactttaaccatgtacaaaatgactgctcctcctagaggcttaaatgaccaatatattgatgtgaagggagtatatctttctgagctttgcattgggctgctaaaaataaccagcagaggagcccaggcctgacgcctactccctgcctccggaagcgctctttttttctgcctcagttaggagttgcaggaacaggcagtctttggcaagttctgactttggttttctccctactttgaggtttgctactcctttgccaagtttttctaagcacataacgggtgccacagaaattctgcatttgaacagagcagcccatatccacagttctagccaaagctgctaagaagccaagggttttcttttttgctcttcagcctggaatacttttgtcccctcttagcatcctcatttgagttctaccatcatttgtgtgttcaacaggctgagcacctcgtatgtgctccgttgcagctgatccctgccttcatggagcttagcttttcaaggggaaacagacatgaaacagttatgtgatgaatgcaagaagcaaagggcaggactgcgagagaaggatgttgcaggtgtggcagggaagcctctccaagcccctttagactgtgattgaaggaaagaaaagatgcggctgtgtgcagatctgggccagagcctgaagtgggaaacagcttgggaggtgcagcaggaagagccacctggtgggagaggagggccgtgggggaggggttggaggtggtgagcagggttgaagtgggagggccaaggcaaggccagatcgtacatgcagggatccagggaaatgagtatggatttcagccaaagtgaaatagtaagccattggaaggtttttttttaaactttattaagataaaatttacatactgtaaaattctcctaagtgtacaatgcaatgatttgtagtaaatgcacagcgatattccagcatcaccattatccagttttaggattttttttatcacccaaaaaagttttgttatgtaattctattattatttagagacaggatcccattctgttgcccagactggagtacagtggtgcaatcatcgctcactgcagcctcgacttcttgggctcaagcagtcctcccacctcagcctcctgagtagctgggactacaggtgtgtactaccacaccaggctagtttatttatttatttttagatggagtctcactctgttgcctaagctcgagtgtagattgaaatggcctgatcttggctcactgcaacctcagcctcccaggttcaagcgattctcctgcctcagcctcctgagtagctgggattaccggggtgtgccaacacgcccggctaatttttgtatttttaatagacacagggtttcaccatattggccaggctggtcttgaactcctgacctcaagtgatccacccccgttggcctcccaaagtgttaggattataggcgtgagccactgtgcccggcccgaaagtcatttttgtaaaactcttaggaaatggaaacgtcaaaggatcaatttcttctgtccgtgctgtgtatagtatctgttgtgtaaagggctgggagggcattaacagcatcccagaaactggcgttgaggttctgaggggcaggagattctgtcataggctgcgtgtctggtaggtggcccccacgtccagttgggtacattaggggtgcccctcatcccatgtggacttgcagggtggtgtgggggctgccagctgggcagaccagactcaagcacgctcacagcccaaggtcccttccaccagctaagacctggacaaaacatctccaggtgcctcttttttctttttcttcattttttctatttaattcagcaaatattttttaaacatttctatgttccaggctgtatagtaggagccaggcacctgaagaggagcaagacatcgtctgtgccctaaagtcattcacaatctgaaaatagagttgacaagcacacaaacgaagccagagtgagctgccacagagcagtgtagggaatgagatgggcaagtaggtgtgaggaggggaggaggcttcacagaacaagggacaaccttggggaatctttttttttttttgagacggagtctcgctctgccgcccaggttggagtgcagtggcgccatctcagctcactgcaagctccgcctcccaggttcatgccattctcctgcctcagtctgccaagtagctgggactacaggtgtgtgccactacgcccggctaatttttgtattttagtagagaaggggtttcaccatgttggttggccaggatggtctcaatctcttgacctcgtgatctgcctgcctcggcctcccaaagtgctgggattacaggtgtgagccactgcccccagccaatcacggggaatcttaaaggacaaatccaatttaaccagattgggggtgggggcagattcgcaattgcaaaaatgtggaaccagcccaaatgccaatcaatgagtggataaacatcatatatatatgatggaatactactcagccataaaaagaaatgaatgaatggcattcgcagccacctggatgggattggagactattattctaagtgaagtgactcaggaatgggagaccagacatcacacgttctcactcataagtgggagccaaactgtgaggatgcaaaggcataagaatgatacaatggggccaggcgcggtggctcccacttgtaatcctagcattttgggaagctgaggtgggtggatcacctgaagtcaggagtttgagattggcctggtcaacatggtgaaaccccgtgtctattaaaaatacaaaaattaggccaggtgcagtggcacatacctgtaatcccagcacttcgggaggctcagttgggtggattgactgagctcaggagttcgagaccagtctgggaagcacggtgaaaccccatctctgctaaagcacaaaaaattagccaggcgtggcggtgtgcacctgtagtcacagctactcaggaggctgaggcaggagaattgcttgaagccgggaggcggaggttgcagtgagcccagatcgcaccactgcacttcagcctgggggacagagcaagactctgtttcaaataaacaaacaaacaaaaaaacccccaaaattagccgggtgtggtggcgcgtgcctgtaattccagctactcaggaggctgaggcacaagaattgcttgaacccagcaggcggaggttgcggtgagccgagatcgcaccaccactgcactccagcctcaaaaaaaaaaaaaaagttacagtggaatttgggaactcgggtggggaagaatgggaaggaggtgagggataaaagactataaattggtttcagtgtatactgctcaggtcctgggtgtaccaaaatctctcaaatcaccactcacgtaaccaaataccacctattccccaaaaatctatggaaataaaaaatgagaaagaaagagaataggtgaagacccagaaaaagcaaggatactggtgggacattgcccaagtcagtcttcctggctctggtgggtgagggggcagaagcttagccactgagagatgggagtggggaagcagtcatgaaagggtggcttgaactcgccccagctctcaccaatcccttccccgccctctcttgctctctcagacctcattccaagcaacagttctgcagatactgttctcacaactccttcacactaaagctacatgatggagaaagtcttaactcattccgtttcctgtgtatatttacatcttaagaggaaacactttcaaccaggcatggtggctcatggctgtaatcccagcagaggcaggaggattgcttgagcccaggagttccaggccagcctgggcaacacaccaagacccccgtctctttaaaaaaaaaaaaaaaaaaaaaagggccaggcatgctggttcatgcctataatctcggctctttgggacgccaaggcgggtggatcacctgaggtcaggagttcgagaccagcctggccaacatggggaaacactgtctctactaaaaatacaaaaattagccgggtgtggtggcacgtgcctgtaatcctagctactcaagaggctgaggcaggagaaccgcttgaacccaggaggtggcggttgtagtgatctgagattatgctactgcactccagcgtgggtgacagagtcagatcctgtctcaaaaaaaaaaaggaaaaactttaagaacatgatgacttaatggaattacttgtttacagtaggattttataccttgagccgggagccggaaggaatgcacttttgaccaaggattgtggcaggggcacatagagccaccgtgggctgggtgcttccaccaatgagggcctctctctcggggtgtgtatttggggggcagggaaagaaggccttgatgaagccctgaggtggggtttgtgccgggggaacctgcttttccatccctctctcatttaactccaagtcccaagcctcctttcctccctgtcttcctcccacccgctccaaacaatctgcctgtgactggtttttctgctctctgtgctacttgaacaggaggctgtcaggagctgttctgctccaacgaggagaaccattgactcatttgtgggtgctccttgtcttgacctcgagttttgtttcaagccctttggagggttccctctttttttcttttgagacaagttctcgcactgtcacccaggctgggatgcaatggcatgatcatagctcactgcagcctcaatctcccaagtctcaagtgatcctcctgcctcagcctcccaagtagctgggaccacaggcacgggtcaccatgcccagctgatttttgtgtttttttgtggagatggatttttctcatgttgcccaggcaggtctccgaatcctgagctcaggcaatccgcccacctcggtctcccaaagtgctgggattctaggcatgagccactgcgcctggtcatatgagagggcatttgagcagagactggggcaaagtggagtgtgagccacgtggatgtcaggggaaaagtattcagaaagataggagagccttgcaagggacgtgaactccatgtgggctggatgtgtgtgctgagtggataaattccagggagtttttgggctacagttgggctgtggcatgccactgagaaagttctttttgtgtttgtttgtttttgcttttttgagatggagtcttgctctgtcacccaggctggagtgcagtggcatgatcttccctcacggcagtctctgcctcccaggtgcaagcgattctcctgcttcagtttccctagtagctgggattacaggcgagagccaccacgcatggctaatttttgtattttcagtagagatggggtttcaccatgttagccaggctggtcttgaacttctgacctcaagagatccgcccaccttgagaacgttttttttaattttcggtttcacatcgatcctttaaatagaggatcaggctgtgaaccaggtcatcaggacgggtcatctgcttccccacgggtgtggttgggctgcagggaccttgttgctgagactaggaacagctccttgaggcaggtgctgcattagtttctggggctgctgtagcaaggtgccatcaactgggaggcttaaaccacagaaatgtatggtctcaccgttcaggagtgctgggattataggcatgagccaaggattgcctttccttgaaagtgactcatacgctccgctttcctccacagtcatttcaccctctccctggtttggtaactgaagccttctgaaatgaaccagtgtcaggctccagtgaggactccatccccaattcaggaagcacagaggtggagcataatccccccaatttgtttatgtgcggctgacttctctcaagatggtgtgcctgtttgggaaaacttttgtttgcaagacaatgtgaaagaaatccttaaagctcacagactgctgggtggatatgacattctggcccttggttcccccaagaaaacagcaacttgcagatagcaagtcaaacttgtcagcagaatccagggatgttcctcgaggcctgacaagttaagagcaatcatgggaaggcattcagaggaccgcagcagaggatcaggtcaagggaaacctacctcctaaaggaaagatcgagaagaaccatgcgccccaccacccacctgggctgctcagctgggcacagaagcagccaaggatattttcattcggatgctcacatatgactgagttgccacatgaggatgatccgtggcgattttccaccttgaggcaaagcaggacaatgcgtgtaaagaggtttgcagccccgggaccgggttttcagctggtttttctaccccaaagtccaatgcgtgcaggctgtcatcagcaccacagacagcaccagaacccatcataatgtcccagaaggttttattgctaaattagtgtcagagctccagggaacacattcagatatagtcacactgagtcagagctcgagggaagagctgtaagctgggaaccagagaaccgatgacaaggcagcggcctcttctggcagcttccggaggagcccccacttaatgggacgtcatcacttgaggcagcaggtaacgtttacttggcacttagtatgttacgggcaccatttccagtattctagaaacacaatactcacagcagtggaggtaacattgaggtaggggctgggttttgttttttttttgactcccactctgttacccaggctggagtgcagtggtgcaatcatacctcactgcagccttgaactcctgggctcaagtgatcctccctcctcaagtgagcctcccgagtagctgggactacaggtgttcactactgcacccagtgagggttggtggggaggtgtctcgttatgttgcccaggctggtctcgaacttctgaatccaagcgatcctcccacctcagcctcccaaagtgctgggattataggggcgggccactgtgcccttccaaggtaggggttattattatcgcaattttactgatgagaaaactgagtcccagagaagttggtgactgctcaaggacacagacagctaggacttgaattcaggcagcctggccacagaaccacaccatcaaccgctatgctatactgtgttttgtaaaatgacatgatggccatgtgatgcaatgtaatgatacagcagagttttgtgctcaggatgtaaaaatgagtatgtgctgcctttcagggttatctgttgagttctggctcatgacctgaactattttttccaagacccttccttctcccactgggaaagatactatatttggtacctgaacaaatagcctttaagatatcagtttatgggtctttttagaatttgtggctgggtgcagtggctcatgcctgtaatcccagcactttgggaggacaaggcaagaggatcacttgaggccgggagttcgagaccagccaagtccatgtagtgagatcccatctctacaaaaaatttaaaagttagcttggcatggtggcatacacctgttgtcccagctactcaggaggtgagatgggaagattgcttgagcccaggagtttgaggctgcagtgagcctaggtgacagagcaggacctcatctattaattaaaaaaaaaaaaaaaggaaaaaagaaaaaagaatttgtgttgagtgggattggagagttgaaacagaccaagaggttgtccaaggttgtcctcaaagctgagaaacaagactcaaccctgggtcagttgcagttgaactttattcatccgttcacacctgggtccctcccggcccccacctaccctggccttgcctactcagggcttccaagattgggtgtcggggtggctttgcttatcctccagatgccttcttcccaggatgtgatccgtgccctccaggatctaagggatgaggactaaaggggtctgttcctcctccaggcagctggcatggaaccgtccgtctcagcggctgcttggtggtggcggtgtggatgggtgtggctctctgtttgctggggggtattctgccaggatgtataggaagccacccagggctgccactgctgtggctgtgttgtgggaggagcagccatctaggggagagagcccccatgagtgctgggtggcaagaaccttggccctttattcaacacagtctcattgaaagtgcttttcagccagacgcggtggctcacacctataatcccacactttgggagcctgaggtgggcggatctcttgagatcaggagttcgagaccagcatgagcaacatgatgaaaccctgtctctactaaaaaaatataaaaattagccaggtatggtggcacgctcctgtagtcccagctactcgggaggatgaggcaagagaattgcttgaacccaggaggcaaaggttgcagtgagccgagattgcgccactgtactccagcctgagcaacagagcgagaatctgtctcaaaaaaaaaaaaagtgcttttcagatgtcattccaggcaacttgcaagacgctgagtgggtgcttcggtgctcccttaggccccttttgctgggccgggtgctcttccgccagctgctaagggctcccttctctgggaggtatgtccctcccaaataacttaccaatacagggatacaaaagcctggccaccttggcccagggggatgactctggtgcaatttatgctccaaggcattcccctcccacccctgcggggggatctggcctgaggccgcatcctgtccagctcctgcctggcttagcctgcttccctgacttacgtacctcaataaacccacgcaccggagtcctgtcccaggtcctgtgtaagaccttctgagatggggaaactgaggcttgggtagccgagctgagcccctggccctggtgactccacagctcatttcctgaccccagtggccttcctcttagttgcctctggtctgcctggtcccgtgtgacctcatggctcatggagtcagagtctcaggcctgagcacttgcctgagataataacccttaggtgtagttagttctttgagctcaaagtgggctgcacgcctctagtctcacaatctgtctgcttgtggaagggagccaggaattctttcctccctacccagagactttgggaaggggaggggaccccagccaggtccgttgaagggagggagaatgcagatttcaaggtgccgaatgactaaccctggcagctcatgcctctcagtggcctactgtatgccaaatacaatggggagggctttgcacgatgatcagttgttagcccccaacagtttggtgcccattttacagatgaggaaaatgaggctcagtgaggttgtgtgactttcgcagcaagttagaggcagaagcgggactcgaacccacacaacctgacctcaaaccctgtgctcctaatctctacaccagctgcctcctgctccgtgggcttgtgtcataagtgcaagaatcagcacacccctcctgggcagttttctaggctgctggtcaacctggaggtgttccaggaaaggccttgggctctggaatttctgtggcttccgctccagtccctaggacagtcctcgtgttgggctctggggacgggcagctgaccaggtagtacacagcaggcccctaccaccctagccataggcagccccagcccctctgtgtcataaaggcctagctagggtaggacctctggaagtctcctgggaacttctctcccttctcctgcgtgacttttggtggcagctacgaaactgactcactggatttctgctttcactctctcctgtccacctgtaggtggatgatgaggccacagtggggttgatggagagatgtttagttactggaatcatatacccacatatgttggacatccactctgtgagctggctattccatatcccttcctgtttttgcctgcacttatttattttttattttattttattttattttattataattatttttgagacacagtctcactctgtcacccaggctggagtgcagtggcacaatctcagctcactgcaacctctgtctcctgggttcaagcagatctcctgtctcagccttccaggtagcgggattacaggcatgcaccaccacgcctggctaatttttgcatttttagtagagatggggtttcaccatgttggccaggctggtctcaaacttctgacctcaggtgttccacccgccttagcctcccaaagtgctaggattacaggcatgagccactgtggctgtcctatttattttttattaatgaaaaattgaaatcaaagtcctctctttcttcttggttcctcccttcctgtgtccccctccttccctttcttctacgttatttcttgactttcttctacgttatttcttgcctttcttcccatcccaatatacttatatcctgttctcactttctttacattggccaactgaccatacagtttattgtcgcaaccaggacactttggaggaaagagggcactattcataatggctccaagacaacaggtgtaaactggggcagctctgggagcactgggctgtgtggccaccaaaactgttctggtcacttgcccattcattggctttcgggtcccttctctgcctttccttattccaaactccagcacacagacccctccaaactacatttcccaggatgtcttgcctactggtttcgaccaacaggaggtgcaggtggaatgaggggagaagccagaatatttctcccttcctctctctgtctcccccttgttcagcccctgcaggccctattaacactgcctcctcctgccattctccagctctagggagggtagtggcttcctgcaacagtaaaatctctgggtttttccaccttttctgttttcagctcttacaacacctctgagatgagtttcctctagtaaattccctctgttgaagttcctgacgcaggttctattttcctgaccagaccttgacttagaagggttactgttgctatttttaacaactgaaacttctcttttatgctcctttaacaaaagacagtatctcttggactccccactttctttctttcttttttttttttttgagacagggtcttgctctgtcacctgggctggagtgcagtggtgcgatctcagctcactgaagcctccacctcctgggttcaagtaaatctcatgcctcagactcccgagtaactgggactacaggcgtgtgccaccatgcccagctaagttttgtatttttagtagagacagggttttgttatgttgcccaggctatctccccactttctaagaggaggccatcagggacccccagcctcccttccacctctcaacatgaaggccctctgattagtgcccctttggtgatgccaagtgcttttcttccatagcagagaataaacacaggcctctgttttgctaggatatcttagtttcatgtcaagaaactcccttgggtattttcattacctggaaattgtttttctcgcctcttcactctcctcgaaaaatgctgctgatattgaatagctttagataattcttcatcttcagcatctgggagaagagcaaaagttgaacttctcaagagagatttttattttttacatttttatttctttttactgcttttattgtagagacagggtctcattctattggccaggctgggtgcagtaacgcaatcatagctcaccacaacctcgaactcccaagctcacagaatccttcctgcctcagcctaccaagtagctcggactacaggcatggactaccatgtccagctatttaaaaaaaatttttttttggtagagatggggtcttgctatgttgcccaggctggacttgaactcctgagctcaagtgaccctccagccttggcctcccaaagtactggattatatgtgtgagcccctgcagctggtctcaagctgaatttttaaatgttactcactaaacctcctgcccccataacatttcaaggaagttaggtcttctcttgaaacttgaggctattccggaagtttcctcctgcacctgtctgcagatccttttgcatggcctaaacttgtcatctactgatggttttccaaactgtggctccccaaacacccaccatcagaaccactggaggtgcctgttaaaaatggaagtccctccaagataagcaaaaaactgagggatttcattaccactagactggccttacaagaagtgctcaagggaatcctacatctgaaaagaaaaagacaataataactatcatgaaaacatgaaaaagtataaaagttactggtagaggagaaatagaaagaagaaagagaaaagaagcaaaactatcactagagaaaagcccaaacagcagtgataacaataagaaaggaagaaaaaaaaatcaaaggatatagaagataaccagaaaacaattaatgaaatgacaggagtaagtcctcacaagccaataataaccttgaatgcaaattgattcagtcccccacttaaaagatatatagagtggctgaatgaatgaaaaaaaacgacccaactatatgctgcctacaagaatctcacttcactggtaaagacacatatggaatgaaagtgaaagagtgagaaaagatcttccacataaatggaaaccagaaggaagaaggagtagctatacttagataaaacagactttaagtcaaaaactgtaaaaagagacaaagaaggtcattatataatgataaggaatttagcaagaggacataacaattcaaaaaatatatgtattaaacactggagaaccctaaagcaaatgttattagatataaagggagagatagactccaatacaataatagctgaagacatcaacaccttgctctcagcattggacagatcatctagacagaaactcaacaaagaaacactgaatttaaactgcacttaagaccaaatgaatctaacagacatttacagaacatttcatctaactgctgcagaatatatattcttctcatcagcacatggaacagtctccaaaatagaccatatgttaggccaaaaaacaagtctcagcaaatttaaaagaatttaaatcatagcaagtatcttcttgaccacaatggaataaaactagaaatcaataacaagaggaactttcaaaattgtacaaatacagggaaattaaacaacatgttcctgaatgaccaatgagcaaatgaagaaattaagatgaacatttaaaaatttcttaacacaagtgaaaatagaaacacaatatgccaaaacctatgggatatagcaaaaccagtattaagagggaaatttacatcaataaatacctacatcaaaaaagcagaaagatttcaaataacgaactaatgatacatcccaaggaactagaaaagcaagaccaaatcaagccccaaattagtagaaggaaagaaattgtaaagatcagagcagaaataaataagagactaaagaaacaataggaaagatcaatgaaacaaaaagttggtttttaaaaaagatcaacagataaattattaactagactaagaaaaaaagagaaaagactcaagtaaatgaaatcagaaagaaaaaggaacttttacagctgataccactgaaatacaaaggatcattagagactattataaacaacaaattagaaaacctagtggagtgtgctgggtgtggtggctcatgcctgtaatcccagcactttgggaggccaaggtgggcagatcacttgaggtcaggagttcgagaccagcctggtcaatatgatgaaactcagtctttactaaaaatacaaaaattagccaggcatggtggcgggcgcctgtaattccagctacttgggaggctgaggcaggagaatcacttgaacccgggaggtggaggttgcagtgagctgagattgcgccactgcactccagcttgggtgacagagcaagactctgtctccaaaaaaaaaaagaaaacctagtggaaatggataaattgctggacacatacgacatactgaaattgaaccaagaagaaatagaaaacctgaacagaccaattatgagtaatgagattgaatgtgtaataaaaagtctccccaaaacaaaaagcccaggacctgacagcttcactgctgaattttaccaaatatttaaagaacaaataccaattcttttcagtctcgtccagaaaattgaagaggaggaaaattttcccaactcattctacaagttcagcattaccccaatactaaaaccagccaaggacaaagcaacaacaaaaaaactataggccgatttccctgatgaacctagatgcaaaaatccttaacaaaatactagcaaaccaaacccagcaacacattaaaaaccattcatggctttcctactttgaccacttccagtaagtaatgaatgttttgcattttaaaaaaaatcattcatcatgaacaaggggactttattggagggatgcaaggatggttcaacatatgcaaatcaataaatatgatacattacaccaatagaatgaaagacaaaaatcatataatcatcttaatagatgcaggaaaatgcatgtgatgaaatttaacatcccttcatgataaatctctcaatacgttaggtatagaaggaatgtgcctcaatataataaaggtcatatatgacagacccacagccaacattacactgagtgaggaaaagttgaaagcttttcctgtaagaactggaacaacacaagagtgcctaatttcaccatttttatttgacataatactagaagtcttagccagagcaattaagcaagagaaacaaaaaagggcatccaaatgaaaaaggaggaagtcaaattgtacctgtttgcagatgacatgatctgatagacaggaaaccctaaaagctccaccaaaaaaactcttagaactgataaatgaattcaacaaagttgcagaatacagaataaacatacaaaaaatcagtagcatttcatacacctacaatgaactagcagaaaaagaaatcaagaatgtaatcctatttataagagctaaaaccaaaatacccaggaataaatttaaccaaggaggtgaaagatctctacaaggaaaactgtaaaagacactgatgaaagaaattgaagagaacacacaaaaaatgaaaagacatcccatgtttatggattggaagaattaatattgtgaaaaatatccatgctaccgaagtgatctacagattgaatcaaaataccaatgacattcttcacagaaatagaaaaaaaaatcctaaaatttgtatagacccaccaaagaccccaaatagtgaagcaatcctaaggaaaaagaacaaagctggaagcatcacattactggacttcaaaatatgcttcaaggctataggaaacaaaatatggccaggtgcggtggctgacgcctataatcccaggactttgggaggtcgaggtaggcagatcacttgaggccaggggctcaagaccagcttggccaacatgtagaaaccctgtctctactgaaaatacaaatattagccgggcatgatggtggtgggtggctgtaatcccagctactcgggaggctgaggcaggagaatcgcttgaacccgagaggtggaggttgcagtgagcaagactgtgctacggcacaccatcctgggtgacagaacgagactgtctcaaaaaaaaaaaaaaaaaaaaagaaggaaaaagaaaagaaaaaaggcaaatgagctgcatagacatctctcaaaagaaggcatacaaatggccaacaggtctatgaaaaacgctcactatccctaatcatcagagaaacgcaaatcaaaccacaatgagatagcatctcacacctgttaaaatggctactatcaaaaagacaaaaaatggccaagcgcagtggctcacgcctctaatctcagcactttaggaggccgtggctggtggatcactttgagctcaggaattctggatcagcttgggcaacatggcgaaactctgtctctacaaaaaatacaaaaattagccgggtgttggtggctcccacctgtagtctcagctactcaggaagctgaggctggagaatctcttgaacccaggaggcagaggttgcagtgagccgagatcgcaccactgcactccagcctgggtgacagagtgagaccctgtctaaaaagaaagaaagaaaaaaaaaaaagacaacagataacaaatgctggcaaagatgaagagaaaggggaactcttacacacagttgatgggaatgtaaattagtacagacattatggaaagcagtatggagatttgtcaaaaagctaaaaataggactatcatatgatccagcaatcccactactggatatttatccaaaggaaaggaaattggtatgttgaagagacatctgcacccccatgtttattgcagcgctattcacagtagccaagatacagcaacctgagtttctatcagcagatgaatggacagagaaaatgtggtacacagacccaatgaagtactatttcaccataaaaataaccaaattctttcattcatagcaacatcgatgaacttggaggacattatactaattgaagtaagccaggcatggaaagataaatgttgcatgtccttcctcgtatgtggaagctaaaaaagttgatctcatagaagtgcagtgttgaggcagggtgcctgtaatcccagcactttgggaggccgaggtgggtggatcacttgaggtcaggagttcgtgaccagcatggccaacatggtgaaaccccctctctactaaaaatacaaaaattagctgggcgtggtggcatgcacctgtagtcccagctactcgggaggctgaggcaggagaatcgcttgtacctgggaggcggaggttgcattgagccaagatagtgccactgcactcctgcctgggtgacagagcgagactccatctctaaaaaaaaagaagtggagtgttgaatagtggttactagaggtggggagggggatgggggagaggagataaccagaggttggttaggggatgcactagtacagccaggaggaggaataagtggtaccgttccatagcactatagggtgattgcaaataacaacaatttgtggttttttttttttttttaaagacagtgtctcgctttgtcacccaggctgaagtgcagtggtgcagtcatggctcactgcagcctcggcctcctgctgggctcaagtgattctcccacctcattctcccaagtagccgggaccataggtgtgcgccaccacacccggctaatgtttttgatatttttggtatagatggagttttgccatgttggccaggccggtttctaattcctgagctcaagccatctgcctgccttggcctcccaaagtggtgggattataaggcgtagcctattgtgtattttcaaatagctagaagagcgaatttggaatgttcccaacacaaagaaatgacagatgtttgaggtgatgcgtctgctcattacatattgtatacatgtatggaaatatcacactgtaccctataaatatgtacaattattacatgtctattgagaataataataaagccaaaaatgcaagttccacagccccatccccaacccgccgaagctatacatctggaggcctaagaatcttcatcgtataaactcttttaaaaacgcaccatcttatttcaaaagcttttgcttcgtggagcatcccaagcttctaatgaggacactagcatttcctgggagctgccgtgtacctggcacaggctatgcggcttcaaatgtattacgttgactctccttgcagctcaggaaggtggggattactatgctcatttattttcagacagggaaattgaggctgagaggggtgaagcgacttattgcaaagggaccagctgtccattgtcacatggctgggaagtggctgagtcctctgcctctccaccctctgctacgtcacctcctcccatgtagttgttcccagtcacccacctggagagcctttcctggacttctcttcttcctcaccctgtcgtctcctttatagctcttatcagaatgtgcaattatttcacttcttggtttgtttaggtgatttatgtttcttttcctcaggcctctagttttccctagagcctagatggtgtctggtacattagtgggtgctcaatacgtacttgctgaatgaatgctgatgtggtttggctgtgtccccacccaagtctcatcttgaattgtagctcccataatttccatgtgctgtgggagggacctggtgggaggtaattgaatcatgggggccgtttcccccataccgttctcacggtaatgaataagtctcacagatctgatggttttataaggggtttccctttgtgcttgcttctcattctctcttgtctgccactatgtgagacgtccctttcgccttccactatgattgtgaggcctccccagcagtgtgcaactgtgagtccattaaacctctttttctttataaatcacccagtcttgggtttgtctttatcatcagcataaaaacagtacaatacaaatgggcttgttaatgcagctgtaggggccaacaccttccaataagacggcctcctgtcttgccacattttggcttccaaggctccgagcccgtttctccttgtgtgtacacgtctgtgtgtgtgcacctgtaggttacaaatcccttggcaaccttaacaccaatgcattgttcccacacctggcctagaaactcagagccacccccacccccactgccccccttcttagccagggcagcagcgcagctcaccaggctccccgaagcatccttcctgctgtttctgccagctgagaatggcctccagccaccggagcttgtagaagtcggagaagccgcccattccacagaacatgactggaagtaaagacgggggccctctgcaggcctgccccccaggcccacctcctcccactccccagggctgccacggtgccacctgccttcatctgcctgggttaggcttaggaggtgggcgttcaatgcagaggagggaaggaggcagcttgagcctttgcctgaccaactaggggctcccatgcttgtgtcccgcctcccactgagggccttggtcagggctgctccaaagtcaggatcagtggaggagtttggacaccccagccagctagcagcctcccaagcgctccctgtctgcctcatccataaggctttgtgggtctgtctgccagtcacctggtccatctgtgtagagctccgtcactggggcagcctttgggggcaggaaactgtcacacagtggcaggtaaaatacaggatgcccagttacatttgagttttcgataaacaatgaatataatttttgagtgtaagtatatcccatgaaatagttgggataaacttatactaaaaatggattcattgcttatctgaagttcaaatttaactgagcactctgtatttttacttgcttaatctggcaactccgtgtgtgtgtgtgtgtgtgtgtgtgtgtgtgtgtgtgtgtgtgtgtgtgtgtgtgtgtgtgttggtggggggacaccctgttcctttgccccgggggcagaatgctggccatactgttttccatgaagatgtcccgggtagggtaggcgtatccgatggcctcagctctgcggttcaagtccatcatgttggcgcagaagaggttgatatagtcctggctctgttggagtggtccctgtgtgcaccccctctggggagacaaacacccaaagacaagggagtcagtggtacagatgacagacacacgccctgctatgggaaagtcttgcagttctgagacggtcttgcaaggggctgtgtttagggctgtgtttagggcaggtctttttctccttttcgcaggatttcttccccatgcacacccccagcctgctgggttcgagatccagctctgccacttaggagcaaaccacttggtttgctaaagtaacctttctgagcctcaagagtttttatcaggaaagggcgaggcctctagaaacggcaccagaggggctctcgtagggggatgacacagctgggaagtgcccaatgtgatgcctgggccactaggaggtgctctgtgaccgatcgcgggggcaatgcaatgtacaacgagcctgaacccgcgggcagcttcagtgctactcaaagtgtgggccaagaaccgggctggtgactccccacactgggagagaagaacaagagttgacagcaggctttagacacttctgtagcagtggtcagagttactttccacctgctgaatctaatgatcaaaataattcccttgtaatatggtttttattgtatttataaaaatattgggctgtcacagcttgcagagaaataataatttttaaattctgttgaacaaaaacagagagtgtctcctcagctaaggatttctggacactgaatcacattgttttttgaatgaagataatgaaccctacctttctgtatgaagaaatatatatggccaggcacagtggctcatgcctctaaccccagcactttgggaggccgaggcgggtggatcacgaggtccggaattcaagaccagcctggccaacatggtgaaaccccatctctactaaaaatacaaaaattagctgggcatagtgggacgtgcctgtaatcccagctacttgggaggctgaggcagagaattgcttaaatccgggaggcagaggttgcagtgagctgagatcgtgccactgcactccagcctgggcaacagagtgagactccatctcaaaaaaaaaaaaagaaggaaaagaaatatacatatatatatgtatatatatatgtgtatatatatatatagtggtatatatatacatagtggtgtatatatatagtggtatatatagtgattatatatatcgtgatatatatatagtggtatatatatagtggtatatatatagtggcatatatatatagtgtgtatggtagtatatatataaagaaaagaaatatatatactggtgtgtgtgtatatatatatatatgccaccatatatatatttttctttttctatttttttatatgtatatatatagagagcggcatatatatatatagtggcatatataatgtagtagcatgatctcagctcactacagcctctgcctctctggttcaagcgattctcctgcctcagcctcccgagtagctggaattacaggtgcatgccactatgcccgactaatttttgtatttttagtagagacgggattttaccatgttggccaggctggtctcgaactcctgatctcaagtgatccacccacctcagcctcccaaagtgctgggattacaggtgtgagccaccgtgcccggcctcattcatttgtttttgtttacagagttctttctgatgattctcttttattctctctttctctctctcgttgtgtttttctgatgccctacagtccagttcagcaggcaaagctatctgtttcactggcctaacagaatcccaaatgccagatcccaaatcggctcaattacacagcaggagtatgataggggccctacttctccctcctgaggtcccaagtagaaatccaaagctctgcttattttcctggtgtgtagcagacagaactacactgccatgagccctttttcatttatttcttttttctttttttttgaggcagagtcttagtccattgcctgggctggagtgcagtggcgcaatcttactcactgcaacctccgcctcccgggttccagtgattctcctgcctcagcctcctcttgtagctgggattacaggtgcacgccaccacgtccagctaattttttttttgtatttttagtagagaatgggtttcaccatgttggcccagctggttttgaactcctggcctcaagtgatctgcctgccttggcctcccaaagtgcttggattacaggcatgagccaccacgtccggctgccccttttcctttttccttccccttcccctggcacggcgggggctccctgggcactcaccattctggcccagaggaagaagagcagttggtgggacaggcagtagcctgagcagccgggcttggtcatgaggctcctgcagaggtctgagaggccgcagggctcgctgctgtccgtcctgggggaaagtggttccaagctgttaaggatggagcgctgactctgccctgcgtcttcccagccccctagttgtagttgttggaactcccagtagattccagacacccagctgggcatgggggttgacagagacaatacagcagtcctgcattttgatttgctaaatctggctgccctagcccaggaaagatgacgctagagctattctggggttgaggaagccaccaaggctgaaacttcctattgctccatgggccaaatcacatcttttccagccccgaacagtgggtacttgaacccagaccacttggaatctgggcccaacatgcttattcctcctgcaccagccaggcgcggtggcttacacctataattctagcactttgggaggctgaggcaggcaagtcacctgaggtcaggagttcgagaccagcctggccaacatggtgaaaccctgtctctacaaaaaatacaaaaattagctgggtgtggtggcacgtgcctgtaatcccagctactcgggaggctgaggcaggagaatcacttgagaatcacttgaatccgggaggcagaggttgcagtgagttgagatcgcatcactgcactccagcctgggagacagagcgagactccatctcaaaataaataaataaaaataaaataaaataaagtaaaaataaaaaatacacacacaaatacaaaaattagccgggcatggtggcgcacatctgtaatcccagctactcaggaggctgaggcatgagaatcacttgaacctggtaggaggagcttgcagtgagccgagaaagaacacaccactgcactccagcctgggggacagtgagcctctgtctcaaaaaaataaaaataaataaaaatttttaaaaagcagaggtccttggctggggcccagcccctccgtgaatccagctgtgtcctggcctaagcactgctctgaaggatgctgacaggatgcggcctgggcaccggctgcccactttgcccatgggccctgcacctagggctgccctggggccttgttccaagcccaccaaacaccaggataaaatgaggagcccagctaggctcagtcctgtcttcctggagctgcatcctcactggggatggggacaggctcataatacaaatgtaaattgcatctgtggctataagaggtgccaggagaggccctcacaggaggtctgctatgtgctggggtcagagataggatggggttggaggtaggatgctggcgccagccctggaggatgggcagacttcctgaggcccagggggtggagtgggtggggtggggggagcaaagtctttgaagtgggaggaagccttggagagtctgaaaagaggcctctaggggcctggagacttggaactgcggagaggaattggggatttgtcctggggcctggaggtggtgtgttcagccatggctgctggaaggcctgctgtggcatgggaggccagcgggcggctggagcaagggggaccctgctggagtaggagagggcagtacccggcagctacagggagctgcacctgtgtctgcacaaacccctggcttcagccctagggcttggagaaggaggagcgggacaggaccagctgagaactagtgcgtttgggtttccagcaaatagggcaagtgcagggcccacccggttcccagcagctgcaccaggcacacgtcacttctctcctctgagaatgagtcctggggcccgaacgtggggtacaccaaggaggcatcagtgtggatccaggcatgtgggagcttccaaaacccgggctggagggtcagctggaactctggcagagaggacagatagatggggtggggtgtgggggtgacccaggagcagtgggccaccctggtgtccccacctcctcctgcagccctgcccactggcaggtgcagctcagggctctaagccctgtcccctggtcccagattgggtttgaaacactcaagaaagctccttttgcttataaaaccattttttcccctaatcaataggaacagtgatgggacgggatttgactaaacccactgcatcccatggaaaccccagataaataaaaggtttagtttcccaggtgcagggctcacgcctgtcatcccagcacttggggaggctaaggaaggaagatcgcttgaggcccaacgttcaagaccagcctaggcaacatagcaagactctgtctccacaaaaataaaaaaagtagccaggtgtggtggtgtgcacctgtagtcccagctgaggcaggaaggttgcttgagtctagaagttggagaatgcagtgagctatgatcagccttttttttttttttttttttttttaagaggcagggccaagagcggtggctcacgcctataatcccagcactttcggaagccaaggcgggcgaatcacttgaggtcaggagttcaagaccagtctggctaacacagtgaaatcccatctctactaaaaatacaaaaaattagctgggtgtggtggcaggtgcctgtagtcccagctactcaggaggctgaggcaggagaatagcatgaacccgggagacagagcttgcagtgagccgagattgcaccactgcactccagcctgggtgacagagcaagactccatctcaagaaaaaaaaaaaaaaaaaaaagccgggcgtggtggcgcatgcctgtagtcccagctacttgagagaggctaaagcaggaaaatcacttgaacccaggttgcagaggttgcagtgagctgagatcgcaccactgcactccagcctgggcgacagggtgagactctgtctcaaaaaaaaaaaaaaaaaaaaaaaaaaagagagacagagtgagacactgtctcaaaaaaaaaaaaaaaaaaaacccccccaaaaaaaaaaacaagtggggaggtggaattagtggggaggtgatattggtagaccttttggtttggtgagaacgtggagctcttaactaaacagatgcccagtcatagatatctttaagatgacataggtggggacagtgttagggaccaggcctgggagagggtgggggaccttaaaattggaaaggtcagcatgggctatggtccctgcggctggactgccgtgtgagcatgaagcgtggcctggctacctccccgctcacccccatgcatctgatgggagtggggagcagaggggacagggttggagcagcatgatggactggttatttgtgccccgcccttgccatccaggaacaactcagccaaacttattagatgggaccttttgcagggtcactcggggctggtgaggagagagagactctcagtggtcataaggcatgagaaagataaaccccactgttttgaaaaatagtgtgtggacaacttcgggaatttctactgacatttaatgaagtggattaaaataatttggtgacatgggacactactgtttgctgtgcaaagggttgaattgccttttggatactctcccctctgggacagcccagcctctccgctctagtctaggaccaggacctccagcttgtgcgtgcgctgaatgcttgagagaagacaccctgcttcctctgcacacctctgtgtgggtaggagagcccgtcagagtctgaagtcaaggatgaccgcacgtccccagggctcgtctgtggcttgctcagcagacaggtccaagttggttacggactgtcccagcccagccttgccccaggagagcccacgctgggttatttcagtcaatatccccataggcgctattcctgagggaatgggacaccctgcgtgtgctcacctcttaggtacttgggatcactcagcttgaggtagtggagggatctctggatggcagcctccagcttctcccccagcatccccacgcgcaggctcagcggctgcagcaggggctcctgggcccacttctcccggacactttttagctgctctggaagggaacagagttaattcattcaactatttggaatcgggacctttttttgccttggaacaagaaaaaaaaatgccccaaagtctaatgcttcctgggagcctctctgccttctccagcactcagaggggaaggatttactgagctgactggaaatgaggccaggatgggggtgatctgggcaatgagaatgggtgtcagagtagtagaaggtggtggctgagagcttggtttctggaggcgggcctgggttcaaatctttgatacttgaggttcaaatcctcaaatccttgactcatatactttcttgttggatggccagagaaaggttgcagggtagagaaccactgtgtacagttgagcaggttgtacactgcacaagggcaacacacatttggatcatgggtttgtatatgcagtaagacaatttcccagcagatggctgtcaagtgacttcaggaaggaagtgcctttttctaattcccacagaggtaccctgtgggctagcagtggctttgttgaggtgggagacaatggtgaagatccagaggtggccagaaattggggagacatgagtgagaacatccgagtgagagcattcacgcagggctgagagggcgagggatgaagtggggcagctgcagtcaggtaggaaccttgttagggaggatgggctaggttaagaaggatgctgaggtagtcctccagggcgaccggctctggcacgccccctctgctcagccccctccatgggcaaacccgcagggaagaagtaaaggcttgggagtgctgacagggaggggctccctgtgtgtcagagtgtctcctcctgtgattgcaccgggtctacaaagtccaataggacaggggtccccaacctccagtccattactggtctatggcctgttaggaatggggccgcacagcaggaggtgagtggtgggtgagcgagctaagctgcatctgtaatttacagccactccccatcattcgctgtcactaccgcctgagctccgcctgctgtcagatcagtggctgcattcgattctcacaggagtgtgaaccctgttgtgaattgcacatacgagggatctaggctgcacacaccttatgaggatctaatgcccgatgatctgagaccgtctcctatcacccccagacgggattatctacttgcaggaaaacagtctcagggcttcaactgattctacattgtggcgagttgtataattatatattataacataataacaataaacagaaagtgggctgggcacggtggctcacgcctgtaatcccagcactttgcgaggccgaggcaggtggattacttaagtccaggagttcaagaccagcatggccaacatggtaaaacctcatctctaccaaaaatacaaaaattagccgggcgtggtggtgggtacctgtagtcccagctatttgggaggctgagcaggagaatcgcttgaacctggaggtggaggttgcagtgagctgaggtggcaccactgcactgcagcctgggcgacagagcgagactccgtctcaaaataataataatataataataataataaataaaaaataaagtgcacaataaatttaatgcacgtgaattgtcctgaaaccctcccctccacctcagtccatggaaaaattgctttccacaaaaccagtccctggtgtcaaaaaggttggggaccactgcaatgggacgtagaccctgcccactgggagctcattgtttagagagacacaggtgaggaagccgttgctgctagtcaaggatgctcaatgctttgatagatggaaacagtaatggctgacaagtactgagccccactggtaagatgacatatacacacaatctcatgagacacatgtgcatgatcgtgtgatactcccatccaccagctgcagctgaaggatgaggaaaccaaaactccacgagagcagttaactcagtgccatgcagccagttgggggagatccaggatttgaacctgggcagtccagttctgaagctctgttctaggcactggcactgcctttgctcccttctgggcacagttcacgggtgtggttgtattaagcactgaattcctagggaatctgttatggagcaagattattgagaggagaaggggcagtggatgtgggatgtggcgtgggtggagaagccgggctcactgcagctgccaaggagtggggaccctggtctgaggctgttaggtggggccgctttcccagtgaatgctgcccagtcatgattaagagaaccccctcccttctttgctaaaagaggataataataatgggtgtaacctcagggatgacggggagagggcactgaagtaccccatgcaatgcacctgggttgtgcccacattgagcagatacttagtgaactacagcttttgctatcacatgcgccccaggaagcacccagccctgtgggagccacctgtgtgcttgtgtgtgtgtgtgatatgcttgtgtgcatgcgtgcatgcgtgcttgtgtgtgtgatgtgcatgtgtgtgtgcgtgcgtgcatgtgtgcttgtgtgtgtgtgcatgatgtgcgcatgtgtgtgtttaccttggcctgtctccagcccccttcttggggatcttatagctctcaaagctaaacaaacacttgactgtttttgcagaaccttcaggagactttggctgcaagtggaggaagtggggtgggaacccgatcttgagggtcctcagttttgtccacagccacctcattcaaggggaggggtcttcccacaaatatctgttaacggggcactctccctgctccccttgttcgtggcgttgtgaggaggggctgtcaaatggatcatttcattctgagaaaaagataattcccaaatcccttcccatgttgcctttaaatctttcctacttctaaaaaattgcgtaacagttagctgggccacagccgccaggaagatccagcccctggcctcctctctccttatagccgaggcaggctatactggggccaggagtctgccaggtcccaggcgtacagagcagggcaggggacaaagctgagagctagcttcccagtgtccagccagaggaattggggctcactcaccttccagcactcggacccccaccatgccatccaggttgatttcaggcagcctctgttctaggaagacggtggctctctccagcgcagacaggatcaggtctgcaatggtggctttactttcagcagtgtccagcccaggcagtgaggaggaccacagcggtggcagtgctgtcagtaagagcaggagcagcagccccaggctggccatggccggcctctgctcactgctggtcacacgctcagcaccctgagctctggccaagcccagactgcctctgcacgccctcctcccacctccttcccacctccccctggcagacatgaagacaagtggcccggcagggctgccaagaagcctggggtggcctgggcaaaggactctgggaagggtggctgcagggggatgacggttaggcagcggaggttaggccagtcctgggcgtagagcctgctgtccacgggatgctggggagagggctgcccgccctgtccttctcagccctgattctccaggctcacaggctagatctttgatctagcaattgcaattcaacccagaaatccaaaagctctgaaagcaaaacgaatttttttttctttgttttttgaaatagggtctcattctcttgcctaggctggagtgcagtggtttgatcacagctcactgtagccttgacctcctgggctcaatagatcctcttgcctcagcctcctgaatagctgggacaatcggcatgtgccaccatgttgcctaatttttgtagctttttttaatagagacagggtctcactatgttgatcaggctggtcttgaaccgctggcctcaagcgagccaccttctttgggctcccaaagtgctgggattacaggctggagccaccacacccaggctttgttttaaataaatttgaaacaaactcatttgagggcacgtctgccttgaactgaggcaaacttccttaaaggggcaccgtccaattgaaatagaattggagctacaaagatgagccatgtgtgcatttcgaaatttcctagtagccacatctaagaaagcagcaataagcaggtgaagttaattttaacgatctagtttatttgacccagttatttaaaatattataattacatctgtaatcaatatagaaatgatttgtttttatttttgtcatactaagtctttgaaattgatgagtagtttatgttcacaacacaattgttttattttgttattttatttttaagagacagggtctcattctgttgcccaggctggagtgcagtgatgtggtcatagttcactgcagtctcgagctcctaggctcaagggaccctcgcgctttagcctcccaaggagctggcactccagatgtaagccaccatgccaggctaagcacatttcaattcagactatccatatttcaggggcttgatagtcacatgtagctggtatactgggcagtgtcttagttttgtgctactacaacagaatacctgagactgagtaatttataaagaaaagaaattcatttggctcatagttctggaggctgggaagtccaggttcaaggggttgcatctggtgggggtcttcttgctatatcatcccacggtggagggcagaagggcacgagagctggagagagagaagagaaagaagctaaactcattcctttatcaggtacacgcttttgcaataacagcatgaatccattcatgagggcagaggcctcatgaaagattccatctctcaacactgttgcattgagaattaaggttccaacatacgaactttagggcacacattcaaaccacagcagagagtgaggacctagcgtccttattggtttcattcagtgtgaatgcgcatctgtttccttgcagaaatgttaatgttggtttcctgggtgctgtcccaaaccttgctggggctgttgtatgtatgtgcaccacattatctttctaaaatcccaacaattttgaattcagaaacatacttggtcccaagggcttcagcaaacagattacagatctgtaataataatcaaaagaacaccactaaagtgtgtatgtgatgctccctatgtgcagatgctaggttagggcttctccaccttttaatttcgtcattgttcttttttctacccccggagtgtttttagacgttttaatcctgaaaaatctttagtaagaggcttattgagatattattcacataccataaaattcaccttttaaatgtgtacagtttcacagtggtttttagtatattcacaaagttgtgcagccatcactatctatctccagaatgtttttgccaccctgaaaagaaatcccatacccatttgcagaaactccctattccctcctccccagcccctaccaaccatgaatcaactttctgtgtctatggtttgacctacggtggatatttcatataaatggaatcatacaatgcgtggctttttgtgtctggcttctctcactcagcgtgatgttttcaaggttcatctgtgttgtagcacatgtcagtactttattcttttttatggatgaataatatcatctcccggggaagcccctcctgctctgatgatttaagaggatgaggactatggagatgacaaaccaaaagtagacacctaggccgggcatggtggctcatacctgtaatcccagcactttgagaggctgaggcggggagatcacttgaggtcaggagttcaagaccaacatggccaacgtggtgaaaccctgtctttactaaaaatacaaaaattagccaggcgtggtggcacgcaactctaatcccagctacttgggaggctgaggcaagagaatcacttgaacctgggaggcagaggttgcagtgagccgagatggggccactgcactgcagcctgggtaacagagtgagactctgtctcaaaatataaaatgaaatgaaatgaaatgaaatataaaataaaataaaataaaataaaataaaataaaataaaataaaatgaaaacaagacacctggagcagggcgtggtggctcacacctgtaatcccagcactttgggaggctgaggtgggcggatcacttgaggttatgagtttgagaccatcctggccaacatggtgaaaccccgactccactaaacatacaaaacttagccaggcgtgatggtgcagggctgtaatcccagctactagggaggctgaggcaggagaatcacttgaacctgggaggtggaggttgcagtgagccgagacggcacccctgcactccagcctggacgacagagtgagactccatctcaaaacaaacaaacaaacaagcaaacaaggagacacctgggaaacctcgggtgggaggctgtgggagctgtggacagaccgcattctgttcatcactcatccactgatgagcctctggattgtttccatgatttgattcttgtggacagtactgatgtttgtttacaagtttttgttcgaaaacctgtttttcattctcctgggtgtatacgtgggaatgccattgctgtgtcacgtgataattctatgttgaacctaatgagggaccatacgactgttttccacagtggctgggccatttacgtgcccactggcagaagatgagggttccttatgtactgccccatgaaattttattttacttgtttatttttttgagacagggtctcgctttgtcacttaggctggagtgcagtggtatgatcatggttcactgcagcctcgacctccctgggctcaggtgatcttcccacctcagtctcccgagtagctgggactataggcacacgccaccaccattttttgggtattctttgtagagatggggtttcactatggtgcccaggctggtcttgaactcctgggctcaagtgatccttccgcctcagcgtcccaaagtgctgggattacaggcatgagccactgctttcagccttcataaaattttaatactgcagatatactgcatgcttgtgtattgtatcattatctgtgctttatacataaaaagggtaaggatgttttgctccccaagagccatttttgcccccttgggagcaccactgggaacagaggttctaggggaagcttgtcattgtcattacttctgttaatccttgatcacccctcaagtgggtgctcagtcaacttgaacaaaatctgaggctccaagggagattgagtgacttatccatatatcctcttgattgttggaaagactggatctcatgtggaatggatgccaagtgagaaagccggacaggtgggctggcccagctatgaaaccgcccccctgctggggatggctccgtcccctctctccaggagacaccacggcaactccctccccgacggaggttcacctaccagagggaggcatctacttttggtttgtcatcaccatagtctttatcctcttagctcatcagagcaggacaggctctcaaagacttgaagttcccctcccttaattcacagacgaagaaagcaaattgatggggagtgactcgcccgaggtggagcaggaaagccaggagtcctgaggctgaggtcccagatccctacctgtcccattacagagcgtcgacagagttgggcaggcgatgtgtcacaggcctccaccccagcacacgcaacctggaggcaggggcctcgctgggaactggaggataaatgccgctgccagcatgtttgtatgcccatccctgctgtctgcagatacttactcgtccttcctttccttctgaaagctcgggtttcaaggtctggcttaaggcgtgagctgtcccttctgaatccatagaaagggagtgatggggcaattgtgaaaagcagatgcaaagtgtgccaagccctgagctgagcccagggacactggggagccacatccatgtgggctaccctgtcccgtgggtgctgcctgtggtcctcatcaggggaggagtcttgtttgtttgttgaatacggtctgggtggtggctctccaggttctgcggcagctcccaagtggaggcaatggggtagcatcaccagtgagctcttggtgtttctctgcaagggaccgctttcaaagaaaaaaggtcatgatacggtttggctgtgtccccacccaaatctcatcttgaattcccatgtgttgtgtggaagggacccagtgggaggtaactgaatcatggggtcaggtgtttcccgtgccgttctcgtgatagtgaataagcctcacgagacctgattgttttataaaaaggagttttcctgcagaagctctctttttgcctgctgccatctatgtaagaggtgacttgctcctccttgccttctgccatgatggtgaggccttcccagccatgtggacctgtaagtccatgaaacctctttcttatgtaaagtgctcagtctcgggtatgtctttatcagcagcatgaaaacggactaatacaggccatcgcagagacacacattaaactctcactatggctactttgggaggtgaaattggagggtcactgtggaaatttcctttctagccattgatacttaagcaaaatcatgatggtgtttacttccttgtttgtccttccccctctctaccttttaaatgttttattaagtgtgatgtacaccctggaaaatgggcaggtaatctgctgcttgaggtaccgccccaaatgcagcacacccacattaccagcaccagatccagaagcagaacccaccagcccctaacttctaacagcgaggactggtttttatttacatagacggaactctacaattcgtactcgtcagcatctggctcctttatcaatgttaggatgaaatttatccaaattcttgtgtcactatattttgaaattatctttgaatcctgaagagagttcttagatcccaatacagtaacagctttactttagtcggggaaatacactggtgtgtagggaatctggtgtatgtgcgtgtgtcctactactactaattcttggccccgaggggctcctgggggttccccgggcccctgttagggaaccgcgtccacttctcgccctctcggcccacttcggaggctcggtctgcggctgcgcacagcgcgaggaagcgcggtcacgtgactgctgcgggccagccaagatggcggcctcatgcttggtcctgctggcgctgtgtctgctgctgccgctgctgctgctgggaggatggaagcgctggcgccgggggcgggcggcccggcatgtagtagcggtggtgctgggcgacgtgggccgcagcccccgtatgcagtaccacgcgctgtcgttggccatgcacggcttctcggtgaccctcctggggttctgcagtgagtggccaagggtctgggagggacgatgctctctcagccgttgatcctcggttctaaccgccccggggagtcgaggcggaagtgctcctttagtcgccgcctttgggcagctctccgagattagacgagcggttctgccccagcctttcctgggtgggtctctaggtatagccggcgttaatcttgccacgtgtcagaagtgtgttaagtgaatccattgcgtggtctcacgtaattctcctagtaagtggaacccaggtgcgtggaactccagggctagtgctggtagctacgtccctgtgcagctacccttgtcaggctatgtctgagctgacaggatatttcattcctcatccctcaacgcagagctctgcagacagatgttttcatttgttcttcatgtccagcttttccccacagtgtgcagggcagcggtgtctgctccctcattattctccacgttggtatcttgagagggtagctcaaccccatctcaggaagaagtgggaacagcactagttgcctttaatccctgtttagaatctgctatcctagggtgatggggtagagtgggacttcctagggatggctctgtggtgggaaaattccactatccagacaatctagattagtttaattgagcacctactgtttgccaggcatcatgttaagtgaaggtaggtaagattcaggccctatctctgtgtgcctcctagagcaatctgaacaagaattggccgcattctctgttctggctagtgaggagcagagagaggttttgaaatatcttactttccaaaacactgtccgtgattcagcctgagttgggagattatctgactttagattgctgcttctggtacattaaagggatcattctcatttttcagactccaaaccccatgatgagctcttgcagaacaacagaattcagattgtggggttgacagaacttcagagtcttgcaggtaggatgccgtcaactccagaatcctctgaatccatgggctgggggcagggggtgttcgtttgaaaagccgtgcagattgccagacgctcctttggtagtcacaggtgttttctgacttgcagttgggccccgagttttccagtacggagtcaaagttgtacttcaggctatgtacttgctgtggaagttgatgtggagggagccaggtgcctatatctttctccaggtgtgtatcagcctctgcctccctctgtgagagccatgttagcagtttactttccagcacaaattggtactatattgcatattcatatgtgtgtgtgttgtgtgtatgggcgtttaaagacatgagtaggagcctatggtatgtgtctatttatggcacctatccatgctctctgtgtcattacagatagtcttacattgtactgactgtgtatcaagtgttttccatgtattaactcatttagtcctcacagttaccctaagaaatattgcatgtaggtaatacaagaacctgtttcttaaggttgttctcatttagatgagaaaacctagactgagaaaggctctgtaagtagcccatcgccatacagctaggaagtggtggaatcaggatttgaacgtaggtcgtcagtgtggttctatagtatacacacgcacgcatacgcgcgcacacacaaacacacatatatttttttgagacagagtttcgctcttgccgcccaggctggagtgcagtggcgtgatctcggctcactgcaacctctgcctgccgggttcaagtgattctcctgcctcagcctcctgagtagctgggattacaggtgcccgccaccacgcccagctaatttttgtatttttagtagaaatggggttacgccatgttggccaggctgttctcgaactcctgacctcaggtaatccgcccccctcggcgtcccaaagtgctgggattacaggcgtgcgccaccgcgcctggcctatcgttatacttttaatcccttcccttgatcactttttctttaaaaaatttttctttcttttctagctgaaggaagaatacttttttttttaaatcaatttttaatatatagaagcaccttcctcttttatttatttatttttatttttcctgagatggagtctctgttgctcaggctggagtgcagtggtgcgatcttggctcactgcaccttctacctcccgtgttcaagtgattttcctgcctcagcctcctgagtagctgggattacaggcatgtgccaccatgcctggctaatttttgtaattttttttagtagagatggggtttcgctatgctggccaggatggtcttgaactcctgacctcaggtgatccacctgcctcggcctcccagattgctgggattacaggcatgaaccatcgtgacccacaccttcctcttttaataggcagccttgaattccaatatgtgatgtactatactgcatgtatttagtctcatgttaatggatactcagattcttcctgattttgtttttacttttacaaatagtgtggctccaagcacagcgagcatatgccttttgtataagtccagtttctttcttagggtaacttcccagcagtggaattgtgtagtcaaagttgatgcattttaaaaatgtgtatgttactggatagctttagagtaaggttgggtcagtttggcccccgctgagtgggggtacctcttctcccccatgcttaccatcaccagctgttgttagacctttttagaatttgcattccaacaggtgaaaaatgccatctctttgttctgttttttgcctccttgattattgatgatcttggacttttcaggttggttctgtttgtttgtttggtttttgtttgtttgttttagaggcagagtctagctctgtcgcccaggctggagtgcagtggcacaatcatagcttaactgcagcctcatcctcctgggctcaagtgatcctacctcctcagcctcctgagtagctggggctgcaggtgtgtcccaccacacctggctaatttttaaattttttgtagagatgaggtctcactgtgtttcctaggccggccttgaactcctgggctcaaatgatcctcctgccttggcctcccaaagtgttgggattacaggcatcagccaccgcacctggcccattctgtttcttttatgactttttacatctattttggtggtggagagggtctttcttctgcttattatcaagagctctgtaaagataacagactcatcaccatgtgtgttgtgactatttttactgggtttattgcctagcatggtctgggtttcctccccttcaagtctctatctttcctagaaccccccaggtctgcctagcattgctgtctgctggttcgtgggctgcctttgtggaagcaagctcgtcattgactggcacaactatggctactccatcatgggtctggtgcatggccccaaccatcccctcgttctgctggccaagtggtgagagtctaggaagagggtaaaataccgtcccctaaaccactcaaggatgagtgagaagaagggccatagtgggcctccggaagtcggttccttgtgggctctgcaggaggtggggtgaggctggtgaatcaggccgaatgctggttccaaatgatagaaacaggcctcagcaaaggaccacattttttggcccatgaaatggaagtgtctgtggaaatggttggtttcgagctcagcagtgtcactgggacccagctcacgtctgtctccacactcccttctggtggtggttcccggaactctcctagctcttgtcctcacgtaggctcattggggagggcagccctttctgattggctcatgtaggttacctgccttcctctgatctgcctgttgaggccagggggcaagtgctccagcagaagagctgggtctcaggagcatccatatctcatggacagagggtgggtgagggcagatccccaaattaaaacccagggctgctgttggtagctggagaagtgggccacagttgctgcagctgatgtgacagggagggaagaagggccagtggtagcagtgggacgtggagctgggaaggtcatctgctgtcctctgagcccaactataacatctctgttatactctgcacggccagccttcaggtgcacatccagcctccgtgtgcatgtccagctgctgcgtgtacttccggccttgggccattggctggctgtggccttcgccctgatagtttgttcactggcagtggtgacagcagcagcaaacagcttagttgagcaaatggagcagaatggtcaatggtgagcacctgctgcatgccagtcctccatccaagccctttttgtattttaccctgttcaatctctatgcacctcaggagggtgtaccttttacaagtcaggaaactgaggctgagaacgattatgcctcttgccacacagctaagtgtgaggaccaaaatatcccaggcaagcccatttccgagctttctctgcatcttgagaggaacaggcgatgataccctggcggtgataaataacccagaatcgcgcatgccgtgttccggctctaccctgcgatcagggctcagtctccgttaggagagaatgtgtacaatgctcactgaatccctttgccccacgttgagagcaagccgtgaccttacagcctttgcagtggtagcacagggtggctgagatcgctagtgaggccttcattgtatttcttccttttttttttttttttttttttgagacagtctcactctatgtcccagactggagtgcaatggcgccatctcggctcactgcagcctccgccttctgggttcaagcaattctcctgcctcagcctcctgagtagctgggattataggcacccaccaccacgcctggctaatttttgtgtttttagtagagacagggtttcaccacgttggccaggctggtctcgaactcctgacctcaaacgatccacctcccaaagtgctgggattacaggcatgagccaccgcgcctggcctgtatttcttccttttacagcaagagagaggatgttcactttggcagtgatacacagtgtccttctatttatttttttaaatttgtatttatttatttatttatttgagacggagtcttgctttgttgcccaggctggagtgcagtt

SEQ ID NO: 127 - DNA, 6158 bp, Homo sapiens
atcatgtcaaggcaataaagacaatggtttcgttacctcaaaagggaaatccatagatagcacatcacacaggctttcgggagtgcaagggaagttctttagccccacaaatttaaactgaaatagaaattagaacaaggaattagtacgttataaatgatactggcccaagcaattgaaaatctctgtcaggccaggcatagtggctcacacctgtaatcccagcactttgggaggcaaagtcaggaggatcacctgaggtcaagaaatcaagacaagcctggccaacatggtgaaaccccgtctgtactaaaaatacaaaaattagccaggcatagtggcatgtgcctgtagtccaagctacttgggaggttgagggaggaaaatagcttgaacccaggaaggggaggttgcagtgagccatgatcatgccactgcactccagactgggtgacagagcaagactccctctcaaaaaaagcaaaaagaaaagaaaatctctgtcaaagaagaaaaacttgtagtcccagctacttgggaggctgctgaggtagaaggatcgcttgagcctgaggtcaaggctgcagtaagctcagattgtgccactgcaccccagcctgagtgacagagccagaccctgtctcaaaaaccaaaccaaaccaaactaaaccaagccaaaacaaaaaaacaaagaagaaaagttttcagtctcatccttctctactaattcccctctacttactctcttaactactaggtcgtggttcccaatctttcctcccccttttttttaagagatgagatctcattctgtcacccatgctagagagcagtggcacaatcacagctcactgcatcctcaaattcctgggctcaagggattctcccacctcagtttcccagtatgctgggattataggcatgagccactgtacccagccccaaccttcttttatccacaagaatcatctagggagcttttaaaaattactgatactcaggaggctgaagcaggaaaatgacatgaacccgggaggcggagcttgcagtgggccgagattgtgccactgcactccaacctgggtgacagagcgagactccgtctctaaaaataaaaaataaataaaaataaattactgatgctggccaggtgtggtggctcacgcctgtaatcccagcactttgggaggccgagaagggcggatcacgaggtcaggagttcgagaccagtctgaccaatatggcgaaaccccgtctctactaaaaatacaaaaattagccaggcatggtggtacatgccagtagtcccagctacttgggaggctgaggcagaagaatcgcttgaacctgggaggcggaggttgcagtgagctgagattgtgccactgcactctagcctgagcaacagagcaagactcggtctcaaaaaaaaaaaaaaaaatattactgatgcacaggccctactctgagattctgactgaactggtctggggtgggatccaggttttttgttgttttttttgagacagagttgcgctctttcacccaggctggagtgcagtggcacaatcacagctcactgcagcctcaacctcttgggctcaagtgatcctcccacctcagcctctcaagtagctggaactataggtgcacgccaccatgcctaatctgtttttgtatttttttgtagagatggggttctgctgtgttgcccaggctggtctcaaactcctgggctcaaacaatccacctacctcagcctcccaaagtgatgggattataggcacacatcaccatacctggctaatttttttgtttgtatttcttttgtagagatggggttttgccatgttgcccaggctgctccgaactactgagctcaggcagtccacctgccttggccacccaaagtgctgggattacagatgtgagtcactgtgcctggcccaggtattttttttttttgagacaaagtctcgctccctcacccaggctggagtgcagtggcacgatctcggctaactgcaagctcggcctcctgggttcacagcattctcctgctcagcctctcaagtagctgggactataggcgcccaccaccacgaccggctaattttttgtatttttagtagagacggggtttcactgtgttagccaggatggtctcgatctcctgacctcgtgattcgcctgtctcggcctcccaaagtgctgggattacaggcgtgagctaccgcactcggcctggcccaggtattttttttaaagctcttcactgggccgggtgcagtggatcacgcctgtaatcccagcactttgggaggctgaggcaggcagatcacaaggtcaggagatcgacaccatccttgctaacacagtgaaaccccgtctctactaaaaatacaaaaaattagccggtcgtggtggtgggcgcctatagtcccagctactcaggaggctgaggcaggagaatgctgtgaacctgggaggcggagcttgcagtgagccgagatcacgccactgcactccagcctgggtgacggagcgagactctgtctcaaaaaaaaaaaaaaaaaaaaagctctccagctgattttaacatacagtcaggagtgggaaccactgtattgtactaggttgagtggttgtgtgttattctcttggccccatgacagctaccactaataaagggctagtgaaatccttttcacacctgcaaggatttttagactgaagcagcataactaagtgattagaactacaaactctaaagtcagattgcttgggtttgaatcccattctgccaatcatttaacctccatatactttcatcttcccatctgtaaaatgggataacaacagcacatatctacttcgtagggttactgtgtggattcagtgagataatatacatagagcacttaaaccagtgtcttagagagagcagtcttccccttcctcaatgcatgttcctccaggacctacatgataataacatcactgaaagtactgatcatatttattctcctataactggttgtccaattccctttaactttttttttttttttttttttgtgacagagtctcgctctgttgcccaggctggagtacagtggcacaatcttggctcactgcaacctccgcctcccaggttcaagtggttctcctgcctcagcctcccaagtagctgggattacaggcgtgcaccactacacttggctaattgtttttgtatttagtagagacagggttttgccatgttggtcaggctggtctcgaattcctgacctcaaatgatccacctgcctcggcctcccaaagtgctgggattacaggcgtgagccacggcgcctggcccttggctttaacattttttgtgagcaatccaagcaaatgccaatctgcagggctaataaaatgccctgaaaatagctgtcacatatttaaatcactgattattattgagtgcctaccatgagtattatgttaggaggacttgcatatttatataatttggttcttataacaaccctgtaaattagatgttattaccctatttttcagatggaaaatctaagggtaagtgagattattaacttaacttagtaataaattttttttagtctttttttagttattattacttcaataggtttttggggaagaggtagtgtttggttacatgaataagttcttttgtggtgatttctgagatttggtgcacccaccacccaagcagcgtacactgcacccaattatccctcatcccccttacccttccccagagttcccaaagtccattgtgtcattcttatgcctttatatcctcatagcttagctcccaattatgagtgagaacataggatgttaaattagtaataataaaagccaaaaatggaattcagatctacatgattgatactcttccctttataccatgctgcctcaaaaaagatcatttcatacataatgattatatttagataacagaccaatccacactactccccataaggaactcagtgatcctaacaccaggccttacaggattaagcttggttttctctcccagtccttcttcttctggtaactttgaatgcatccagtagaatcggaaatcagtctgccacagagaagggaaacagaaagatgaaatactttccatttcaaactctaatataaacaaaaacaccccatgctatttttttttttttttttttgagatggagtgttgctctgtcacccaggctggagtgcaatggtacagtctcggctcactgtaacctccgcctcccaagttcaagcgattctcctgcctcccaagtagctgggactacaggcgcccactgccacaccaggctaatttttgtatttttggtagagacagggtttcaccatgttggccagagtggtctccatctcctgacctcttgatctctccacctcgagcctcccaaagtgctgggattacaggtgtgagccactgcgcccaccgggcctcttcattcttttaaattattttgcttttggaaatttaaaaagatacatacagtcttttgtttacgttataaaaatatatttggttttagttaccaaatttgtaggttgtgaatacatgtaataaaatatccttcagcagaattaaaggaaaatatgttctagattgaatttatgttctgagttgtaggcttggttctacacgtgggcaaggtacttaagacctgtgcttcttagcatctcagcttccatatctatatgtcaaggacaggccaggtgcagtcgttcatgcccagcacttcggtaggccaaagtgggtggatcacttgaggtcaggagttcaagacagcctggccaacatggtgaaacgccgtctctactaaaaatacaaaaattagctgggtgtggtggcaagcgcctgtaatcccagctactcagaaggcggaggcaggagaagtgcttgaacccaggatgcggaggttgcagtgagcccagatcgcagcactgcactccaacctgggcaacagagcgagactccgtctcaaagaaaaaaaaggatgataatagtacttaccttacaataaggacgtgttgtaagggatttaatgagctaatgcagaaagtgcttagcaatgcacatcttgattgttattgtttgaatgagatgcaccttagaattctgagtaccaatacctagtgtgttttggaaacctagtatgcgggaatggcttagaaagaagcagcctatggtgacagcctgcatgaagatcactggaggcctgttcacacatcagcctcaggcccatttctacaacgttctgatatgcctggtctggagactacacaccgagaaccactatgataaactaattgacagggagcaaaaggaagtaccaaaacccccaaacccaccattatacaactgggacaatgacggggagagtgttcttaacagggatggaggccggtggggctcactcagcctcacctgatgactgctgctgttacctgttaagaatcaccaatagtaaaatgttgggggtatggtgaaacagaaggggagaatattggggcctctcctcctttgaaaagtctcctcctagagctaacctttgagatttgaggttctgggtcataccaaggaggccctgccattttcagggtcaggatgtggttggtgaaggagtggaggttgcaggagtctagtagatggtgacttacattcaattccaccttctcttcctggggctgctgcacaaggtggcatccccacccccttgccccacaatcttcactgccagaaatcctcccatactctggagagagataagggggtgggtgcagctgctatcaagtcccagcctacacccctgccatttctttctttcttcctctcaagaactgcatgtttctcttagttcctcctatttctcttttaaaactaagctaatttaaacacactcaaagatgcagggagcattagataatgttcttgatataccacatcctgtgcacaccaagaagttggtcacataccaaacccacatgctgagccgctttcccaggaggagaggagaagacaggaagagccacgagaggaggatccatccctacctggcaatcataaaaagggtgtccccgccagcacatcacatcca

SEQ ID NO: 128 - DNA, 16509 bp, Homo sapiens
ctactctggattcccagagtcccatttatctgacccaaagaacaaccttcttggagcagggctctagagggtagcagggggtacagggggtgtcaagtaccttggctatgcccagcagcagctccagatccaccaggagcatgtggacatcccggtggaacacagctagctcagcccggctcagctggaacatcttctcagggtcaggggctgcaatcatgcttcccttcccggcccccaggagcccattgcaggctacttccacatagagagtgaggctacaaagatggggagacagcctcaggctaagggactggcacagtactccggggacttggggaaggggcacccaggaggcatccagctgagcccaacctgtctgcttccaggatccactacccagaggatcccacagtgtgacaagagtgcatgtgggagggttgtggtacaaacaccagatggatcccatgtcttgctgtcagagagaataagtagcaaagtttggaaccatgtaaagtacgctgctgtttagtcttatatttccaaagttgtctttgcaaagcactgccttggtcttggaaccctctttgcatattaaaatcatgttcggatctcccaggctcaaacttttagacccaagatctaaaaccaacacggccaacatgggcgggccattcattggagaacaggctgggctgtggtgatgccatacttaggcttcagagagcaaacacgacttccttagggaggccttcctgactccacttcgctgctaagtctagagcaaattcctcagtggagtacccaggatttccttccagagccctcagttttgtaattatatgagtgaatctgtctccctttgttggcaagggctattttattcaccaccatactcccagtgtctgaaagcatctgaaacagtgtcaatctatataaaatacattcataatgtctaagaagtgtttttaatggtgtcataaaatgtccatgttataacatggaatgtaagaagtcaggatacaatcttaactagtaaaaactataccgggatgagccgggcacggtggctcattcctgtaatcccagcactttgggagactcaggcaagtggatagcctgaggtcagcagtttgagaccagcctggccaacagagtcaaaccccgtctctactaaaaatacaaaaaattagctgggcatggtggtgggcacctgtaatctcagctagtagggaggctgaggcaggagaattgcttgaacctgggaggcggcggtcgcagtgagccgagatcgtgccattgcactccagcctgggtaacaaaagcgaaactccgtctcaaaaaaatccaaaaaaacccccccgaaaaaacaaaaaaaactatgccggaaagatacaccaagaacatgaatactgggccaggtgcggtggctcacgcctgtaattccagcattttgggaagctgagaggggcggataacctgaggtcaagaatttgagagtagcctggccaacacggtgaaaccctttctctaccaaaaataaaaaaaaaatagctggacgtggtggcacacacctgtaatccctgctactcgggaagctgaggcatgagaatcgcttgaacctgggaggcagaaggtacagtgagctgcgatcgtgctactgtactccagcatcggcgacagagggagacttcgtctcaaaaaaaagaacatgaatgctgagatgttaataatgttcatctctattctagggagtggaataacggtagttatttacttctttgtgctttcctgtatttaccacaggcaaacattgctattatttttgagacaaggtctcactctgttgcccaggctgcagtgcagcggtgtgatcatggctcactgcagcctcatcctcctgggctcaggtgatcctcccactcagcctcccagggtagtgtgggtcactgcacccagcccattatttttatggttaggaaaaaatcatgcttttaaaagcaaacaatgagatgtgaggatgattgtgctagagcagaggcgggcttatgagatcactctgggcctcagctcctccttgctcactggtactccctccctgacagcactggtcaaccagggcacagggactcaccttcgggggtctctttcccccagcctgtcagtcaggacatagctggtcttctcaccctctttggttaaaccctagtagggaggggagtgagagagacaaggcttgaggcttttggacagttcaggtaaagtgtaagccatggggagtcaggcccctccatctggttcccagctctgggtcctctctcccaagcagggccaagattggcaaatcagggacccttggcagtagatgccccaactcccatggcagccagcaccatgaccgtcaaatagcccctgtttaccagtggcaaacccatggtcttatgggaagggccctgggaaggggttaggcagcctgagtgtggattctggtggcctctgcacccctaaataaataccgggaaagaaactccgtgaagtcaggggcaggtttgcctcattccctgctacaccctagtgcttaagggtatggcccagaatggacaccaggagatatttgctgagccagtgaagggaggaagggatggtctctgccttcttgtagccaggaagaacagtcttaaccccagattgagagtcagtccaatttgaaatagaagctgtgtgaacctgagtgagtcaactacacatctgtttcttaatttgtaaatgggtataaagacctactagataggagtataaggactaaacctgataagggtggagcatgaataagacacttaacagtggttatagctggggaatgggatgggtgataaggagagatccattactttatctagaactgtttgaaatgttttcctataagtttgtattatacacaataaaaactaaggaccaattgcacagatgcccaagtggcaacttccctagtcctgaaatcctgataccaccctgtgggcagagcaactcagctgtggcttctccagagtccacagaagaagggctgtagtcatttcagggctgaaatgtggccatacctggccctaggacagggttcctcacctggacaggttctccatcacgccacaccagaccttctccatcactttcccagcaaaggtgaacttcctggcccacccatgcctctgggatggtcagctccacccggaaccagcaggtccaccatctgcaagagagctgttgtgataggcctagaggtagaagtcctatcctgatatccttccttggataaagtgtcggcaggggcttgaaactctccaagcatctgcagtgtcacaaggtactcagctttgagtcacaagaaaggagcaacaaggtgagaagcaagatgagggaaacaggcagaggcgtcaaaggttcgtgatccctagggtgcccttcctaagggatgtccagaggcggccacgtgggaatgaaaaccatcccctgaagacccagggaccagagagctgttcccagcagagggtgctgctcccagcagagggtgctgctcgatcccacgtagttgtctacggcagagggcagacaacgaaggtgtggctgggagctgggttgggacttcccctaggcctgtggccccgcccacccgctgggcgttacctacgtgggtccgaagctgtcgccgacctgcgcggggcggaagtcccgctggactgcctcctggtagggaagtctctccggcgtcaggaagctggagagcacagccacagggcagctggccccaaaaagcctgcgtgggacgggccggtgggcacatgctggaggccgccccgtttccgcctgggggccagctggccggtggggccgcactttccctggatcctccgccaagagggctgcctggccgctccgcggcacagtccattccctaccccctcctccccggcccctgccctgcccgcggcgggcactttgtcccgcggcccgggtggctgcagcttaggtttctccccggaaggaaagcttgaggcgcacggttgcggtcggccggctgcgggggaccaggggccacacctgccgcggaggttacagtcggtaaagtagagcggcgacacgaacttctccacccgctccagcgtggtgcgccagtgcttcaaggccggcgcagccgccatcgccgggctctcgctcctctttccggaaggcccctggcgctaccgttccgctccacggcaggaaaccaaaggttccggcgtccagagggcgcctcccagtcccgggcagcttttcttggaacaccggcggctctcggaagcccagctgctgtctgaactttgagccgagttggaagctagaaactgtttttgaggctctcctatgttgtccgaaatagtgggccgcagggaaaatctcaaaataaaatgggaaatttgacgattagaactctcgaaagtctcaagacagagacttaggccattcggcaagacaggcgggagcctcagctgctgcagacccagcctcagaagcagcaaccgggagacctctggctctagctgtcggtgaacacggaaagtggtgtttgcttaacgtggagccagactacccggaataggtgttttcataccggacggagatcagggtgttagtgagcagggtggtagagctttacgcccaagttactacgacttactcgattacacgctttactgaatgtatattgctaactcttgcacatcaccagaaactctggagtttgaggtggcagaacagtcatggcattgacgatcccaatggaaaaatgtatttcaccatacaggactgtagagtcccgggaagccataataccagaaacagacctccagtttcattctcatccctagtactccactgacagctttattttttttctcctggggttgccaagagtctttgtctataaaatcattaggaacaaaaaaaaatacacaagattagccctgatattttaatggaaatactgaccaagtttacaacatttcaaatgcagatcacacggaaaggtgactaagtacagaataacaaatgtgatttaaaacaaagataacctgctgctgcatataatacaggttgggtttagagcttggagctcagatgtcagacagcaggaggaataaaaatgctacttgtgaaaacccaggctgtaggtaaaacttactcttttgttggttgcactggtgggttgggactttctcctgaactggccttgaaatcctatcctgacctgcaggcaagtgctctggacaaaacactgcaggggcagcaacagctggggctgaccctgatcacaccccaccaatttcccctatggttccaggtcaacatgacctttcttgagggaacacggggataggtgaattatttgagaaaacctcaagatctttcccctaaatcagtacacatgaccaccgccaagtcagacactgccccagctttgccctaaaatctcatcccacaaagctctttttggcaccctacactttggctcacagtctcttctccccagtacaaaaaaagcctaaaatcaggccagggtggctcacacctgtaatctcagcactttgcgaggccgaggtgggaggacagcttgaggccaggagtttgagaccaacctgggcagcatagcaagaccctgtctctacaaaaagttaaaaaattagctgggcgtggtggcatgcagctactcaggaggccgaggtgggaggactgcttgagcctgggaggtcaagcctgcagtgagctatgatcgtggcactgcactccagtgtgggtcataaagcgagacactgtctttaaacaataaaagcctaaaatcagagaggtctaccatgtgttttgaaaatccaggagccaaaaaattttgtttttctttttggtggtggtggtgatttttaactaaaaagcaaacataaaacacacagaacattgctggttacaactaagacttgcgtaatggttgctgaagaaaaatccaccagagtactgggaggggctcagttggtctttgttcagaaagtccaggttaaccacatagaaaaatcctaatcattcatgtttaaatgtctgctagtttaaatttatgtaattaaaaaaataggtatcccatttcaaattctctccctcccaactccatttataaggtataccacatgccttatgcacacttttttttcaaacactggtttggtatttaagttgctcacccccatccatcaccaatgtgaataagaaaaaatatatagaaatacaaactacatagcttgacaacttacccaaatataaaatattttcagattatttgaacaagggaaaaaaacacgtactaaaagacttaagtattctaagattttggaatattttgatttgggacaagtaacaagtattttaagcaaaatcctgtttctaccctggataaggaactgaagtcaaaatccctgcttcacagtattttctggtgaggacaagggacgtgggttgagagtttattccttaagtaagaaccaagctttatttatttacaaaaaaaaaaaaaaaaaagttgggggcaaaggggaagacaagttttacacaaaagtactacaatggtaactccctttggtaaaaagtgtaataaatgtcttgtacatctgttcataggtactaaatctgaagccacagtactatggtacacaagaagctagagcagttatgctagcacatcaaagcatatttcttttaataaaaaattgacagtatgtacattatgtacaaaaaaacaagttaaaattgtgtgtgtgtgtgcgtgtgtgtgtcagagagtaaagctggtggatggcactaaggtagactagtaaagaggcagatacaaaacagttccacgggagctaaaaaggacaactgatttgaactcgttgaggttgagaaccagaggagagaaaagggtaggcagcaagggaatcgtcaggaataaaatccacaagatgatcaatcccaaagccaaactgcaggtcccagataaaacctaatgggtgatcttagatgtgctcgagtgaccagaaaaaaaaaatcaaatccagcttttttttccttttgtggggaggggagaggagcagtgaccatgatagttccaatccatctgagtattaagtccttctccagtctgttttgtaaatgcatctccatccagtcaaagtgtgaacagcatccggttccctcattgaaagttaggccacaggagactccagtcttagctctgctggtgtgtgcaagcaaactgcatgtctttgcttgcatggacttccttcccctccagggcaggctatacccaaaaccctttgggaaaagttccagcttcagctttgtaaggtattcatgttcctaacaggtagcccacttggtgccaggctgcaccagccacacacaggtcaggtggccatgtcccagagaggcccagtgaggcttgaaaggcatcttccttgtttcttcagtgtgtgagtgcataggcccacacacacatccccacacacaccccaagttatctgctctggctttgcagttaaggggctttgaatactgtgccgtatttgacacgatacttgttaatgctcacaaaatgcagggtctctgtatcacaggtggtggtacagggcaccaggccctccagcccctcacccatgagccacttgctggtctctgctgccatttcacggggcacatgctccttggtccatttatctacccaggcctggaatctctgatgtagacgcttgcttacacgctcatgggactgcaaaacagaaaaaaaaaattttattaaatgaagcagaaccaaaaaagagcccttcaaatacaaagcctaattttcttctaaaggagcaaaggaaagatgtgggctcaagtcttagataccactgtttttttcttaaaagaaaaaaaaaaggattctctgtttaaagagaagttaaagaggtaagaacatagaacatgtgagggcatgaaaatccataaagcctccaaagaaatgcgaacacaggctctgggctgaaaaagctcgctgttctcaattttagcatgcgttagtataaccgagggaatgtgttaaaaaatacacatttctgaccaggtgcagtgactcatgcctgtaatcctagtactctgggaggctgaggcaggcagttcgcttgagctcaggagtttgagaccagcctgggcaacatggcaaaaccccatctctacaaaaatacaaataataactgggcgtggtggcacacacctgtagtcccagctacttggtaggctgaagtgggaggatcgcttgagccaggaggtggaggctgcagtgagccaagatcgcaccaccgcaccccagcctagatgacagagccaaaccctgtctccaaaaaaaaaaaaaaaaaaaacccaaaacccccaaaacccacatttccttggtttaccaatgtgcattttaaaccagcaatccagctgattctaatgtatcctgggtaggacccagtgagccattgatcacttctatcagcatggagatccacctctaagccagacagtgcaaagcaaagggcttaaaaccactctccctccactgtgttaccccaccctgggaagcagagtccaggcttggcagatgttctgcagggggttctgttcccaccaacacattcaataaaaatttattggtgtccacatgcaaggatactagaagagatacaaagacaaaactggtgttgcccagtgtcccaaataatgtgaatcagagacaggcagacacacaacacatagcaaaaaaaatgagccaggtgtggtggtgcacgcccgtaatcccagctactcgagaggctgagacaagagaatctcttgaacccgggaagtggaggatgcagtgagctgaaatcatgccactgcgcttccctcagtgccatgagagaagtagagcagactcttgaacaacacagctttgaacagcgcagggccactgataggcaagttttcttccacctctgccaaccctgagacagcaaaaacaacccctcccttcctcctccctcttcagcctactcaacaagatgagaataaggaccctttatgatgagccacaaccacttaatgaagagtaaatgtatcttctcttgcttatgacttaacattttcttttctctaacttactttattgtaagaatatacagtataggctgggcacagtggctcacgcctgtaatcccagcactttaggaggctgaaatgggtgggttgtttgaacccttgagtttgagaccagccctgggcaacgtaaggagaccccgtgtctattttcattaaaaaaaaaaaaaagaaagaaaaaaagaatgcagtatatataatacatacaacatacaaaatatgttgtttatcagtaagccttccagtcagtagtagactatcagtagttccattttgggggagtcaaaaattatacacagatttgactgtgcaggggccagtgccccaaaccccttgtcgttaaagggttaattatacattaaactgtctgctcaacatctcccatttgaaagttttgtagtcctttcaaacttaaaacagcacttcatctgtctcccaaacctcataaccctttcctattaacaggtgagcccctaaaatctccacttaagcaaaacaaaacaaaccaaaaaaccccaaaactaatcaggcaccatccttgatgtccttcttttgcttacccccacatttgatccaacaccatctcttgtcaattaaatatctaaataatatctacatctgggcgtggtggctcacgcctgtaatcccagtactttgggaggctgaggagggtggatcacttgaggtcaggttcgagaccagcctggccaacatggtgaaatcccatctctactaaaaatacaaaaaatcagccaggcatggtttgagacacagcgaaactctgtctcaaaaataaatgcataaagtctacaatgtaattcttgcaattccactgccaccctagtagtacgggtggcccccacatctcatttggacaagggcacccttttgagtggtctctgctcttccaactttatatatacccatctccactgtcctcacagaactccaagctatctttgtcaaatgtcccagtgcatctcaaacaaattacaaaccatggcctatcattagacaaagtgatgtggcctctgcctacccttctaacttcatgcaaccttgagccacaatggtgtttgtaatttcttgaatatgccaagtcctttcctcccagccttgtactagctcttttgtctagaaaacacccatcctctactcttcaccaggctaattccttgtcattattcaggcctcaagcatcacctcctttgagaagcctcctccagtgaaagcaaggcctgtatgctagttacccttgatcacttcacctgatttgtttccctggtagtgcatatcatcgcattacttcatctgctctacttcatggctgtagtcccagggcctggcataacaccctatacgcagctgcaccaggaaggtttcacaattgagacagaatgtaaagacaggtaggattcatacaagcaaaagatcagatactacttgagatgtaaatactgggagtaaattcaccaaaaaggtgccaccgggtatttacgtgctcttacaggctgaactgtattctccttaaaattcttatgttggccgggcatggtggctcacgcctgtaatgctagcactttgagaggctgtgtcaggtgagactctgtctcaaacaaacaaacaaaaaatcatacattgaagtcctagcccccagtacttccgaatgtgacctcatctggaggcagacacacacacacaggtaggaacaccatatgaagatgaaggcagggatctacaagcccaggaatgccaaagattgccagcaaagaaccagaagctaggagaggcctagaagagattgtccctcacagtcctcaaaaggaaccaacactgctgacacttgactttggacttctagtctccacaacttttgtcatttaagccacagtctgtggtactttgtcacagcatccttagcaaccaacatacgtacttcctcagttaagtctcagctccaagaacaggtttgcataaacaaagaaaaacaatcagaagactctgggcctcccctggtcctagctagggtgggagatgtgtacagaaatttcagttactggttctcacctgatgagcccggagcagggcggtcctccgatacatatagtcctctgatttgatcacatacaccatcttgtaggaattcagcttgaatctacactccagcttatccagactatccacattctccatggtcttcttgctgtttccttccttcccttccttttcctgctgctctcgaccacgttgacacttccggatccgccgtagattcctattgcagaaaagccccggaggatgagagctcgtccagatgcagattcccgtgacttccccaaagtgagttttctttattatatgcttgcatagtactcatcccaatttgttaaatacatacacaaatgttcagttgtttcactgcaaaaaaaatttcaactgcaaaggtacacagaataaaaagcagaaatcttcacccatcccctacttgacttagcagatgtagccagttaagagttttaatgagaaacttctaggcctctgtctgtaaatttacacatgtaattaccagctacagttctgctttgggatttgtttttaagacaaaataggatcatactatatattttgtcctcaacttttcacttactgtcatgaatattttttcatttcatgatagatttgtcttattctctttaactgctgcagaaaaatgtaccccaatttaccattccttaacagtttctttcaactgaggttcctcatctgaaccacataacaaaaatttatttgaatgactatttttaaaaattcccccagatgatataaactagtgccattctacatacacaagaaagaagataattcacatgaatggatgccctgaggggtggtaggcttgctaaatctcaacatccagtgaaaaaagttatcagctagacaattatattgtttctcataacttgctattaaaaacactgcttcaggttggccactgtggctcatgcctataatcccagcactttgggaggcaggtggattgcttgagctcaggagtttgagactagcctgggcaacatggcaaaaaccccttctctacaaaaaaaaaaaaaaaattaggcaggtgtggtgacgtgtgcctagagtctcagctacttgggaggctgaggtgggaagatcgtttgagcccagaaggcggaggttgcagaaagccaagatcccaccactgtactatagcctgggacacagagccagacactgtcttaaaaaaaaaaaaaaaaaaaaaaaaccaaccagcccaaaatattgcttcagtgagaatctttgtatacaagtatttctgtagacagcagttctttgtccaaagggtcccaggaccctttcaggagatctgtgagatcaaaactattctcataataatactaaaacattatttcccttttttgctgtgttgacatctgcactggcaccattaaagtaatggtgaacaaaaatgctggtggtggcgccaaactgtatttgcaatatcgaacaaattgttaccaaattccaatatcaatttgtacatcactgagcttttcatacagttgtcaaactctgttggtttatcttgtaccatcaatgaatccattttacttccatgattttgcaccttcatgcgactgcaattcaagtctttgaacttcacactgaccatacaatgacattaagtgaaaaaagccagtttcacttaagaatgtttctgatgggccagtcacagtggctcatgcttgtaatcccagcactctgggaggctgaggcaggcagatcacttgaggtcaggagtttgagactagcctggccaacatggggagacctcatctctaataaaagtacaaaaattagccgggagtggtggcgcgcacctgtaatcccagctattcgggagggtgagacaggagaatcacttgaacctggctggtggaggctgcagtaagccaagatcgcgccactgcactccagcttgggcaacagagtgagactctgcctcaaaaaaaaaaaaagaaaaaaaaagtttctgatgaagcagtaacattttctattaaatcccaacccctcaatttacatctttttaacatgctgtgtgataaaatgggaactacacataaagcacctttgtgtgctaaagtacaatggtattcttatagaaaagcacttgagcaattgcttgagttgtaagtggatcatcatttttacccgaaagaacaactgactaaatatagtcaatctcagccaagtatttggcagatgttttctcaaaaatgaacaagggagcctatcacttcaaggaaaacaatgttgccaatggtaagactggaattttcaagcaaaactatgaattttggtgaactggtatcagccaccctgagcttgacagcttcccaatacttaaagatgtgtttgatgacctagcgatagcgatattaaatcaatgtgatttcttttggagacactgtaaaatatatcaacatttagtaggtgtgtataacttattttccaaatagccaattgcgtaaagttacaaaatcatagaggaaaaaaagattcattcatgatacaaaataaatcaatggatttttacaactgcatgaaaagcccactgatgtataaattgatattccaactaacctttaagaaactatcactggggccgggtgcagtggctcacacccgtaatcacagcactttgggaggccgaggtgggaggatcacctgaggtcaggagttcaagaccagccagaccaacatggagaaatcccatctctactaaaaatacagaatcagccgggcgtggtggcacatgcctgtaatcccagctactcgggaggctgaggcaggagaatcacttaaacctgggaggcaggggttgcagtgagctgagatcacaccattgcactccagcctgggcaacaagagcgaaattccgtctcaaaaaagaaaaacaaaaacaaaaactatcactggtagttttgttgtcatatcaaagaatatccagttatctgaaggatctgaaaatattcctttttccagctacacatttgcgtgaggccagattttcttcacatatttcaatcaaacaacatacataatgcaacagattgaatatagaagcagacatgagaatccagctgttcttctggtaagccagacactaaacaaatttataaaatataagcaatgccactctattcactaatttttgttttgaattagcttttcattaaaaaatattatttaagaaaatataatagggatatatatatatatatatatattttatttttgaggcagagtctcactcggtcacccaggctggagtgccgtggtgcgatctccactcactgcaacctccgccttccggttcaagcaattctcctgcctcagcctcccgagtagcttggactacaggcgcctgccaccatgcccagctaattttctgtatttttagtagagacagggtttcactgtgttagccaggatggtctcgatctcctgatctcgtgatccacagcctcggcctcccaaagtgctggagttacaggcgtgagccactgcgcccagcccaatattgttatttttcaaatgaattaaagattgaaaacatttctttgtttttatttctaacttggtaaatattactagtataatccatataaacaaaagctttttggagtactcatgctctaagagtgtaaggggtctcaaggccaataagatgagccccttagctgtcagacaaatcattagaaactgaaattctggagggaagattccatacacttcaactaccctgccaccagaacgattatatcaatttccttttcctcacagtacataaatgtgcctccttcctcatatcatggtgagagacacatgatgacaggtttattgtagtatgttattagcatggagcctgttttgttgagaggaacctgacacagagcaactgctcaaatgtgttaaatgattcaatgaatggagaacccggcagggccctttttgctggtatctcttttcccatgttctcattaggactcaataagtctaataacactgggatgatactttcttggaaacctaagacataagatttcaattcaaaacttttaggaaggaagaaagccattctacccattttatacttcttaaactgttttcatatacttggaggatcagtatcacaatctgcctatacacagagggaacatttttaaaattctgtgcagaaaagagttaatgtagcaggcctaagattgctattctttgaaaagcctgcttataaaagttggcccttggctgggggctgggatcttggattttgggcaatgttctaccattccttaactcatataagtgtctcactgtacctaaactatttgtacaaactctatagcttatgctgaaaatgtgctttctttctgagagtttgggattttggtacatgctaggcatacagtgcctagatgactacatctcaataaaaatcctggcacagagtctctaatgagctgccctggtagacagcattttgcatgtgttgtcacattcattgttggaagaattaagagtgtcctgtgtgactccactgggagaggattctaggaagcttgagcctggcttcctccagctttgccacaggcaccttttcgctttgctgattctgctttgcatcttctcgctgtactaaatcagtctgactatatgcagagtcctgtgagtcctcttccatcgaaccatggagactctgacacacattcccatccaaagtacggaggttattgttgattctctacaactctcacctcccagatgctttgacacatgctccaggtaagctcatgttgtgacagccatataaaaccttgaattagcatccccagcagatagaacaaatgaataaaatatgtgaaggccaagaacgtgaaagtcatttaactctccattcctcaatcatgcacagtatggactgctgacagatgacatggctcactcacctggggagaaatactggtttctgtgctagatgttcacgaagctcaggcgaggtagtatctgaattcatgtatcgctccacgtagtctgaccagcgctaagatggcaaacacaaaatacaggtggaaggaaatcacaaaaacagctcctaatgcattgggcactctagtaaattctatgattacaatgccccgaattcataaatttcaagatcaaaaaagtccctttctataaagacatgattgttagtaggtattggaacacggatta

SEQ ID NO: 129 - DNA, 97905 bp, Homo sapiens
ttaaaaacaatccctgacctcaactaatttctgcattaatgcaataggaacttcaggctgcccttggtaagaatcagagacgatatccttggtatttgaatctttatctcagctaggatattttctcctttgcatcaatacagctgactggaggttgacttcatcactcctttagtttcagtattgtaaccagtctggaatacttttttttttttttttttttttttttttttttgagtggaggtcttgctctgtttcccaggctggagtgcaatggcgtgatctcggctcactgtgacctccacctcctgggttcaagcaattctcctgcctcagcctcctgagtaggtgagattacaggcgtccaccagcacaccctgctaatttttgtatttttagtagagacagggtttcaccatgttagccaggctggtctcgaactcctgacctcacgcaatccgcccacctcagcctcccaaagtgctggtattacaggcgtgaactactgcatccagcctgctttctttttattgaagtgtaatatacagaaaaagtacaaatataagtgtactgcttgatgaatttttttattttattttttgagacagggtctcactctgttgcccaggatagagtgcaacagcacaatcctggctcactgcaacctctacttcctggctcaagcgatcctccagcctcagcctcccaaatagctgggactataggtgcgtgccaccaggcctggcccatttttatattttttgtagagatggggttttgccacattgcccaggctggtctcaaactcctgagctcaaagcaatccacccacctcagcgtcccaaagtgctaggattacaggcgtaagccactgcacccggccagatgaattttcataaactgaacacactcgtgtctgtgcccaatgcacagatcaacaaatagaatattctgaacttgccaaagcctcgccttttgcccatcccccaccccacagtcagttactactctgctgaagggtaaccactatcttgcccgttttttttttttttttttttttgagacagggtctctcgctgtgtcacccaggctggagtgtaatggcacgatctgggctcactgccacctctgcctcccgggttcaagtgattctcctgcctcagccttcagagtagctgggattacaggcatgcactaccatgcccatataatttttgtgttttttttagtagagacgggttttcaccatgttggccaggctggtctcgaattcctgacctcaagtgatccacccaccttggcctcccaaagctctaggattatagttgtgagctatcactcccagcctcaggcttgaactcctgggctcaagtgatctgcctgcctcccccttccaaagtgttgggcgtcagccaccgtgccgggccaagtatgctttttctccctaggcaagcaaatggttctaggactaaactggagtaagaaacagcaggacctgagtagtacaaaccattgattggagacaggagaggatggagtctctcaactcactatttacacttcacatttgttttgcccactgatcctcaggacaccaggggtcagtgatttatccaaagtcacacaactaaataattagtattgagctaaaacttgaacccaggcattctaactcctgatctaggaactgggtgaggaggagaattaataaagatatttaactgagtgggctgagagagaactcagcagtgttttcagaggcacagctgtgtgtgtgggcgtgtgggtgtgtaaggaaagagagttctccggaactgttatccatcactgttttaacaggacaatgtttggaaatttctgagcacaaacgtgaataacaaaacaaagtgcaaggcggctggctggccagtttgttttgagaggtaaatccaggagacccagagtagagaggcaactacctggcttgcctgtaactgcaggcttgaaccaatgaactcaagtatggtactgtcatcctgcccaatcaaatcttaaaggctgggctgggcaccggggctcacgcctgtaatcccagcactttgggaggcccaggtgggtggatcacttgaggtcaggagttcgagaccaccctgatcaacatggtaaaaccccgtctctgctaaaaatacaagaaattagccagacgagatgttgcatgcctgtaatcccagctactcgggaggctgaggcagaattgcttgaacctgggaggcagaggttgcaatgagccgaaatcgcaccatggcactctagcctataaaacgagagcaaaactctgttgcaaaacaaacaaacaaaaatcttaaaagactgcagaatggcttgtagtatcaaaagattgaaaacattatgaggccgggcacggtggctcatgcctgtaatcacagcactttgggaggctgaggcaggcggatcacgaggtaaggagaacaagaccatcatggccaacatggtgaaaccttgtctctactaagatacaaaaattagctgggcatggttgtgcgcaccactgtcccaaccactcgagaggctgaggcaggagaatcgcttgaacccgggaggcagaggttgcagtcagccgagatcgcaccaccactgcactccagcctggtgacagagggagactctgtctcaaaaaaaaaaaaaaaaaaaaaaggctgggcgcggtggctcacacctgtaatcccagcactttgggaggctaaggtgggcagatcacgagatcaagagattgagaccaacatggtgaaaccccgtctctactaaaaatacaaaaattagctgagtgtggtggcacatgcctatagtcccgctactcgggaggctgaggcaagagaatcacttgaacctgggaggtggaggttgcagtgagccgagatcgccctactgcacgccagcctggcaacagagtgagactccatcccaaacaaagaaacattatggcccatcaatagaagactcagtaaataaattacagtacacacatacactgaaataataggttgacatttattgtgtccttacatttaccccacacactgttctaaatgactttcattgatttactctcaccataatagtataagaaaggtgaaactatgatccttattttacaaaaagcatatatagtagatccattgatacagcctccttacttttttttttttttgctgagatggagtcttgctgtgttgctcaggccggagtacagtagtgcggtctcagcttactgcaacttccgcctcctgggttcaagcaattctctgcctcagactcccgagtagttgggattacaggcgcctgccactacgcccagctaatttttgtatttttagtagagatgggttttcaccatgttggccagactggtcgtgaactcctgacctcgtcatccatccacctcggcctcccaaagtgctgggactacaggcgtgagccaccacacccagctgtttttcttttgtttgagatggagtctcgctctgttacccaggctggagtgcagtggcacaatctcggctcactgcaacttccacttccctggctcaggtgattcttgtgcctcagcctctcaagtagctgggattacaggcgtgaaccaccgcgcctggcccctccttgctttttattttttttgaggcagagtgtcactctgtcacctcagctggagtgcaatggcacgatctcagcccactgcatcctctgccccctcgtttcaagcaattctcctgcctcagcctctcgagtagctgggattacaggtgtgcaccaccacatctggctaattttttttattattattatactttaagttctagggtacatgtgcacaatgtgcaggtttgttacatatgtatacatgtgtcatattggtgtgctgcacccattaactcgtcatttacattaggtatatctcctaatgctatccctccccatgaccagccccgctgtttgatgttccccaccctgtgtccaagtgttctcattgttcaattcccacctatgagtgagaacattcggtgtttggtttcctatccttgcgatagtttgctgagaatgatggtttccagcttcatccatgtccctacaaaggacatgaactcatccttttttatggctgcatagtattccatggtgtatatgtgccacattttcttaatccagtctatcactaatggacatttgggttggttccaagtctttgctattgtgaatagtgccgcaataaacatatgtgtgcacgtgtctttatagtagcatgattcataatcctttgggtatatacccagtaatgggatcgctgggtcaaatcatatttctagttctagatccttgaggaattgccacactgtcttccacaatggttgaactagtttatactcccaccaacagtgtaaaagagttcctatttctccacatcctctccagcatctgttgtttcctgactttttaatgatcgccattctaactggtgtgagatggtatctcattgtggttttgatttgcatttctctgatggccagtggtgatgagcattttttcatgtgtctgttggctgcataaatgtcttcttttgagaagcgtctgttcatatccttcacccactttttgatggggttgtttgattttttcttgtaaatttgtttaagttctttgtagattccgaatattagccctttgtcagatgggtagattgcaaaaattttctcccattctgtaagttgcctgttcactctgatggtagtttcttttgctgtgcagaagttctttagtttaattaaatcccatttgtctattttgggcttttgttgccactgcttttggtgttttagtcatgaagtccttgcccacgcctatgtcctgaatggtattgcctaggttttcttctagggtttttatggttttaggtctaacatttaagtctttaatccatcttgaattaatttttgtataaggtgtaaggaagggatgcagtttcagctttctacatatatatccggctaatttttgtatttttagtagagacaggctttcgccatgttgaccaggctggtctcgaactcctaacctcaggtgatctgcccgccttggcctcccaaagtgctgggattacaggcgtgagccaccgcgcccggcccaaaacagacgttttgttttgtttttctgagagagagtctcaatctatcacccgggctggagtgcagtgatgcgatctcagctcactgcaacctccgcctcctgggttcaagcaattctcatgcctcagcctcctgagtagctgggattacaggcgcccaccaccatgcccagctaatttttgtatttttagtagagatggggtttcaccatattgtccaggctggtcttgaacacctgacctcagatgatacacccacttcagcctctccaagtgctgggattacatgcgtgagccaccacacccagcccagaacagacattttataaaataagacatttaaatctcaacaggcatataaaaagatgcttaacttcactgatcatcagagaaatgcaaatcgaaactacaatgaggccaggcatggtggctcatgcctttaatctcagcactttgggaggccgaggcaggtggatcacttgaggtcaggagttcaagaccagcctggccaacatggtgaaacctcgtctctactaaaaatacaaatattagcagggcacagtggtgcacacctgtaatcccagctactcaggaggatgaaacaggagaatcgcttgaacccgggaggcggattgcgccactgcactccagcctgggcaacagagtgagactctatctcaaaataaataaataaataaaataaaataaaattacaatgagataccatctcaccccagttaaaatggtttttatccaaaagacaggcaataacaaatgctggcaaggatgtggagaatagggaaccctcatacacttttggtgggaatataaattagtacaaccactatggagaacaatttggaggttcctaaagaaaacctaaaaatatagccaggtgaggtggctcatgcctggaggctaaggcaggaagatcacttgagtccaagattccaggagtttgagtccaggctgggcaacacagtgagacctcatctgtacaaaatataaagaaaatcagctaggagtagtgatgcacacctgtagtcccaggtacttgggaggctgaggtgtgaggatcacttgagcctgggaaataaaggctgcagtgaactgtgattacaccactgcactccagcctgggcaagagagtcagaccttgttgaaaagggaggagaggggaggggaagggaagggagggaaggtgtaggggaaaagaggggtgaggggaggaggggggaaggaaggggaggggaagaaaaggggaagggaggaaaaggggaggggagggaaggaaaggggaggggaggggggagaggaggaaaaggggagggaggaggggaaggaaggggaggggaagagaggggagtgggaggggaggggagagggaggggaggaaagaaaagaaaaagccaaaaataaagctaccaatccccctcctaggtatataccccaaagaaaggaaatcagtatgttgaagagacatctgcactcccatgtttactgctgcactattcacaatagctaaaatttggaagcagcctaagtgttcatcaacatataaatggataaagaaaatgtggcacagatacacaatggagaactattaagtcataaaaaagaatgaggccgggtacagtgactcacgcctgtaatttcagcactttgggaggccgaggggcagatcacttgaggccaggggttgaagaccagcctagccaacatgatgaatccctgtctctgtttaaaaaaatactaaaaatacaaaaattaaccgggtgtggtggcgcatacctgtaatcccagctacttgggaggctgaggcatgagaatcgcttgaacctgggaggcagaggttgcagtgagccaagattgtgccactgcactccagactgggtgacagagtgagactctgtctcaaaaaaaaaaaaaaaaaaaaagagagagagggatcctgtcatttgcaacaacatggatggaactgaaggtcattatgttaagtgaaataagccaggcacagaaagacaaacttcccatgttctcacttattttgtaggagctaaaaattaaaataattgaactcatggagataaagagtagaaggatggtaaccagaggatgggaagggtagtggggggtgagggagaagtggggatggttaatgggtacagaaaaatagaaagaatgaataagagccaggtgcaatggctcatgcctataatccttgcactttgggaggccaaggcaagtggatggcttgagctcaggaatttgagaccagcctaggcaacatggcaagactctgtctctactaaaaatacaaaaaagatcacttgagcctgggaggcaggggttgcagtgagctgagatcacgccactgcactccagcctgggtgacagagtgagaccctgtctcaaattagaaaaaaaaaaaagaatgagtaaggtgtatttgctagcacaacagggtgactatagtacaaaataatttaattgtacatttcaaaataattaagaatataattggattgtttgtaacacaaaggataaatgcctgggatggataccccatttaccttgatgtgattattatgcgttgcatgcctgtatgaaaatatctcatgtgacccataaatatatacatctactatgtgatgtacccacaaaaaagaaaaagagaaagaaaaaaaatagcataagtttcaggtctctgtctagaaagcttatcctcccctcccagcaccttcttcaccagacatatctgattcatccttaaggtctcagctcaaaagtcacttccccagcaagatcttccttgattactctctaaactgaactgcactttctgagactcatagcacccttttattcgtcagagagctgatcacaatttgtaattatgcacttgtttctacattcattggcctagtgtttgtgtgccttactagattgtaagcttcaggatggcaggaaccacatctgtcctgttggcccctgaactcccagcacctagaacctagaacatagtaggcaatcccttgataaatgtgttgaatgactgaatcaaggaagatggccactttatctatgagacatatcttaccattttcccctctcttttgttgtatttatttgggtttaagaatagacatacttccaatgctggagttggaattttataaccttctccaccaaacatttttatttctaaaatccaaagctcctctcaaacattgctccaaaatttctactgcctataaaagagacttgtgttgtgctataaagatgatatgaggctgggcgtggtggctcacgcctgtaatcccagcactttgggaggctgaggcgggtggatcacgaggtcaggagttcgagaccagcctgaccaatgtggtgaaaccccatctctactaaaaatacaaaaattagctgggcgtggtggcgcgtgcctgtaatcccagctactcaggagactgaggcaggagaattgcttgaacccgggaggcggaggttgtagtgagccgagattgcaccattgcaatccagcctgggctacagagcaagactccatctcaaaaaaaaaaaaaagatgatttggctataaaagattcaccccaccctgccaaaagaaagaaaggtgggcacagtggtgcacgtctgtagccccagacactcaggaggccgagatgggaggattgcttgagcccaggtgttcaagaccagcctgggcaatgtagttgagatcccatctctaaaaaatatctatctgtatagagtgcaatggtataattatagctaattgcagctctaactcctggccataggagatcctcctacctcagccttccaagcagctaggactacaggcacctatcaccatgcccaactaatttttaaattttttgtagagacaaggtctcgctctgttggccaggctggtctggaactcctggcctcaagaaatcctcctgccttggcctcccaaagcactgggattataggtgtgaaccaccatgcccagtctcatttctttattagaaaggacagctagggtgattgcctttcccttttccaatgtacaaagttagtttttaagctatccttttaatcacgtacacagaactaaatatagttcttgttcctaaaagtctgcagtatatccaagcacctgttagcagcttgccacacacctccatttagctttctcagcaaggtcactcctctgtgcagcagcagagaggaggggctctcctccagggtgcattctcattccaccttagtatttcttcattcactcaactaaaagttattgacgtaacaagtgccaagcataatgccaggcactggggacctaaagatgaggaagaccaggttcctgacctcatggaacttgctagctaatagaaggagtatgtagtaaagaacttaaccttgcaaagagtgttctggcctttgcccttcgctcctgggaggtaacctctaagcccttggaatgtcttgcctgataaaagtatctttgtttaccaggaggcagaccttaggccacactggacagtctaacaatgtgatttaggcagaagtctttggggcgtaccagatagtttagcaatgtgatgagggaggagggaagactttggatcacactttatcaggtagacttatggaggggctggagactgaggtcagtcacatgggcagacaatcaggtccacatgactgagccccaataaaaattttagacatcattccagccagacgcggtggctcatgcctgtaatcccagcactttgggaggccaaggtgggcagatcacctgaggtcaggagttcaagaccagcctggccaacatgggggaaaccctgtctccacttaaaatacaaaaattagctggacgtggtggcagatgcctgtaattccagctacttgggaggctgaggcaggagaatcacttgaacccaggaggtggaggttgcagtgagccaagattgtgccactgcactccagcctgggccacagagcgagactccatctcaaaacaacaacaaaacaaaaaaaaactttggacatcaaagctcaggtgagactgcctgattggcaatactctgtgagtattgttacacatactgggaaaattaactctgtccatgattccactgggagctctgcatttggaactttcctgctttctgctccgtgcatctcttcccttggccgactttactctgtttcctttcactgtgattaaactgtgattgtgaccataacagctttttttttttttttttttgagacggagtctcgctctgtcacccaggctggagtgcagtggcgcgatctcggctcactgcaacctctgcctcctgggttcacaccattctcctgcctcagcctcccaagtagctgagactacaggcacccgccaccatgtccagctaattttttttaatttttagtagagacagggtttcaccatattggccagctggtctcgaactcctgacctcatgatccacccgcctcgtcctcccaaagcactgggattacaggcatgagccactgcgcccagcccacatcttgatatttttgaatgctagcttgaaggacctatttcagagtgccccttacattttttttttttctttttgagacggagtcttgctatgtcgcccaggctggagtgcagtggcctgatctcagctcaccgcaagctctgcctcccaggttcacgccattctcctgcctcaacctcccgagtagctgggactacaggcgcccgctaccacgcctggccaattttttgtatttttagtagagatgggttttcaccgtgttagccaggatggtctcgatctcctgacctcgtgatccgcccgcctcggcctcccagagtgctgggattacaggcataagccaccgcgcctggcctccacctggtcatatttctttagagattatcaaactacctcttgccacctgttttaaagatggttgtgttggctgggcatggtggctcatgcctgtaatcccagcactttgagaggctaaggtgggcagatcacttgagctcaggagtttgagaccagcctgggcaacacggcgaaaccttgtctctaaaaaaaaaatacgaaaattagccaggcgtggtggctcatgcctgtaatcccagctacttgagaggctgaagcaggaggatcactgggaggtcaaggctgcagtaagctattattgcactactgtactccagcctgagcaacagggtgagcccctgtctcaaaaaaggaaaaaaaaaaaaagatggttgtgttataggttgctatgactgcatatttgttttctagccagccctctaaacagcacccagtttcttttttttgtttgtttcttttcttttcttttctttttttgagacggagtttcactcttatttcccaggcatggagtgcaatggcgcagtctcggctcaccacaacctctgcctcctgggttcaagtgattctcctgccttagcctcccaagtagctgggattataggcatgcaccaccacgccccactaattttgtatttttagtacagacggtcaggctggtctctccatgttggtcaggctggtctcgaactcccgacctcaggtgatccacctgccttgggctcccaaagtgctgggactacaggcgtgagccactgcgcccagcacccagtttctttttattgtagagtcatcttcccatgcaatatatttgagtgatgctatagtctgggataattgccctcccttagtcaagtgtcaggctcataactcaagatgggccaatcacattctcctcccacctcagctcccaagtagctgggactacagccagcacgcctggctatttttgtattttttgtagagacggggtttcgccatgtagcccgggctggtcttgaactcctgggctcaagtgatccacccatcttggcttcctagagtgtgggattacagacgtgagccatcacacggtccctaactgatactattgccatggcctaccttgcttgccttggcaggagggccagcttggcatgagttagcaaagaaccactatttgagatcacctattttatctcaagtactgctggaacccatgcacctagaaaagaccagggttttcaaccagtagatccagaataagcagtcttattgaatcaaaggatatatcagccaaaataatcaacaagcacaacttgatattttttaatggtagcttgaaggacctatctcagagtgccccttacatttttaactaagaagccagtattatctattgatcactgaatagcagtgtgtcccctggtcgtatttctctcactctctctgtctttttttgttgttacaaaaactgccagctctcacagtgattttaccacacctatgtatttacaatctttttttttttttattttttatttttattttttttagactgagtctcactctgtcgcccaggctggagtgcaatggcgtgatctcggctcactgcaacctctgtctcctgggttcaagcgattctcctgccttagcctcctgagtagctgggactacaggcgtgtgccaccacactcagctaattttttgtatttttagtagagacggggtttcaccatgttaaccaagatgctcttgatctcctgaccttgtgctcctcccgccttggtctcccaaagtgctgggattacaggcgtgagccaccgcgcccggcctacagtctgagaaaagtcatgctgagttccagtggctgcactggaagagtttgtgtcaccctaatccacttgtgtttggcagtgatttatccacatttgctatttctccacttggtcatttctcattaatgtctaaacctactgaaacctgacttctgttcctgccacttcaagtcctctcaaaggactactggtctcctgttttccaaatctgagggacatttccccagctttttcttacctgacttcagctgccatctatgtgctgatacctccagacctgtatctatctacttgccattcatctccagtcaccttaatactcagcatgtcccaaactgaactcaatacctttcctcctcaatccccctcaactgtgcttttcctgggatccttgtccttgttagtggcactcagtcacccatattaggaatctaggaatcatcacaatgatgattccatttcttatatttcacagctagtgagtcaccatgtcctttaattcccacctctctcttcatttcctctacaaccttaattcaggccttcatcatctctctcatagggtactgccagatcctcctacctagtttccctgccactagtcttttcccctttgaatccatccctgccatagcagagtgatcctttctaaaaatataggtttgatcatgttacttcaaggatgtaccattgactgcaagatacatgtgaagcttctcatcctgccatgcaagttcattcatgacctgaccttagtatatctctccagcctcataaattaccttgcctcctttgctgcctacttttcagtgatgctgttttacagttctgtgtataaatgcatctgtttcatacttttcccctacaccatccccgctcactctgacttcattcacctggtggatatacctattcgtctttgaaggactccattcaaaagacacctgtttgaacattttcctctgcaggtagagtagccattctttgtgccctccccatccatacagccagctctcacagtgattataatattttatcacacttatgtatttacatatatatttcccaaactcagggaatagtccacagactaccgttactttggataccagttgcaagtttggggaaccctaagactaccctctggttatataattcgccacaaggactcacagacctcattgaaagctgttatagtctctgggcgcagtggctcacccctgtaatcccagctactcaggagggtgaggcaggagaatcgtctgaactggggaggcggaggttgcagtgagccgagactgtgccactgcactccagcctgggcaacacagcaagactctatcccaaaataaaaaaaaaaaaatcaagttgtgattgttgataattttggctgatatatcctttgattcatgcagctgtccccagagtgtgtgtgcctgtagtgcctgtgtgcgccctttggggaagtagtccttccagacctgattatttctgaacagagtatggccaagtcactattgacactagcatgcatagcttctgaactgatatggttggctgctgatagcacagactagagcactcagaaaattatcaaacagagactaaatgtttaggcacttaaaacatgctccttggcaagaggaacacaatgttcctattacagaattgacctaaattcaggaaagagcttattgatgtaggcaaatgcttgaatctgcagccagcaggatcatcaatggatgagggtgggagcggggagtcttccaattttacaaggtcagcttgagcaactctctaagagccgacactaagactagttccactggatgtactgaagttgtataatcaggctccaaataactactacctctgcccaaatctgttcccagaactaatcaacatgcagggaccactgcatgtcagacaagagctgacctggatccctgtgaaaatctgtccacaggacactagtgctgctggagggaatggtgaagtacttgtatccatgacagagtcctagaaagatgggaagcaatatgggagctgactgaagccacaggaagtgggatccatttcctgaatacaaagcagaaactaattagtcagtttccaacacaatcttccattctcacagctgccaaagacctccagttcacaaatctcaagagaccttgcctgctcaaagttctttcttagctcctttcatccatgacacaaaatctaaaacctgctatctctctccagcctcttctcccaaactgtcctggtgggcttcttttctcacaggagtgtgagctcctcaagggcagggactaagtactgtccacctccataacccctctacttggcaggggcctaggacaagcttatctcctggtaggcacaaatgtttgctgaaggagtgaatgaactacatttgcattttatctctggcaatgtctaaaccaaagaaaatcacacttgtcttctcagaagagggaacatattcaaatacccagaattgcagttcctggtaaaacctttcggcggcagcagcaactggaaactcagcagaatctttgagtactaaaaagagtgaaatgggccaagacttgaacagccatggttgaagtagcccaggggactgagatgggaaggggagattcatggctatctaaagcttaagaaccacaaaccagttctttcttacaaatcacatatatttacattgtggatctgggatacacttatcacagtaggagctgctcaaatcaatctgaatgctacgcaatctgggaacctccccataactgtttgagccagcatttcagattatagataagctgtttccagctggactgggtttggaaagttcactctaaagaatgaagtcacctgttgtcactgtcctcctctccaggattccttttggggccaggtaccatcctgtggctccttaaggaggcttctctctttaattctccatgaggcatccagggtggtctgggctatgggaagaacccttcaacttgggagtagacaggtgctccaattcatagtgcccattctcagaggccttgtgtgtgagtttctccttcatgccttccttctggctcttcttgtgctccataatctgctggagctggtgcccagcatagtctggcttggtggtcagcgggccagccggcacagctacaccaaggacatctgacaccatgtaggggcgcagccagcccaccaagggagtgcttccggggctgtagtgggtctgtttgtggtagaagagaagtccatctacctataagacaaggggaaattgaggatcaaatgacttctggggccacatgtttccaggagagcctatacacacaagggcagctcttgtggtccgactcctttttctgggtcactgacagaggaaagagtcccagcttctcacacatgccgtttctctaaataaagaaatggcctagaaaactaaatttgagaaaataaaaacattggctgggcgtggtggctcatgcttataattccagcactttggaggctgaggcaggcagattgcttgagctcaggagtttgagaccagcctgggcaacatggtaagactccatttctactaaaaattcaaaaaaatagccaggcatgtgtggcacatgcctgtaatcccagctactcgggtgtctgagacacgacaaccgcttgaacccagtaggcagaggatgcagtgagctgagactgcaccactgcactccagcctggcgacagagtgagactctgtctcaaaaaaagaaaaaaaaaaaggaaaggataaacataaatagcactttcctgtttacagagtgctttcctgcccactattttactatcttacccatgacggtgtctgagagatggggctgctcatactcagggagttctgaggacctccttaaaacacacagtgagtaggaagcaggacttcaacttgaactctggtcttctgtccccagattccacggactttccaccacttaggggtctgtgttgtggtggatgagctctgtgcatggaatgaaaagcagaggaactggacaggcccctccggggcagcagattgctgcacacagtggaaacaggctgtccagatgccctgcttccctggctactgttggttgcctaaacctccccctaaattgtttgtgagccatgttctgggaaacagtttttctcaacgggaagacctcctacagtcccacattttattttctatgattcagtgactcatctctaaaaagcatttattgtcactggggcataagggttataaataaagatggtattcttaccaccttcttaattgactcccagaaatgctggcaactcagcctttgccatttccttatttgggaagctgtgatccttatataaaattacatccagttcaagcaaatgcttgcagtgactgggcagatttttttttttttttttctttctgagatggagtttcgctcgttgcccaggctgcagtggagtgcggtggtgcgatctcagctcagtgcaacctccgcctcccgggttcaagagattctcctgcctcaacttcccaagtagctgggactacaggcgtgtgccaccatgcctggctaatttttgtattgttagtagagccggggtttcaccatgttggcgaggctggtcttgaactcctgacctcaggtgatccaactgcctcgacctcccaaagtgctgggattacaggtgtgagccactgtgcccggccaaggcagaatttttaagggaatgatgggcaaaggaaaatgtgcttgttgagcctagagaaggtagctgcaggttctgaggctgacaagactgttgaggactggggagcctctggggctgtgaggtttgttttttgttttttttttttgagacagagtcttgtgctgttgcccaggctggagtgcagtggctcaatctcggctcactgcaacctctgcctcccaagttcaagtgattctcctgcctcagcctcccgagtagctgggattacaggcatctgccaatacgcccagctaatttttgtatttttagtagaaacgaggttttgccatgttggccaggctggtcttgaactcctgacctcaagtgatccaccggcctcggccttcccaagtgctgggattataggcgtgagccaccatgcccagccgctgtgagactttcagtgctaaaacagggcgagtcctgagcaaactggaatgaggtggtcacctgactcatgctcctgctcagcaagtgctgctgtccccaagggccatcttctttggtgaggaaaggattagggatttggacatttgttggagtcattcagtcacagaagcaccttcactttacaagcagccacgacagccaaaccagggacctgggtctcagcttgcagtaggaagaggcacacaagaaggatctaggcatgcaagtcttgctcctatctgggcctcagtttctccggacctcagtttctccatctgtaagatgagggagttggacgagctgtccattaagggcccttccagtgccagcattctgacttatccagcatgggtggagctcaggctctgaagggcagcaagtacatcctttctccagaatcagctttgtcccattctgatgctttgacacagcacaatcaaggaatattttaagactttgtgtaactaagtctctctgcagcctatcatcatgtcaaggcaataaagacaatggtttcgttacctcaaaagggaaatccatagatagcacatcacacaggctttcgggagtgcaagggaagttctttagccccacaaatttaaactgaaatagaaattagaacaaggaattagtacgttataaatgatactggcccaagcaattgaaaatctctgtcaggccaggcatagtggctcacacctgtaatcccagcactttgggaggcaaagtcaggaggatcacctgaggtcaagaaatcaagacaagcctggccaacatggtgaaaccccgtctgtactaaaaatacaaaaattagccaggcatagtggcatgtgcctgtagtccaagctacttgggaggttgagggaggaaaatagcttgaacccaggaaggggaggttgcagtgagccatgatcatgccactgcactccagactgggtgacagagcaagactccctctcaaaaaaagcaaaaagaaaagaaaatctctgtcaaagaagaaaaacttgtagtcccagctacttgggaggctgctgaggtagaaggatcgcttgagcctgaggtcaaggctgcagtaagctcagattgtgccactgcaccccagcctgagtgacagagccagaccctgtctcaaaaaccaaaccaaaccaaactaaaccaagccaaaacaaaaaaacaaagaagaaaagttttcagtctcatccttctctactaattcccctctacttactctcttaactactaggtcgtggttcccaatctttcctcccccttttttttaagagatgagatctcattctgtcacccatgctagagagcagtggcacaatcacagctcactgcatcctcaaattcctgggctcaagggattctcccacctcagtttcccagtatgctgggattataggcatgagccactgtacccagccccaaccttcttttatccacaagaatcatctagggagcttttaaaaattactgatactcaggaggctgaagcaggaaaatgacatgaacccgggaggcggagcttgcagtgggccgagattgtgccactgcactccaacctgggtgacagagcgagactccgtctctaaaaataaaaaataaataaaaataaattactgatgctggccaggtgtggtggctcacgcctgtaatcccagcactttgggaggccgagaagggcggatcacgaggtcaggagttcgagaccagtctgaccaatatggcgaaaccccgtctctactaaaaatacaaaaattagccaggcatggtggtacatgccagtagtcccagctacttgggaggctgaggcagaagaatcgcttgaacctgggaggcggaggttgcagtgagctgagattgtgccactgcactctagcctgagcaacagagcaagactcggtctcaaaaaaaaaaaaaaaaatattactgatgcacaggccctactctgagattctgactgaactggtctggggtgggatccaggttttttgttgttttttttgagacagagttgcgctctttcacccaggctggagtgcagtggcacaatcacagctcactgcagcctcaacctcttgggctcaagtgatcctcccacctcagcctctcaagtagctggaactataggtgcacgccaccatgcctaatctgtttttgtatttttttgtagagatggggttctgctgtgttgcccaggctggtctcaaactcctgggctcaaacaatccacctacctcagcctcccaaagtgatgggattataggcacacatcaccatacctggctaatttttttgtttgtatttcttttgtagagatggggttttgccatgttgcccaggctgctccgaactactgagctcaggcagtccacctgccttggccacccaaagtgctgggattacagatgtgagtcactgtgcctggcccaggtattttttttttttgagacaaagtctcgctccctcacccaggctggagtgcagtggcacgatctcggctaactgcaagctcggcctcctgggttcacagcattctcctgctcagcctctcaagtagctgggactataggcgcccaccaccacgaccggctaattttttgtatttttagtagagacggggtttcactgtgttagccaggatggtctcgatctcctgacctcgtgattcgcctgtctcggcctcccaaagtgctgggattacaggcgtgagctaccgcactcggcctggcccaggtattttttttaaagctcttcactgggccgggtgcagtggatcacgcctgtaatcccagcactttgggaggctgaggcaggcagatcacaaggtcaggagatcgacaccatccttgctaacacagtgaaaccccgtctctactaaaaatacaaaaaattagccggtcgtggtggtgggcgcctatagtcccagctactcaggaggctgaggcaggagaatgctgtgaacctgggaggcggagcttgcagtgagccgagatcacgccactgcactccagcctgggtgacggagcgagactctgtctcaaaaaaaaaaaaaaaaaaaaagctctccagctgattttaacatacagtcaggagtgggaaccactgtattgtactaggttgagtggttgtgtgttattctcttggccccatgacagctaccactaataaagggctagtgaaatccttttcacacctgcaaggatttttagactgaagcagcataactaagtgattagaactacaaactctaaagtcagattgcttgggtttgaatcccattctgccaatcatttaacctccatatactttcatcttcccatctgtaaaatgggataacaacagcacatatctacttcgtagggttactgtgtggattcagtgagataatatacatagagcacttaaaccagtgtcttagagagagcagtcttccccttcctcaatgcatgttcctccaggacctacatgataataacatcactgaaagtactgatcatatttattctcctataactggttgtccaattccctttaactttttttttttttttttttttgtgacagagtctcgctctgttgcccaggctggagtacagtggcacaatcttggctcactgcaacctccgcctcccaggttcaagtggttctcctgcctcagcctcccaagtagctgggattacaggcgtgcaccactacacttggctaattgtttttgtatttagtagagacagggttttgccatgttggtcaggctggtctcgaattcctgacctcaaatgatccacctgcctcggcctcccaaagtgctgggattacaggcgtgagccacggcgcctggcccttggctttaacattttttgtgagcaatccaagcaaatgccaatctgcagggctaataaaatgccctgaaaatagctgtcacatatttaaatcactgattattattgagtgcctaccatgagtattatgttaggaggacttgcatatttatataatttggttcttataacaaccctgtaaattagatgttattaccctatttttcagatggaaaatctaagggtaagtgagattattaacttaacttagtaataaattttttttagtctttttttagttattattacttcaataggtttttggggaagaggtagtgtttggttacatgaataagttcttttgtggtgatttctgagatttggtgcacccaccacccaagcagcgtacactgcacccaattatccctcatcccccttacccttccccagagttcccaaagtccattgtgtcattcttatgcctttatatcctcatagcttagctcccaattatgagtgagaacataggatgttaaattagtaataataaaagccaaaaatggaattcagatctacatgattgatactcttccctttataccatgctgcctcaaaaaagatcatttcatacataatgattatatttagataacagaccaatccacactactccccataaggaactcagtgatcctaacaccaggccttacaggattaagcttggttttctctcccagtccttcttcttctggtaactttgaatgcatccagtagaatcggaaatcagtctgccacagagaagggaaacagaaagatgaaatactttccatttcaaactctaatataaacaaaaacaccccatgctatttttttttttttttttttgagatggagtgttgctctgtcacccaggctggagtgcaatggtacagtctcggctcactgtaacctccgcctcccaagttcaagcgattctcctgcctcccaagtagctgggactacaggcgcccactgccacaccaggctaatttttgtatttttggtagagacagggtttcaccatgttggccagagtggtctccatctcctgacctcttgatctctccacctcgagcctcccaaagtgctgggattacaggtgtgagccactgcgcccaccgggcctcttcattcttttaaattattttgcttttggaaatttaaaaagatacatacagtcttttgtttacgttataaaaatatatttggttttagttaccaaatttgtaggttgtgaatacatgtaataaaatatccttcagcagaattaaaggaaaatatgttctagattgaatttatgttctgagttgtaggcttggttctacacgtgggcaaggtacttaagacctgtgcttcttagcatctcagcttccatatctatatgtcaaggacaggccaggtgcagtcgttcatgcccagcacttcggtaggccaaagtgggtggatcacttgaggtcaggagttcaagacagcctggccaacatggtgaaacgccgtctctactaaaaatacaaaaattagctgggtgtggtggcaagcgcctgtaatcccagctactcagaaggcggaggcaggagaagtgcttgaacccaggatgcggaggttgcagtgagcccagatcgcagcactgcactccaacctgggcaacagagcgagactccgtctcaaagaaaaaaaaggatgataatagtacttaccttacaataaggacgtgttgtaagggatttaatgagctaatgcagaaagtgcttagcaatgcacatcttgattgttattgtttgaatgagatgcaccttagaattctgagtaccaatacctagtgtgttttggaaacctagtatgcgggaatggcttagaaagaagcagcctatggtgacagcctgcatgaagatcactggaggcctgttcacacatcagcctcaggcccatttctacaacgttctgatatgcctggtctggagactacacaccgagaaccactatgataaactaattgacagggagcaaaaggaagtaccaaaacccccaaacccaccattatacaactgggacaatgacggggagagtgttcttaacagggatggaggccggtggggctcactcagcctcacctgatgactgctgctgttacctgttaagaatcaccaatagtaaaatgttgggggtatggtgaaacagaaggggagaatattggggcctctcctcctttgaaaagtctcctcctagagctaacctttgagatttgaggttctgggtcataccaaggaggccctgccattttcagggtcaggatgtggttggtgaaggagtggaggttgcaggagtctagtagatggtgacttacattcaattccaccttctcttcctggggctgctgcacaaggtggcatccccacccccttgccccacaatcttcactgccagaaatcctcccatactctggagagagataagggggtgggtgcagctgctatcaagtcccagcctacacccctgccatttctttctttcttcctctcaagaactgcatgtttctcttagttcctcctatttctcttttaaaactaagctaatttaaacacactcaaagatgcagggagcattagataatgttcttgatataccacatcctgtgcacaccaagaagttggtcacataccaaacccacatgctgagccgctttcccaggaggagaggagaagacaggaagagccacgagaggaggatccatccctacctggcaatcataaaaagggtgtccccgccagcacatcacatccagaacgtagtaggtctggtttacctcattgtaaatgcaatctagaatggtgtagtctgaggacacaaagcagaaagtcagcacagagttcttcttccaaccaggttccctccaccacaacctagggagccccatcccagaggcttgagtccaacaatcctcagtgcttgcagcagtcactggcactaaggactaaggattcactggggagagaaccctgcctggctaccagctacagcttcatggtgactcagggtaagacagcacaagacgcatcaaggcaaaccttaagcaaagtgagaattctgaagttttagataaactggcacatttactcacctcaacgaggtttaaaagcaagtcatcttccattttagtttacaactgctttttgagttcctatcataggcactgtgttatgtggggaatattaactataaatattccctgcctttaaggaagttaccatttggttaaggggataagatgatcacagaagaactaagagctaaattacagagctcatactaagagcaacaggagttcccgaaagagaaggctggagcagcaggaaatgcttcaagggagagatgccatacaaatagtcttctgggaccagccgggtttaaacaacagggcagaggggagaagagagggcatttcagacccaagtactgatgtggcatgagcaaagccccagaggcagaatgaactgggcacatgtggggagataagtcagctgaacagaaggtgggtataaggagtaggggaaagacatgggatgggtgggacaaagcctgcatgtgaaaggtactaaacgccaacagagaagtcagagcaaggccaggtgcagtggctcacacctatactcccagcactttgggaggccaaggcaggcagatggctttgagcccaggagtttcagaccagcctgggcaacatggcaaaaccccatctctaccaaaaatacaaaaaattagctgggcatggtggcacactcctgtagtctcagttactcaggaaattgaggtgggaggatcacttgagcctgagaaataaaggctgcagtgagctgtgatcatgcccttgaacccgagcctgggccacagagtgagaccgtgtcaaaaaataaaaaagagaagtctgggctcagtacagaggacatgaggaaccaccaaaggagcctgagcaggtagagaagaaagcaagcccagctctgccaattccttactgaataactgtgggtaagttatttctcccccacgaccttagtctactcagctaggcccagtggggaggaagaacctaaggttacaacaatgagaaaggagaaaagggagtttggcagggaagccccagcatcagctggctgtaccattatgcttagtattctctcagagacgtttccccccaaatctgtatctgttgtcccgtaatagaagtccaaagatatgttgaccttaattcaggaatttacggaccatcaggcctcatggggctgcatttattctgcaactggggacgcttgaccttgaaggggaggtccttggtccaggggccaggatggtgtctacatgcagtttcaaagataagctttcaggccgggtgcagtggcttatgcctgtaatcccagcaatttgggaggccaaggtgggtggatcactttgaggccaggagttcaagaccagcctggccaaaatggtgaaatccagtctctactaaaagtacaaaaattagccgggtgcagcctataatcccagctactcaggaggctgaggcaggagaatcacttgaacccaggaggcggaagttgcagtgagccaatatggtgccactgcactccagcttgggtgacaaagtgagactctgtctcaaaaaacaaaaaaaaaaaacaaagataagctatcaaagtgggtcttttttttttttttttttttttttttgagacggagtctcgctctgtcgcccaggccggactgcggactgcagtggtgcaatctcggctcactgcaagctccgcttcctgggttcacgccattctcctgcctcagcctcccgagtagctgggactacaggtgcccaccaccgcacccggctaattttttgtatttttagtagagacggggtttcaccttgttagccaggatggtctcgatctcctgacctcatgatccacccgcctcggcctcccaaagtgctgggattacaggcgtgagccaccgcgcccggcccaaagtgggtctttaaagcaaattacactgtcttttactgatcaataagtagacactctatgtaggtaccttttgctgttgagtttcgcctgttgcctcctggcagaagtgaagaaaacctgttgacacagtagccactcttggtgtaggcactggtagaaccctgcatggagagaaagttaccattcttattagacctcaaggtctcctcgccctcttgcctcctcattctgcaggaatgttactcgaccaaagatggctctcaacaaaccttcctgcaggaaagtgtttcaagctccactccaggcacagctgttgtggcgtatgaggaaaatggagcacaaagaatccctcccactacagaccaggcctactggcatagggggcaggcagctactcaccctggaggccacgataagggctctttttccaacagggcacacgaccacaatccattcctgccccaaatctgaaggaacgtcaattaaccactcagaaagcatcaactggaaatgcaaaaaatagtgttaaagatcagcaggggtgtgctactcgaaagtctgcaatgacaaggcattaatatcctgtgtgtatattaaaaacctgagtgaaagaatgagggcagagagccgggcacgggggctcatgcttgtaatcccagcactttgggaggctgtggcaggtggatcacctgaggtcaggagttcaagaccagcctggccaacatagtgaaatctcgtctctactaaaaaatataaaaaattagctgggtgtggtggcaggcacctgtaatcccagctactaggaaggctgagccacgagaattgcttgaacctgggaggcagaggttgcagtgagccgagatggtgccattgcactccagcctgggcaccaagagcgaaactctgtctcaaaaaaaaaaaaaaaaaagaatgagggcagaaaaggctgacagtggcacctccaccccatgtgctctagggagttggctgtgtctcctgcacagctgacaggatgatgggggccactgactatgaactttggcttctctcctccatctccacctgcaaccacaccatgcttactgcctcacctcccgggtcagggtgatgaaccctcttcctttccttactttgtccatctgctcctatcatcattactattatgtttgccacaactcagagatgaataagatccctgaccttgagatgctcttagactagaccagcatttctcaaaccgatgccccaaatactatactacaggatgttaggaaatctgtcttaaaaaacgaaacaacgccaaaccaaaccaacaaaaacagtgatgtggtgaaattaatttgggaagacaaactcttccactcagtctcttccatctgtaaagactttgtcccatgggctgggcgaggtggctcacgcctgtagtcccagcactttgggagaccaaggcgggcggatcacgaggtcaagagattgagaccatcctggccaacatggtgaaaccccgtctctaccaaaaatacaaaaattagctgggcgtgttggcgggcacctataatcccagctactcaggaggctgaggcaggaaaatcgtttgaacccaggaggcgcaggttgcaataagccaagatcacgccactgcactccagcctggtgacagagtgagacttcgtctcaaaaagaaaaaaaaaaaaagactttgtcccatcaattaatctctctcattgaatctttcatttctccttccctttaggcactcactcccaatctttttttttttgagatggagtctcgctctgtcgcccaggctggagtgcagtggcgctatctcagctcactgcaagctgcgcctcccgggttcacgccattctcctgcctcagcctcccgagtagctgggactacagtcacccgccactgtgcccagctaattttttgtatttttagtagagacggggtttcaccgtgttagccaggatggtctcgatctcctgacctcgtgatccgcccgcctcggccccccaaagtgctgggattacaggcatgagccaccacgcccggctcactttaaaaaaaaactttttgtggccaggaacggtggctcacgcctataatcccagcactttgagaggctgtggcgggcagatcatgaggccaagaaatcgagaccatcctggccaacatggtgacaagccgtctctactaaaaatacaaaaattagccaggcgtggtggcatgcacccgtagtcccagctactcgggaggttgaggcgggagaatcacttgaagctgggagatggaggttgcagtgagccgagatagcaccactgcactccagcctggcgacagagcgagaccccgtctcaaaaaaaaactttttgtcactcagcatttctgttgagctactccactttctcctagtttaaaaactacttaatacttcttgatgctgccttcttgctcaatctgacagccacagtccagatttcctaccccacagtcctactgaaggccctctgacctcttctcataactcttcctttttttcctttttttttttttgaactggagtcttactctgtcacccaagctgaagtgcagtggcacaatctcggttcactgcaacctccacctcccgggttcaagcgatcctcccattttagcctccctagtagccgggactacaggcacacgccactacgcccggctcatttttgtatttttagtagagacagggtttcaccattttggccaggctggtctcgaactcctgacctcaggtgatccacccacctcggcctcccaaagtgctgggattacaggtatgagccactgtgcctggcctcccatacctctttcttatcctccccactctactcctcgccttacgtaatgctaccagccacatctcccttcctgacatccgttcccttggcaccatgacatagcactactctgtttttccctctaaacattcctccacacactcccccaaaatatgtaatcttcagggggctgttttaggtcccccttttctcttagatgctgttcccattaggggtggatctcatctatttctatagcttcacttgtgcctcctaatgctccttcatctccagacttctttcctccacactcatctatattgcgagatgtctgcttggtatctctttctgtttgtctcctctgcaccgaaaactcagtatatccagagtggaattaactgccttctgttgcctaagtacttcccacccctgaaacacctacccttcccttctgcgtctcataaccttgttaatggcatcaccactccgttactgaatcttagagtttaagcataatctaggcaaattagactacatcaaaatttaaaaattctgtgctgccaacaatatcaccaagaagacaaaaagacaacccacagaatgaaagaaaatatgtgcaaatcatgtatctgataagaaacttgtatctagaatatattaaaaactcttataattcaataataaaaagataaataactcaattaaaaaacaaggagggcagatcatgaggtcaggagatcgagaccatcctggctaacacagtgaaacctcgtctctactgaaaatacaaaaaaaattagccgggcgcggtggcgggcacctgtagtcccagctgttcgggaggctgaggcaggagaatggcgtgaacccgggaggcggagcttgtagtgagccaagatcgcgtcactgcactccagcctgggcgacagagcaagactccatctcaaaaaaaaaaaaaaaaaaaaaaaagagcaaaggatttgaatagacatttctccaaagaagatatacaaatgaccaatacgcacaagaaaagatgtttaacatcaggccaggtgcagtggctcacacctgtaatcccagcactttgggaggccgaggtgggcggatcacaaaatcaggagttcgagaccagcctggtcaatacgctgaaaccccgtctctactaaaaatacaaaaattagccggaagtggtggcgggtgcctgtagtcccagctactcgggaggctaaggcaggagaatcgcttgaacctgggaggcagaggttgtagtgagctaagatcgtgctattgcactccagcctgggcaagagagggagactccaactcaaaaaaaaaaaaaaagaaaagaaaagaaaagatgtttaacatcattagtcactagggaaatagggaaatacaaatcaaaaccacaagaaaccacttcacacccactaggatggctatatttaaaaggatggacaataacaagtgttggcaaagctgtggagaaattggaacacttatatgttgctggtgggaatgtaaagtagtggagtcactttggagaacagtctagcacttcctcaaaaggttaaacagagttatcatatatagacccagcaattccacttctaggtatatacacaagagaaatgaaaacatatgctcacacaaaaacttgtagtacaagaatattaataatggcattatttggctgggtgcagtggctcacacctgtaatcccagcacattgggaggccaaggcaggtggatcagctcaggtcacaagttcgagaccagcctggccaacatggtgaaactcccgtctctactaaaaatataaaaattagctgggtgtgatggcacacacctgtagtcccagctactagggaggctgaggcaggaagatcacttaaactcaggagatggaggttgcagtaagccaagaacatgccactgtactccagcctgggtgagagagtgagacttcatctcgaaaaaagtaaataaataaaattaattaaaaaacaaataaaaatggcattattcataatagccaaaaagtaggagcaactcaaatagccataaactgaagaataaataaacaaaatgtagtctatccatacagtggaatattatttggcaataaaaaggagtgaagtactgatacatggtacaatatgatgaacgttggaaacctcatgctaagtaaaagaagccagtcacaaaagtccacatattatatgattccctttctatgaaatgtgcaaaataggaacagaaagtagattaatgattaggggctacagggaagaatggagagtgacactaattagtatggggtttcttttggggataaggaaaatgttctagaattaaatagtcgtgatggttgcacagtcttgtgactacactaaaaaaaaagaaaccattaaactatacaataaaaataggcaaattgtatggtatgtgaattatatctcaatataactgtctaaaaaatagtagtagcagctaatacttgtggggcacttccagactctgggctaggtatttaaggcatattatttcatttaatccttctaccaatcctatgagataagtactattactatccccattttacagataagaaaccaaagacttagagtggctaaaataccttgcttaaggtcaacacagagcctagctttgagatcagatctgtgtgacctcaaagcttacatcctttcccacttcttatactgcctctcatatccagtccactgctaagttcttccattctatctggcaacatttcttttttatttgttttatttattttttattttttatagaaatgggatcttcctatgctgtccagctgggattacagacacccatcacacctggctaatttttgtatttttaatagatggggtttcaccatgttggccaggctggtcttgaactcctggccttagcctcccaaagtgctgggattacaggcatgagccactgtgcccagcctctgcacatatttttgaggccctttacatctcttctgccatactccttctcccaactctatgccactctaccctaactggcctgcaaactgctcccgggcacaccatatactcctttctggcttctgggcctcgtgctcagcctgtttgttcccactgcctggaatgccctaaaatgcactgcacttctatctattaatgtcctacttacccttcaaggctgcctcttccttcattaacccttctctgatttcacaccccctccttcctccttggttggaaggaatctcatttttttttttttttttttttttttgagacggagtctcgctctgtcgcccaggctggagtgcagtggtgtgatctcggctcactgcaagctccgcctcccaggttcacaccattctcctgcctcagcctcccaagtagctgggactacaggcgcctgccaccaccacgcctggctaattttttttttgtatttttagtagagacggggtttcaccatgttagccaggatggtctcgatctcctgacctcgtgatccacccgccttggcctcccaaagtgctgggattacaggcgtgagccactgcacctggccagcatctcacttttttatagcacaaaacatcttctacacctattctaggagcacaggggctatttctgctccacatctatcttcccatgtcatagcctagtttaacacagagcaggtctttcaataatgcttactgaacaaaattgaattgtactttgtcacagaggatgttatctgtactgtatttggggtaaagaaaggggctgtgggagtgcatccaataaccatattctattgtgtttttttttttctttagagatggggtctctccgggtgcagtggctcactcttgtaatcccagcactttgggaggccgaggggggtggatcacctgaggtcgggagttcgagaccaacctgtccaccatggtgaaaccctgtctctactaaaaatacaaaaacttagccgggtgtggtggcaggcatctgtaatcccagctactcgggaggctgaaacaggagaactgcttgaacccgggaggcagaggttgcagtgagccacgatcgtaccactgcactccagcctgggcaacaagagcaaaactctgtctcaaaaaagaaaaaaaaagagatggggtctcactatgttagccaggttggtcttgaactcctggcttcaagtaatcctcccaccttggcctcccaaattgctgggattacaggtatgagccaccacactcaggcccaggaaccatattctaaaggcaggggagaattctgagatgacaagatacttgggttctagacacaagtatatgatagcagggtagacctccatcccaacttggacccataccctgctttctgaaatacctgagctgcctggaacacaagaacagtctctctccatacctctttccctatggtaccacagccatgttggtttcctctctggatctaaaagggcactgagtcaggtttattatagtgatctgctgcttcatggcctgaacctcaccttggccagctggctggtctggggtggctgggcaggctcactttattcaagggcagctgtacttcccacttgccaccacctgagtgtgaaatttcaagactggcctcatagtacactgcctgggaaagactctaccacccagggaagtggaaggagtcagtggtaggctgggcaggcccaatccagaacagctgtgcagtgacaactaaaaaaaatgacaaggatatggagtgtgttactatatcaatagctcaggggctttctgcagtgggctggcagcctttggtaacagcacaggctaatagttcccaaaccccactacccacagattccatcagtgattcctagtcagtccatagcacagtaagccatctctacttatcatcccatatgatctacgtacactggcatgttctttgcagttcctattcctttttcctgcctcattctcctctctttatgacagcatttatttcagtgggctttgactgcatagtaaagggagtgagattagctgggtctcatcttctctggaccacttacttgattagcatagtgttttggtaacttcttgacagtgtcaatgtccatttcttcatcatctttcttattttcttcctcactctccatccctgtccagtcatcttcagccagtcttctggcatggttcacataatccagccgcttgctggaaggaaaaaaaaggcataaggacatatcttttcttctttttttttttttagacagggtctcgctctgttgcccaggctggaatggtgcaatctcagctcactgcagcctcaacctcctgggctcaagtgatcttcccacctcagcttccacagtaggtgggactacaggcacacaccaccacccctggctaatttttgtattttttgtagagatggggtttcaccatgttgcccaggctggtctcaaactcctggcctcaagtgatctgcctgcctcagcctcccaaagtgctgggattattaggcatgaaccaccgcatctggccagggcaggtctttatgtcttttaggaagatgccctataatgcgacacatttaattcaaaagctccaaatttgggagcaacttggggattctggtggaagtaagaaatgatggaatctcctttgcaaggctaaaacagtgaccgccccctcaaaatcctaaatagcgaaaccccctctgaatacactcagccttcctcagagtttcctaagaatgcaaaataaaatatctaaagaaatttccaaggttcactagatggaaaggctagcttcacccctaccccatcccaccccagatgagagctgacaccttcctgcctagcagacatctcatccaaagaccccaggggtggaagagaagagccactgagatgcagtgagaagtctaaagcaaggacagcttctggagatttctgccttatacaccttttttgtttttaaagagaacttttttttttacggaccgtaggtgtatgccactgtgcccagcttatacagctttctcagaagccaggcctttctccagttcctgtctaactttcaaaaaaggtcacttagtttacaatttaatatattttatttatttgtttccctttatcgttatcttgttttaaaacaacacatgctagaaagtttgggaaactgaaaagaaaaaaaaagaatcttttggaacctaattgtttcaaagtgatttggaaataccacataacctcccacatttgatttcttcaatgctaaggcaggaattcaaccactgaggcagtgaaaccaacacagctggtttctcttaaacacatacatgttcatgctcattataaaaaggcacacaccagagagaacatatgaaagcacaatggtcttttatctcgagaataaaagagctggtatatttgtacatgtgtgaaagaaagtctgtctgtggttatttcctgaacattgtttgtaatcacaagagaagaaaactgcccagatgcccatcaggagggactggcttgatggcattatgaagtatccattccacggaatacctagcaccacgaaaaaggaatgatgtggtactttatgaactgatatagaatttctcccccaaaacaccactaaataaatgtgcagaacagtatatagtatactgctacttgtgttaaaaaaaaaaaaaaaaaaaaaaaaaaaagccaggtgcagtggctcctgcctgtaatcccagccctctgggagggtgaattggccagatcacttgagctcaggagttcaagaccagcttgggcaacatggtgaaattgtgtttctaccaaaaataaaaaaattagctgggtgtggtggcctgcaccagtggtcccagctacttgaggggctgaggttgcagtgagccaagatcatgccacagtactcagcctgggagatagagtcaaaaaaaaaaaaagcttttgtacacatactaccacacacacttgctcatatatgtatagaatatcttcggaagggccaggcgtagtggctgacgtctgaaatcccagcactttgggaggtcaaggtgggaggatcagttgagcctaggagttcaagatcagcctgagcaatatagggagaccctgttcctacaaaatataaaaaaattagccaggtgctatggagtgtgcctgtagtcccacctacttcagaggctgaggtgggaggatcacctgagcctgagaggttgaggctgcagtgagccgggatctgcacactccagcccgaacaacacagtgacaccctgtctaaaatatatatatatttggaaggatacaccagaaactaataatataggagaggaactggatagctaggggacagaaatgggaagacctcaccatatactcttctatttattttatttatttatttatttattggagagagtctagctgtgttgcccaggctggagtgcaatggcgcgatttcggctcactgcaacctccacctcccgggttcaagtgattctcctgtctcagcctcccgagtagctgggactacaggcacgcaccaccatgtcgggctaatttttgtatttttagtagagacaagttttcgccatgttggtcaggccagtctcgaactcctgacctcaggtgatccacccacctcggccacccaaagtgctgggattacaggcgtcagccaccatgcccggcctcttatgtatattttaaattttcaaccatacaaatgtattacctattcaaagataactacatttttaaaaatggggagaggaatgatctgggaatgtattctgcaagccacccagagccacagggaaccatctctgccaaacacaaccagtgatgcaacactgggcaaaatgcagactgtatggaaactatgcagctgttagtagtttcttctgatccctaattccttaatttatgacccagaagaggcccatgctgcattgagaatacaaggatcggccctgccttcagagtagctcagcctcaaacactcttatcctgccctctttccctgtttgcacatcttggcacttagaattaagtatatggaagacatttcctcagattcccttaggaattatttgtcttgaactcccaagagtgccacagaaacatttgggctgaaggcagatgggaagaccacaccaataccagcattcagagtgcagaagccaaacacaagcatcccaggaaatgtggggagtgaaagtctgggcgtggctttcgcaagttcctaaaccacagagctcagtacagctgccaggaaaaaaagaaaaacttaaccaaataattgagcttttggtttcaaacttcggtgtctccctaattcctcatcttctcctaagctctgggtataaaagaaacctacctctgccaggatttacccctcccaacctgtgggcaagaagatcagcctacaaagagtctactttgaagggagagtctgtagagacaagcctagagccttcggaatggttcatagctcctagcccagagaaagaagacaaggagttaaagcttccttacgatttctgcagttccagtaacctccggcggcgctcactctgctccaaggaactgtacttggacttgtactgggataggcgggggtgtggggcagctgtgctgttcagatcttgagacacagaaaagctactagccagggcctgactcaactcttccatcttccctacaaaggaaaacgtaagaaaatggttcattcatttcatatcatctcctgtatacagacagttatgcagttatgatatgatggccacattcctgaaaaaaaattaacttaatgcaaaatcacaagtgtttccatgagacaaaaggaagttaaagggtaaatgagtcatatattagcaataacattattttcctacagatatttccttttttttttttttttgagacagggtctctctctatcacccaggtcggagtgtagtggtgcaatcacagctcactgttgcctcaatctactggacccaagcaatcctcccacctcagcttccccagtaactgagactacaggtatacaccaccacacccagccaattttaaaatttattggtacagacgggatctccctatgttgcctaggctagtcttgaactcttgggctcaagcaatcttccctcctcagcctctcaaagtgctggcattataggtgtgagccactgcgcccggccttttctgagcagttcctctacagtttcctgaatagccatcactcattaaccaatataactctccatgcagtttattcaattggttatttaattctcaactaagtgccaactcatattatgaaaatttaattccagaggaaacactggttctagggtccctggaggaagacaaaagcaatcaaaaaccccaaactcgccaggcacgatggctcatgcctgtaatcccagcactttgggaggccgaggtgggtggatcacaaggtcaggagttcgaaaccagcctgaccaacatggtgaaaccccgtctctactaaaaatacaaaaactagctggatgtggtggcaggcgcctgtaatcccagctactcgggaggctgaggcagaagaatcgcttgaacctgggaggcggaggttgcagtgagccgagatcgtgccactgcactccagcctgggcgacacagcaagacttcatctcaaaaaacaaacaaacaaacaaacaaaaaaacaaactctagcgacctgggattacaggtggctcatgcctgtaatcccagcactttgggaggccaaggcaggaggatcacttgaggccagtagttcaagaccaacctggacaatgtagtgagactatgtctctactttttaaataaaaaagtaaaaaattattttaaattataatttattttttaaaaaatctgattgttacttcctcatattctagttgtgttttgtttttgggtgggcagaaagaaggtttcagggctacttatgtgggactcacttggaaaagagctaggatgtggaaggctgcttaacaagtaacgtcaatgctccagtagtgtgaagaacttccataaagtacattagggaaacaagacaggcatggagtagatgtcattttgaaaacagacttcccactttaggtggaccctaaagaatgggagtggggagaaaggtgaattcacacttcattcaagcgcctgtgagccttagattataagaaaacaggaacatttgggagaaatctgacttgcactgctgggctggcccagccctttggttctagtgtaaaccagagggcacctccagtgcttaacctccatcccaggccaggtccagtgctctgagcatcaaaatcaacaggttcattccagagcctctacagtgaaaaatacaactccataggcctctacttggccagtgagttactttccattgcacaagtgaagtcagatatttttcttgatttgaaacattagattttgtttaatttaaaaggaacttaaaaatcgtggtttgccaggtgcagttgtgcttgcctttagtcccagctactctggaggctgaggcaggaggtatgcttgagcccaggagttcgaagccagcctgggcaatatagcaagaccttgtctgtaaaaagaaaaaaaaattgtggctaaatacacatatcatgaaattcatcatcttaaccatttgtaggtgtacagttctgtaaagttaagtatgttcaacactgctgtgcagaactctccagaactccttttatcttgaataactgaacctctgtaacctttaaacataaaagaaacttttttttttttgagacagagtttcactcttgttgcccaggctggagcacaatggcacgatcttggctcaccacaacctccgcctcccaggttcaagtgattctcctgcctcagcctcccgcgtagctgggattacaggcgcccgccaccacgcccggctaattttgtttttgtattttttagtagagacggggtttcaccgtgttagccaggatggtctcgatctcccgacctcctgatctgcccaccttggcctcccaaagtgctgggattacaggtgtgagccaccacgcccggccttttttttttttttgagacagggtctcactttgtctcccaggctggactacagtggtgtgatctcggctcactgcagcctccacctcctgggttcaagtaactctcctgcctcagcctcctgagtagctgggattatagacatgcaccaccatgctcggctaatttttgtatttttagtagagaagaggtttcattatgttggcgtggctggtctgaaactcctgacctgaagtgatctgcctgcctcagcctcccaaagtgctggaattacaagcatgagccactgcacccggcttgaggtgtgccttaatatctttgcaatgcaaccaagggttgccattcctgagtgactgaggcctcatgatgagtgcttgggatccatatggtatgttattcaaatcatccataatggtatgtatgctattgtctctacttttctgtacttttgtgtaagtttgaaagctttcatgataaaattttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtattttcagtagagacggggtttcaccgttttagccgggatggtctcgatctcctgacctcgtgatccgcccgcctcggcctcccaaagtgctgggattacaggcgtgagccaccgcgcccggccgataaaaatttttaaaaagtcattatgttttcagttcatcaccaaagtaatgaccaaatccaaagcacctttattaggcctatcatgcactatcttggtgtgggctcccgctctgccaagaaccacacaacctttgaaactgatgtcctgggcctggcgcggtggctcacgcctgtaatcccagcactttgggaggttgaagcgggcagatcacctgaggttaggagatcgagaccatcctggctaacacagtgaaaccccgtctctactaaaaaaaaaaaaaaaaatacaaaaaaattagccaggcatggtgacgggcgcctgtagtcccagatgctcgggaggctgaggcaggagaatggcttgaacccgtaaggcggagcttgcagtgagtcgagatcgtgccactgcactccagcctggacttcgtctcaaaaagaaaaaaaaaagaaaaactgatgtcctggatactggggcggttcctttaccttccttcaaggctgttcttggcgggttcctgctgtttcgttttgttttttctttgttgttgttgttttttttttgagacagagtttcgctcttgttgcccaggctggagtgcagtggcatgatctcggctcactgcaacctccatctcccggattcaagcgattctcctgcctcagcctcccgagtagctgggattacaggcacgcgccacaacgcccggctaattttttttgtatttttagtacagatggggtttcaccatgttggtcaggctggtctcaaactcctgacctcaggtgatccgcccacctcggcctcccaaagtgctgggattacaggcgtgagccactgcgccccgccgggctcctgctgtttcaacccattccttggatggtgctgcctccaagtgttcggaccttagccccaggtggtcttagcaccagtaacccccgctccaactccctaaagtccgacccgccccaggccccgcccacgctccaccctccctccctgtctagccccctcccccatccccttccccctccttcgcgtctccccatccggcgcccccgcctcgcgtcccctgggtccgcatcctggcagcctccgcgtttccctacccctgctaccgggctccagccccggggacgctatctgcttcactcggccgtgcgcgccgccaccgccccgcactgcctttttctaggcatggggtcatctaggccatgcatgattcgcccctgccccacagaagtccctgaggggtcctggccggacagcacggaatagaagaacggaaactctcccaaaaggagtcccaggcctggctctatccctccagatgacgtcccaggaggccagagtgcagggccggccagagggagtcacagtccggcaccgagaggcaactcggcagctggcggggcccgggctcgaacccagggactcacccaaaccgaggtgaccgtcgcacgcgccgccgccaccggggccgacgaatcacctgccctgggaagctaggtccgccctccccccgcccccagctgctgcctcaccgctgggcccacaggcctcgcgccctgagtttccggctcctccctcctttgcgaacgctgggagttccgttgcctacaggccgttatttccgccttcaacggctggggcatttcccatcggctagggagggggtcttcttgcatttgctttgcactgtccgggactcttcctgctagatgacttgaccaggccgaggcctccctcctgaacacaagctcttcggggctcctttcgccaatgggaggaggctgatcttgtggccgggcattcaacgccctgggccctgccgcctcccgcagatcttcccgggccttagggcttcacctggagtccccttcccctcttgggcccgtgctcttaaacgggcagtgccaattgcctggattactccaactaacccctcacacccaagtttcagacacagaccttcgctcccccacttgcccttaacaaaagcagatacatacctcgattactgcctgtttgctgcttttgcgagcttctttcccactcggctgcgggctgagcaatggtagggacctggcttgattcctatttaagtagccagagtccagcacaagggatggcgctcagtagaccctgcgtgaaggaatgattaaattggtgcaaaagactagggtaagcggcagagatttaggagattaagtcctgccagggtgtagcctctgcagggcgggaaggctgagattacaattttaaaactgaatatttattgaatgcttacattcagccaatccctgcttcacacccatcatctcatttaatttttttccttttttttcttttttaagccagtagatattaactcttaatcatgacatgaggaagtagacacactgaagctcagagaggttaagtaatttggccaaagtaacacagctttcaaggaaaatgtttgaatttgctgaaagtttgatgtatagggaagttgactaccgatgtatgacagaagcaaagtatccacctttggcacattttgcgtccacggaatgctaaaatttggacttgtgtattttatgcacattacaccatacattcagactaaaaagaataggaaattaggctgatgaaaggctattactagactggtaaaaagggttctggggccctggaaggccaatttttctggacgtgagatttttttttatttttttgagatggagtctcgctctgtcgcccaggctctggagtgcagtggcgcaatctccgctcactgcaagctccgcctcccgggttcacgccattctcctgcctcagcctactgagtagctgggactacaggcgcctgccaccatgcccggctaatttttttgtatttttagtagagacggggtttcactgtgttagccaggatggtctcgatctcctgacctcatgatctgcccgcctcggcctcccaaagtgctgggattaaaggcgtgagccaccgcacccggcctggacctgagattttatttaggtggctctttcagtggccaggctgagcaaagctgtccactagggtatttatttggtgcatccacaaataaaagctcatgtctgcctgatttatgagactgacaaaaaagagaagtccagggcctgacttcactagggaattttgacacccaggatattaggtattttgtgtccaaacaaccatcccttacaaccacggaggtcacatctaatggtcgggctgcatagaaaagaataaagaccttaaacattttaggaaaatagactgagactgagaaagaagttcccaaattcatgcctggaggtccaggagaaatgttctagttcctcactcacacctagctgaataacttcccatatcactgaaaaaacaaaacaaaaccaggtcaggcactgtggctcatgcctgtaatcccaccactttgagaggccaaggtggaagtagcccatgagtttgagaccagcctgggcaacatgacaaaaacccatctccacaaaaaaaaaattagctaggtgtagtggtatgagtcatgatcccaactacttggaaggctgaggtgggaggatcacttgagcccaggaagtcatggctgcagtgagctgtgatcctgccactgcactcagcctggagactctgtctcaaaacaaacaaaaaccagagcacctggcccaggggttcatttagagccagtgggtgtttcagaaggggctacctctggaatctcagcttcagaatgttggccacatgcacacactgtgctttatgtctttaaatcaattaatttaagaaaaaagcctgactacatttatttaaaagggcaacattggccaggtgtggtggctcatgcctgtaatcctagcactttgggaggccaaggcgggcagatcacaaggtcaagagatccagaccatcctggccaacatggtgaaaccccatctctactaaaaatacaaaaattatctgggcatggtggcgcatgcctgtagtcccagctgctcgggaggctgaggcaggagaatcacttgaacctgggaggcggaggttgcagtgagccgagatcgcgctactgcactccagcctggtgtcagagcaagactctgtctcaaaaaaaaaaaaaaaaagggcaacatcatagcattaccttacatcaatcacttcccactttattagaaggtatctataaaataaatacattgctcatgcctataatcctagcactttgggaggctgaggcagacagatcacctgaggtcaggagttcgagaccagcctgaccaacatggagaaaccctgtctctactaaaaatacaaaattagctgggcatggtggtgcatgcctgtaatcccagctactcgggaggctgaggcaagagaattgcttgaacccaggaagcggtggttgcagtgagccgagatcgcgccattgcactccagcctgggcaacaagagcgaaactccatctcaaaaataagtaaataaataaatacgtgaaaataatgttataggctggtgcaaaagtaattgcagtttttggccgggcgcagtgactcacgcctgtaatcccagcactttgggaggccgaggcgggcaaatcacctgaggtcgggagtttgagaccagcctgaccaacatggagaaaccccgtctctactaaaaatataaaattagccgggcgtggtggcacatgcctgtaatctcaggtactcaggaggctgaggcaggagaatcgcttgaacccaggaggcagaggttgtggtgagccaagatggcgccattgcactctagcctgggcaacaagagtgaaactacttctcaaaaaaaaaaaaaaagtaattgcagtttttgccattaaaattaatggcaccaacctaatataatcttgctagatagatatggatgtctgcagaaagctgtaagtctggggactttgtaaaaatcagagattagcaagtgttgaagtgataaggagtcacactaacagaatttttctttgacgtaatcagaaaaattcaaagaggacagaagagggaagaaccactttctcactctattattcaatgtcattaaagtggaatctgtgtaccccttaaaatcttctggttgcccatgggcaggagaatccttacttagaaaagagaaggttgagagcaggaaggtgtccagcccagaggggaaatggagggaggtaagatcacagaggctgctgggacacaggggcaggtaagggcctcaggccacggtggggagtttggattttacctccactgctgaagagggtttatttttttggggggtgcgtgggggttgtttttgtttttgagacatatcttgctctgtcgcccaggccggagtgcagtggtgcgatctctgctcactccaacctccgtctcccaggttcaagcaatcctgcctcagcctcccaagtagctgggattacaggcatgcgccaccatgcctggctaatttttatatttttagtagacacggggtttcaccatgttggccaggctggtctcgaattcctgacctcaggtgatccgcccaccttggcctcccaaagtgctgggattacaggtgtgagccaccatgcctgtctgcagatgagggtttttaaacagttatgagatagcagattccagctttagtgagctcccgctggctacttggtagacaactgaatgtaggcaaccaagtgtggaggcgtggaagccagtgagcagaccttgcatgaaagtatgtcgggggatgtgataggattaagatataatctaaaaataaaacctggacagtttgttactctttttattgagatggagtcttactctgttgctcaggctagagtgcaatggtttgatcacaactcactgcagcctcaatcacctgggctcaagtgatccttccacctcagcctctcaagtagctggaactacaggtgcatgccaccacacccagctaatttatttatttatcttatttatttatttatttgagatggagtttcgcccttgttgcccaggctggagtgcaatggtgctatctcggctcaccgcaacctccacctcccgggttcaagcaattctcctgccgccgggcgcagtggctcacgcctgtaatcccagcactttgggaggccgaggcgagtggatcacaaggtcaggagatcgagaccatcccggctaacacggtgaaaccccatctctactagaaatacaaaaaattagctgggcgtggtggcacgcgcctgtagtcccagctactcgggaggctgaggcaggagaatggcgtgaacctgggaggcggagcttgcagtgagccgagatcgcaccactgcactccagcttgggcgacagagcgagacgactctgtctcaaaaaaaaaaaaaagcaattctcctgccttagcctcccaagtagctgggattacaggcatgagccaccatgcctggctaattttgtatttttcagtagagacgggatttctccacattggtcaggctggtcttgaactcctgacctcaggtgatccgcctacctctgcctcccaaagtgctgggattacaggcctgagccaccacgcctggcctaatttatttttttagagacgaggtttagctatattgcccaagctggttttgaaaaactgggctcaagagatcttcctgccttggcttctcaaagtgctgggattacaggtgtaagccaccatgcctggccagtttattactcataaaataggggaaattagcacgaattatacatgcgtcctagtctagtccccagccaaaactttccccctgaggtttattagatctgagagaaaataggaaagggaacaacttcctccctaaatcgatgttgttaaaggccaaggccatgcaccatctaagccattttgaggaccagtgcttctcattggccacctggagacaccttgtaggacagtaaagaagtcagttatgggccgggtgcagtggctcacgcctgtaatcccagcactttgggaggccgaggcgggggaatcacgaggtcaggagattgagaccatcctggctaacacggtgaaacaccgtctctactaaaaaatataaaaatttagccgggtatggtggcaggcgcctgtagtcccagctactcgggaggctgaggcaggagaatggcgtgaatccgggaggcagtgcttgcagtgagccaagattgtgccactgcactccagcctgggcgacagagcgagactcagtctaaaaaaaaaaaagtcagttatggctggtcgcagtggctcacacctgtaatcccagcactttgggaggccaaggcaggtggattacgaggtcaggagtttgagaccagcctggccaatatggtgaaaccccgtctctactaaaaatacaaaaattagccaggcatggtggcacgcacctgtaatcgcaggtactggggaggctggggcagaagaatcgcttgaacccaggaggcagagtttgcagtgagccaagattatgcccctgcactccagcctgggcaacagaatgagactccatctcaaaaaaaaaaaaaaaaaaaaagaagccagttatgctaggagggagaagcagacgtgaaagggtggcaaagtcaggcatcaaagggggtcacaggagccagggtacagaaactgcagccacaggggaccctaaagctccagggagccaaacctcttccctactcccaccccaccccaacccacccccatcccaaggtccctgagccccagtcctgggtgagagaaatcatgaaagtggttaaggattaaggtcttgggccctggagctagatggcctagatccaaatccagactcaggtacctgttggcacagtggcctgggtttgttatttcaccttctgtgctcaattaccctctctgtaaaatgtggttaacaacagcacctagctcataaggttgttatacagtttcattgagctaatctaggtgaggtgattagaatagtacctggcacagagtaagtctttaaaagtgctgttttgttagtctttaacttgttataaaataacccctccatgactgatttacttatatctacaataaataaattgacacctacttaggtgagcccaagagaatctcttctctgcagacaaaagtgcttgcccagacttgaggtgacatagtttgcccaggttaggtacaggcagagggtgactgggtgagaattttaatccagactttcagcccttacggactccaaaattcctgactttttttttttttttttttagacagagttttgctcgttgccaaggctggagtgcagtagcatgatctcagctcactgcaacctctgcctccagggttcaagtgattcttttgccctagcctcctgagtagctgtgattacaggcgcgcaccaccatgcctggctaattttttttatttttagtagaaatggggtttcaccatgttggccaggctggtcttgaactcctgacctcacgtgatccatctgcctcggcctcccaaagtgctgggattacaggcgtgagccaccgggcctggcttttttttttttttttttttgagacagggtctcactctgtcacccaggctggagtgcggtactgtgatcttggctcactgtaacctccacctcccgggctcaagcaatcccctgatctcagcctcccaagtagctgagactacaggtgcttgcccccacacccagttgattttttttttttttttagagacagagtcttgctctgttgcccaggctggagtgcagtggcgcgatctcggctcactgcaacctccacctcccgggttctagcaattctcctgcctcaggctcccaagtagctgggattacaggtgcacaccgtcacacccggccaattttttgtagagacagggtttcactgtgttgcccaggctggtctcgaactcctgagctcaggcaatccaccagcctcagcctcccaaagtgctaggattacagcactttgggcgtttacagcactttcagccaccgcgccaggcctgatttttatatttttagtagagatggggttttgccatgttgactaggctggtcttgaactcttgactcaagcaatccacccaccttggcttcccaaagtgttgggattataggcataaacctggccaaaacccctgatttttatcccatggacccatggaatgttgcctgccctgtattttttttttttttttgagacagggtcttgctgtgttccccaggctggagtgtagtggtgtgatcacagctcatagcagcttctacctcttaggctcaagtgatcctcccacctcagcctccctgagtagctgggaccataggtgaatgccaccatgcccagctactttttttttttttttttttttcctgtaaagacaaggtctggttatgttgcccaggctggtctcaaactcctgggctcaatcctcccacctcagcttcccaaagtgctgggattacaggcataaaccactgcacctgggccctgcctcatattttaaggggtctactttcactcctgagtttcagctcatgagctgaatgaatgagtgatttggttcatctctgctgagattctgcccttccatgcagggaaccagcctggccccaggtaggggggaaatgtcctttacaaactgcccaggggcttcaaagttgggacccattcttggattttttttggtttttctttgagatgaagtttcgctcttgttgcccaggctggagtgcaatggcctgatctggattcactgcaacctccacctcctgggtttgagcgattctcctgtctcagcctcctgagtagctgggattataggggcctgccacgacaccaggctaattttttgtatgtttagtagagataaggtttctccatgttgtccaggctggtcttgaactcctgacctcaggtgatccacccgcctcggcttcccaaagtgctgggaatatagacatgagccaccgcacccggcctttcttggatgttaaaaccaaggtttgtcctaaagattgcacagctttctggagccagggctggggattgttggggcagtgaagcacgtctaaattcttctctactttgcaagtgttgacagcactcttttatatccttttctctaaatcagaaacagagcagaaactagagccatctcgtcctgcctcttcctatcatagaaaggagatggagggaggcctagagagagaaggagaagcttatgcccccagtcccgcagcaagtcagaggcggacaagacccctcttccctgaagcccctgcagcctctctgcccctctgctgctggaataggatgcagcatctgcatgatgtttgctctgtgccaagcactgggctaggaacaaggcctgtgcttttccaagtgtggtcccctgactagcagcaccaaaatcacctgggaacctgttagaaatgcaaattctcaggcccgccccagacctcctgaatcagaaacatgaagggggctgggcgcgttggctcacgcctgtagtcctaacactttgggaggccgaggtgggcgcatcacggggtcaggagattgagaccatcctggctaacacggtgaaactccgtctctactaaaaatacaaaaaagtagctgggcgtggtggcgggcgcctgtagtcccagctactcggaaggctgaggcaggagaatggtgtgaacccgggaggcggaacttgtagtgagccaagatcgcgccactgcactccagcctgggcaacagagcaagactccatctcaaaaaaaaaaaaaaaaaaaaaaaaaaaagaaacatgaatggagtggagacagcatctgttttcacaatccttccccaaggttcaaatgtggcatggtcaagtttgagaaccactgctccaagccatagtaggctcagtcccggtgtatctgagtggctaaaattgtggaacctggagtcagagagaactaggtgcaaacctgcctccattgctaactctgtgactcaggtaagctattgtctttgagctttagttctgtcagtgataaaatggccataataatagtgcccataaggttgttgtgaggactacatgagacagcacaaagcctggggcgtggtaagcactgctggggtagccattattagctagctgagtgattattttttatttttttgagacagtcttgctctgttgcccaggctggagtgcagtggcacgatcttggctcactgcaacctctgcctcctgggttcaagcaattttcctgcctcagcctcccgagcagctgggattacaagcgtgcagcaccacgcccgtatttttagtagagatgaggtttcaccatgttggccaggctagtctcgaactcctgacctcatgtgatccacctgccttggtctcccaaagtgctgggaatgcaggcgtgagccaccgcgccgacctcctctctacaatttttaatgtcagtactattttttacccccaccttttcacattaaaaaatgtggtaaaatatacataacatagaatttaccattgtagccacttttaagtgttaattcagtggtattaattacactcgcaatgtagtacaacagtcaccactattgtactataccacattgtactacattgtgaatgtgaaatgtgttgttctacattgtgaaagtttttccaaaactttttttttctttttgagactgggtctcactctgttctgtcacccaggctggagcgtgatcatggctcactgcaccctcaacctccctgggctcaggtgaccctcccacctcagcctcccaagtagctgggactacacgcacacatcaccacacccaactaatttctgtggtttttttttttttttttttttccacgctgcccaggtcttgaactcctgggctcaagcaatccacctgcatcggcctcccaaagtgctaggattacaagagtgagccaccacgcccagccttcaaaacattatcatcacccaaaacagaaactctgtaccattaaacagtaattccacacccccctccaatattaccacatttttatgatgaggaaaacggaggcacagagaggctcggtaaaacaatcaatgttacacagctagctaagcataggggtcaggactcagactaggctatttggctccagagcttgctttctgaatcactgtcttacattttttttcttttcttttttttttttcagacagagtctcactctgtcccctaggctggagtgcagtggtgcgatcttggctcactgcaacctccgcctcctgggttcaagagattcttgtgcctcagcctcctgagtagctgggattacaggtggctactaccatgcccgcctaatttttgtatttttagtacagacggggtttcgccacatgggccaggctgatctccaactcctgaactcaggtgatctgcccacctcagcctcccaaggtgctgggattacaggcatgagccgccatgcctagcagattttttttcttaaatctaaagcttttattcttgtttatttatttatttacttatttatttactctgtcgcccaggctggagtgcagtggcatgatctcggctcactgcaacctctgcctcccaggttcaagctattcttctgcctcagcctcagctttgcaaacctagcccaagtagctgggtttacaaacatgtgccatcacgcccgactaatttttatatttttgctagagatggggtttcaccatgttggacaggctggtcttgaactcctggcctcaagtgatctgcccacctcagcctcccagagtgctgggattacaggcatgagccaccgcgcctggcctgaattttgaggtttttatctgcttgggccatgggtgcaggctccaattactccaaaggggctgatctatctgccatgccttgtggggtctggtgggagctggagggccacaggggtcctgccctgtagagccactttgtttttcctccatgagatccacaatcttgggagccctgaggatgttcctccaaatgggcagactatgcccagccaccagagctggagagcaggattctctctccttccacttataaagggacagcactgaaacaaacatggcctctggagtcacatgagactggactcgaaacctagccttggacaggttgctattccaattgtttcccaaactgaagttacagataccaccacctaccttgcagagttgttggtaagagtaaatggcagcctagaactagcagggcctagatgagagttagttcccttcctaacttgaatatcaccttttccttaatgccttcccagttcaatgtttgctccctcctcacacctttatacagcatcctgtggagaccgatcgaattgcctagtgctgctgcttttccctgctggtttgtaaattcaagttcagagactctttctaaactctgacacacatcaagggctgggtgtgctgacactgacacagtcccagtccattgcttactggctacgtaatctttggtaatttgacccatctctgcctccatttcctcatctgaaaagtagagaattggattctccacttcataggattgctgggaggttgaaatgggctaatataggtggtgcacttaaaaatggagctgacatatagtagaagtacttggtattatatgatcccatgatataataagtccccttctctaaatcatttcttcacctaatgctgcctcacacctggggaagcgaacaaggcaccactaaaagccaatccactgatctcggcatcctatttattctccttttagaaggcttggccaggcacggtggctcacacctgtaatcccagcactttgggaggctgaggcaggattgcttgaacttaggagtttgagatcagcctaggtaacatgccaaaaccctgtgtctacaaaaattaaaaactagccaggggtggtggtacatgcctataatcccagctactggggaggctgaggtgggaggactgcttgagcccaggagatcgaggctgcagtgagctgtgacagctccactgcactccagcttgggccttgtgtgaaaaaaaaaacaaaaagaaaaaagaataaagaaatcttgagtaaaacttggtagtctcccttcttattctctatcactgctatcatctaaatttccaggaacctcctgggccacttctaaccgctagatggccaagctacagagtgattatttccttaggcaagcaaacatcccagccctctaatacggtatttcctggggctggaatatcaacaggaagttatgtgaggaagagctctgccaaaacactcattccaaggaagggactggtaaagtgacaaatttgcccaatcctgtacaacatcctgcatcctccacatgtggccctgttgcacatctaatccacaggcaggtcactcgctgctgactctattcttctctgggctcctgggacgtataaatatgactctatgtaagaaaaccagaggctgggcgcagtttgctcatgcctgtaatcccagcactttgggaggccgaggcgggcggatcacgagttcaggagttccagaccagcctggccaacatggtgaaaccctgactctactaaaaccacaaaaattagccgggcgcggtggcgggcgcctatactcctagctactcgggaggctgaggcaggaaaattgcttgaacccgggaggcggaggttgcagtgagccgagatcgcgccactgcactccagcctgggtgacagagcaagactccgtctctagagaaaaaaagaaaaccagacagattaaaaagttgcacttacaaagcagttggggcatttattgacatttaaacaagggaggagatcctgaacactagtctcgctcagtttataaaaacttgaggccaaactctccatcatctgtacacagcttaaccacggccaggagcaagaattcgagttaaacgaattgaaccagtccaaccacaagacgataaagggaaacagggcgtggggatttccagtttttccttttacattacaaagtttccaacacaagaagccaacaataccccagtgctgcaccaagttacttcccactgtttcccaaggcacagtcaattaataatcagtagtccaagttctaagaacattccctggaaaacaaggacgcacctcccgtggctctatgcatggcctgccactgatgaatcaaattcttaagaacctacgaccgtctgatacccttgaggagagcaccctcatagaatctccagcatcaggcctcagttttcccatctgtaaaagacagccatgcaaagtgggagatccgctaggcttccagatcgaagtcatcgcgctcctcattgtactctagcacgtgccgcttgatcttggacgagtccacccaagtgacaaagtcctccatgctgcgcgtgacaaggaaggcggggtcggtaaccacgtcagggcccacgcgtacgtgcccttgctccacaaaggccacggcagcctgaaggtgctgcgccatgcgcagcttgaggagcacggtggggaggcggcggcggcagaaggacgaggccgtgacgaagtcgcagagctccagcgaaccgcgcgtgggcaccaagccgagagcatacagcttgtccagcagcgcggccgaagcgcgcacgcggaactggtcgcgttcgggcaggtcgcgcaggcgccgcgccagctcacgcacggcacggctcagctggttgtagcgcgtgtagtcctcccgccgctgcagccggtaacgccgcagcacgcgcagctcgtgcaggttgtggtcggtgacctcccagttcaggaagtccacctgcttcagcagcttctgctcgtggaacttaagcttccgcaccatgatggcggcagccgcagccgcaggacccgaagctgagagcgcgttctggcatccgcgcgatttccgccgcggcgccccaagacctggacggcctgggaccctgggccaatgaaagaaagacttaaagtcacgccctcacttcccattggccagggtgggaccacgcctctgcactgggatctcgcgtttcttcttttcttcgcgtttgcgagggagggggtagaagcaccggaggtgggtggttgggagcgggtccctaggcggttccgcgcggtttttagtagccaagactgtatccctttctgcggcaatcatttcctcctagacttctgtcctttggggactttcagagtctcccccgcaagagctgaagaggccatttctggggaagaggggtgactgcggcttgttgattgggtttactgtgctaacttgcactgggctcctgccatgccttgggggagcttgccggagccggctctcctggggctgacctggtagtccccgccgcccgccagcgtcaggtccttcacctggcatgcagagcgatctctcattgtcaagttgggataggtggcaccgaacccatgaaatactgattggctgcttcctaggcccacagaaaagggatctataagggagtcgcctggaaatctgtattattaactaaagtgtcagatgattcataaaacccagcaagtttgagaaacttggactataactacaagtccaaaccctttagtctgtgctcaaatgaattatcctgacatgaatttctggccaccaagcattgagttaacaaatttaatgctgtttccgctagttgcatctgtaagttacatctgagtatagcgctgcagacctaacccctttttgcccgggcatttgacgccacctagcttctcactgatcatttttgttttgtatgcttttcattgtcttttacaatacaatatttgagggttgggcgcggtggcacatgcctgtaatcccagcactttgggaggctgaggtgggaggatcatttgaggccaggagttcaagaccaacctaggcaaaaaaaaaaagaaaaaagaagcgagatcccacctctgtaaaaaatcttaaagaattagccaagcatggtggtgcgcacctgtagtcctgactacctgggaggctgagggggaaggatcatttgagcccaggacttgtaggctgcattgagctacaatggtgccaccgcaccccagcttgcacaacagagccagaccctgtctcaaaaagatatatatatatatataaaatattcgatatctggaaaataatataatatgtaaattataaagtataataaatactcataaacttagccagtttaagaaaacatcaccaggctaggcatggtggctcatgcctgtaatcccaacactgggaggccaaggtgggaggatcactggaagccaggagttcaagaccagcctgggcaacatagtaagactcagtccctatggacaaaaaaaaaaaaaaaaaattagccaggcatggtggcagcacctatagtcccagctactggtgagggtttcggggtaagaggggggaggatcccttgaagccggaagttcaaggatgcagtgagccatgatcacactactgcactccagcttgggcaacagaacaacatcctgtctctaaaacaaacagaaagctaatacagattgtttgcttttttaatctaattgattttttctttttttttttttggagatcgagtcttgctctctcgcccaggctggagtgcagtggtgtgatcttggctcactgcaacctccgcctcctgggttcaagctattctcctgcctcagcctcctgagtagctgggactgcaggcacctgccaccacacctggctaattttttgtatttttagtagagacgaggtttcaccgtgttagccaggatggtctccatctcctgaccttgtgatccacccactttggcctcccaaagtgctgggattacaggcatgagccactgcacccagccccagagtaggtcttattgagaaggtgatattttataggggttaagccatgtgtggatatctagggggagaacatttcaggaagaggaaacagtggaaatgccttaaggcaggaatgtgcctggcatgtcagaagagtaagaaagctatcttggctggagcagagtgggcaaggaggagaggaagaggttaaagagcttgtagtcccttgaaaagactttggcttttatgttgagaggcatatacttcggggttttgagcaaaggattgacacttatgttttttgtttgtttttgtttttgagatagggtctcacactgttgcccaggctggagtgcagtggtacgaccaaggctcactgcagcctcaaccttccagcctcaagcaatcctcttgagtagctaggactacaggcacatgccaccatgcccagctaatttttattttttattttattattattattatttgagacagagtcttgcccaggctggagtgcaatggcacgatgtcagctcactgcaacctccgcctctcaggttcaagcaattatccctgcctcagcctctcaagtagctgggattacaggcgcctgccaccacacccagctaatttttgtatttttagtagagacggggttttgccatgttggctaggctggtctcgaacttctgacctcaggtgatccgcccaccctcggcctcccaaagtgctgggattatagacgtgagccactgcacctggctactaatttttaaattttttgtagagatggggtctcactatgttgtcatggctggtgttgaactcctgggctcaagcgatcctgctacctcaggctcccaaagtgctgggattacaagcataagccaccatgcccggctcagaaattcaattttggacatttttggttggaggcatccattagacttctgaggggagatgtcaaggagaaatagatatatgagttaagagtttttttaaaaagggctggagatttaaaaaattgggcattactagaatgagtggtatttgaagtcattcggctggatgagatcatcaaaggagtgcctatggatacaaaagacaagaggacaactctactgtggttactctaacgttaagaattattggaggcttgctgggcgctgtggctcatgcctgtaatcccagcactttgggaggctgaggcaggtggatcatgaggtcaggagatcgagaccagcctggttaacacggtgaaatcccatctctactaaaaatacaaaaagttagccaggcgtggtggcgggcgcctgtaatcccagctacttgggaggctgaggcaggagaattgcttgaacctgggaggcggaggttgcagtgagccgagatcgcaccactgtactccagcctgggtgacagagcaagactgtctcaaaaaagaaaaaaaaaaaagaattattggagagaagaggatgaaccagtgaggtggaagaaataccaggagagtatgttctctccaatgcaaatgaagaaaatgtatccaggaggaaggagtgatcaaccaggtcaaatgctaccaaaaggctaaataagagaaggactgagaataaccattagggtccagcaacaccaaggctattgatgaccttgacaagaatagttcagtggagtgtgggagtaaaagattggccagagggatttaaagagagaacaggagaaaaaaaattggacgcacttagtatagacagctatttcaaggaattttgctgcaaaggtgagcagaggaatggggcaatagctggtggggaaagtggagtcaaaaaaaattttgagatggagtcttgctctgtcgctaggctggagcgcagtggcgggtgcaatctcggctcactgcaacctttgcctcccaggttcaagcgattctcctgcctcagcctcctgagtagctgggactacaggcacacgccaccatgcctagctaatttttgtatttttagtagagacggggtttcaccatgttgcccaggatggtctcgacctcttgacctcgtgatccgcccacctcagcctcccaaagtgctgggattacaggcagtagccaccatgcccggcctcaaaaaaaatcttttttaacatgtgggttgatacttcactcaatagctgcagcttattggttgctttcccagtctattctacctccaaaagctctcccagatttttgtctctccagcctgttacccctgccctatgtcaggccctcatcatcttttgtctgcattcctacagtaatagtccagtgtgtcctgcaggctgccaccagcagagtcagcctgaaaaccactgggcacagttctcccttgctgtttcctttcctaaaggatggaaattggatgcctggatgagggatggatgctgtttcctgtgtatgaatcagggtcccagcaggaaagacagaacacaccccagtgagaataacgtgagaggctgggggtggtggctcatgcttgtaatcccagcactttgagagaccgaggcagaaggattgcttgagcccaggagtttgagatcagcctgggcaacatagtgaaaagccccctatacaaaaatacaaaagttggctggatgtggtggcgggtgcctgtagttccagctacttgggaggctgaggtggggaggatcacctgagcccagggaggttgaagctgcagtgagctgtgattgtgccactgtattccagcctgggcaacagagtgagaccctgtctcaaaaaaaaaaaaaaaaaaaacagaaaagaaaaaaagaataatgtgagacttgactaaagggactgtttccataggaatgggcagggtatagggagatcacaagggttagtgcagtttcctgagactgctaacatggcctgtttcccctaggactgaagaaggtccctggaggggagggaatgggaagatacaggttctggaaatctcagtgaggctgaggagtgagttcctcccaagaacctggaaataagggtggctcctgagagttacaaaaaaacccgtctagaacacatgtgggagtaaatccaaaatggctggtctgtaaatgtgtgactgagtgtttgggaaccaactaaagtctgtcaagggtggtggctgaggacgcctcggggaggttgggctggagggggaccctattgggtgaacagaaatcccaattgtattaagtaaactaataaaggtaaagcgtttactgtagtgtccatcactcagcaagcactaaggaagtagatgcttttttttgctttttttttttttttgtgagacagcgtctcgatctgtcccccaggctggagtataatgacatatacaatggcaccatcttggctcactgcagcctctcactcctggccacctcacctggctgatgctatctttttttttttttttttgagattggagtcttgctctatcaccaggctagagtgcagtggcacaatctcggctcactgcaacctctgcctcctgggttcaagcaattcttctacctcagcctcctgagtagctgggattacaggcatgcgccatcacgcccagctaattttttgtatttttagtagagatggggtttcgccatgttggccaagctggtctcgaactcctgagctcaagtaatccacctgccttggcctcccaaagtgctgggattacaggtgtgagccactgcacccagccctgatgctattgttaaactcagtttggagaaaggctatgtggacagaagatagatcacagggaaggggggggtcctaaaagcacgtggggaaaacgtatattctgtcttagagatgctaggacgaactgtctttagaatgaaggctgccccatgacaggaagcaaggttttaaggttacttgactgagagactcctcataccctttcccctcttgggggttccagactcactgagctaactttctggtaactgggcttcccaaggggtagcccaaactgccttgatctattgatgcagaaattcagttctgcttgacagttttatttctctgtgcaaattgatacctagccttctggggtttgtacataggcctttattctggtcaaatgccagacctgcgaagggagtcggatccactcactgaaccagtgaaactgggttttggagccagaggtctgggaaccatgtccctcaaaacagccaaaggtatccatctttagcagaactaccttgtaccagttaatctgcaataagtgactagggagagaatgaagggaagatctagctagacagggtagacaagactccagggtatagccaggaaagggagtcctcctgaagcctttgcctcatcttaggcacttcctccttcaggaagctttccttgatccttgctctacccaggctggggtaggtaccctcatgtgcacttttcatggcactaactagtcacactgggcagggagcatttgtctacttgtcacaacatatctgagcttttggaaaataaggataatgtcttatttgtctttgtagctcaggggcctggtgcagagtaggtactcagttaatgtttcttgagtgcatgacttggctgaatgaatgactgagacagaatggattgattaaagacaagagagggtggactgtaagccccccaggatagaaaccccgactgccttgtggtgtactactccccagtgcccagcacagtgcctagcagaatcaatgcccaaagtgttcccgatatgctgaccgagggtcagatcccacttgcctcttctcgaagattctctacctgaccacttctctccttgctgccgctggctagcacagaacatccagtccccgctgctgtactaagcaacacggaaccgggtggcacctagacttgttccctgtcgctgcagatgtagagtagtgtctttccctccttccaagctagtcgcccagggcagggtcgccctgtctggctagggtgctgcacccgcagctctcggtatcttaggtcagacgcctggaacgcgcaggccgtttctgttcctccggaaaacaatctctgagctgcgccacgacccgtccctgcggagcaggagtggggaatgggaaggtgggaaggcgagtccgcgactctgctccccaaccccagctggcgcggcggctttccacgcacccccctccccccaccccgatctcccgatcctggctctggcgcggtgctccttgcagccccacgctttgcaaactttcggagttttactccatttgcgtcacggaaaaggcaggaggatgacggagtccaggaagcgaggcagcggcagctggcaagctcccccgccgggcgctccaaccacgggggcgtgaggtgtctcccggcgagggcggacaggcggagggagaggaggggaggtggcggtcccagggaccagccccggaggctctcgggccccctcgttcccgggtcgtttcctccctctcgcctcccggactgagcgccagcgagcgagggcgctggccagctgggaagccgcgcggaggagtaggcgggggctcggctgcagcgccccgggcccgcgggagggcggagctggccgtccctgccccgccgggacgcacggaagtgcagcggagtttgcccgattctccagcctgcttccccctccctcctccctctccccacccctcacctcccctttggcgatcccctccttcctcaggacgccacctcccggaatcgcctttttgttttggagctgccttctcgctggcggagcggagggtctgcgagcgccggggaaggcaggctgggggcgcagcccgccccccactggccgggccccgcagggcggagaggaggacggacggacagacggctggccgcgccatctgctcgccggagctcactctccaaactccaaactgttgagtgtgtgcgtgcacgcgagggtggtgatcgggggtcgtaagtcccgggtgaggaaccggtttctgctggggttacctttggacggggttcctgggattcagagcagggtcagcgtcaggctcagaaactgctgaggaattaggcaaacaaaagagaccactcagcgagtggctagaagtcgcccgacagcctcgtcgcgccccctccttcctccggggttggggctggccacttctggggcggggagagggcgcccgagccggcgggggctccggctgcgcagccggggtcgaagagttggcggcctgttgtgtaagcctcagtccttgttttcccggcctggctcgttgtgaagccggacacatccacccttggactcgattcaggcggctgctgcttttctccttgcccctcttggattttccggatttttgaaaacccagtggcccaggagcaagaggaggaaggaggaaggggcagatctgcagaggaatgtgagagcctcccaaagcgagagccgccaaaagaatctgggagccagagggacagccgagccctgcccgggtttctggaatggtggtttcagagtgagtctcttctattttagaacgttgttccagtggaaagtgtcgaatttttcccctcgcagggcagatttctccaggtcacttgacttttcttctgggagtaggagttaggagagattcccctctaaccccccagaggctgctaagggaggaggagactgtggacatgagccctccctgctcacaagcatatgcccggagacctgatagggcagtttctgggccatggacattgctttgaagagggggagactggacagcatctgtgggtgctgagaccccaccttaggacctgagagattgaactgtgtaagcgccattcagctgcgagtgcattcttggactgccttgtgagcatccccggtctgggcaggaccctctccttcccatctttctataccacccagcccagccatggcactgaaaggccgagccctctatgactttcacagtgagaacaaggaggaaatcagcatccagcaggatgaggacctggtcatctttagcgagacctcactggatggctggctgcagggccagaacagccgtggggagacagggctctttcctgcctcttatgtggagatcgtccgttctggcatcagcaccaaccatgctgactactccagcagccctgcaggctctcccggagcccaggtgagcttgtacaacagccccagtgtggccagcccagctaggagtggtgggggcagtggcttcctctcaaaccagggtagctttgaggaggatgatgatgatgactgggatgactgggacgacggatgcacagtggtggaggagccacgggctggtgggctgggcaccaacgggcaccctcccctcaacctctcctaccctggtgcctaccccagccagcacatggccttccggcccaagccaccactggagcggcaggacagcctggcatctgccaagcgaggcagtgtggtgggccgtaacctcaaccgtttctcatgctttgtgcgttctggagtggaggccttcatcctgggtgatgtgcccatgatggccaagatcgctgagacatactccattgaaatgggccctcgtggcccccagtggaaggccaatccccacccatttgcctgctctgtggaggaccccacaaaacagaccaaattcaagggcatcaaaagctacatctcctacaagctcacacccacccatgctgcctcacccgtctaccggcgctacaaacactttgactggctctataaccgcctgctacacaagttcactgtcatctcggtgccccacctgcctgagaagcaggccactggccgcttcgaggaggacttcatcgaaaagcggaagcggagactcatcctctggatggaccacatgaccagccaccctgtgctctcccagtacgaaggcttccagcatttcctcagctgcctggatgacaagcagtggaagatgggcaaacgccgggcggagaaggatgagatggtgggtgccagcttcctgctcaccttccagatccccaccgagcaccaggacttgcaggacgtggaagatcgcgtggacactttcaaggccttcagtaagaagatggacgacagcgtcctgcagctcagcactgtggcatcagagctggtgcgtaaacatgtggggggcttccgcaaggaattccagaagctgggcagtgccttccaggccatcagtcattccttccagatggacccccccttttgctctgaggccctcaacagtgccatttctcacacgggccgtacctatgaagccatcggggagatgtttgctgagcagcccaagaatgacctcttccagatgctggacacactgtctctctaccagggcctgctctccaacttccctgacatcatccatctacaaaaaggtaaggcccagtgcaggcaggaaactcgtcctgagtctggctctctgctgggccctggggagatggggatggcctggatagaatggagcaacttgtctttatttctctgtctcaatcattcatttaacaaatgtgttgggctgggcacggtggcttacgcttgtaatctcagcactttgggaggttgaagtaggaggatcacttgggcccaggaggttgagactacagtgagcccgattgtgccactgcactccagcctgggtgacagagtgagaccctgtctctaaaacaaacaaacaaacaaacaaacaaacaaatgtgttgaatatcaactctgtgtctgtggcaaatgtgcttctaggtgcagggatattgttgtgcacaggcccggtctctgtcctcatggagcttgatatttaccttcttgtcagttcattcattttctctgtttgcatctcgtttacccatcatgcatggtgtcatgctgggttctgagaacacatagatgaccaggccccaggccttgcccttgaggagccggtaggcccttgggagacacagacccaacccagataacaagagctcagagtgggggcctgtcttgtgctccttgcaagttaacctccccacctttgcagctttggaagctactctcaccactgtgtattctctttatgagcgtcttgtctgtgtgcaggaagatccctgtccccattttgcagatgaaggagctagtgtccacagaagagtggttgcacagcctgtggcccggctgggactgtcccttcctcctgccacctccccaaggacacgtccatgttggccacttcccaagcctagccatgttttcagttctcatgaccccctctgtgggggagggacaggatgggcctctgcctgttactgctggggctgtccatgaactgccggggaaatgactcatcctgggtcacacaggggcactctggctgggccaggggtgcagaatcaggggtccagggcactgtccacatggcctatccaactcctgcttcccaagcctggcttctcttcttgcctgaggagagagccagtggctgccccagcaggtgcctgagtcctgggcacagctgggagggcagatgtcaggagagaggtgtgatcctccctggggctgcttggtaactcgtctgcagggcgtggagctggctccctggcccttgggccctgaggttagacctggcttggtggggagtttgactctgggtggggccagggggcagacctctgcactgagcctggggaacaggaaacatgtcacccaccaccaccagggagggcctggggtaagctggccttgctttcctttaccaagaggttgacttctataacttctccagctcccagcctcctttctccccttgctatatcctcttcctcttcctttctttctgtttttttttttttttctctcatctctacctttcttcctcctcctctgaactccaggaaacacaaacctgagtgctagtcttggctctgcccctagattgctgtgcgtccccggggagtgcctttgcccctctgggccttagtttcctgatctgtaaaacaagggaatggggtcccagtgagccatcaggccttcaagggagtgggtgggaagggactcctggggagggtatggctcagaaacagaatgacaccttagctctggctctgagcactggggcaggagtagggcaggggaggtggccaggcctgctgggggcccactggggcaggtgtctccctgagcacaagtgggaaggctggttcaaccagctccttagatggcttgttcctgtgcaggcagcaggagggggaatgcaatgattaaacagatgctcccatgcagtggctggggaccccccacccagagcagagctgaggacattagggcagccccacacctaggaaggacaccagggcctcccaggctggggggaagccagaccagcctttctgaccctgggcagagagacagagctgagataggccatttctgagtttctacttgaggtgtttctaagagtcagaggccactgtcctctgtgctggtgcatttgacctgaaacagaggccagcccactgccttccctccccgggaggacccctcccaatgggccaagccctctctggcttactctaagttctgggctctgcactgctcctcccaggcctgtggtgtggggcaagttagggagggggtactgagacagaactggacaggctttggggaccacagcccaatgggagtgataaggagggggtcctaatgctggccttaggggtggagcccttctcaaagaaaagagaagaacagttgggtcctgggcccccaggattctgtccagcctgtctggacatctgaatgggtggtgagtgtgtgggaggaaggacagtggaggcctaggtgggagtcaggagaccaggatttggacaaactttgcatctgacatgactttgggagagatttctcccctcagtctctaggtgagtaaaatgggacccgagggtcttcatttccttaggagggctccatgtcatgtgaaacttacattaaacaaatttgtatgcttttcagaaaaataataaaatgaaataaaatgggacataaaccctggctggagctgagaggagcctggtcctcccacgggcctagtccctgtagcccaatccaggggtctcctaagagaagggtaaccatataattaaccagggcagtttggggcataaaagggggccctagcaatagtgatcccgggacaacaggggaaagtaactgtccagggcaagctgggacgtatggacccccaacttgacagccagcaagagcggggctggtcctaaggctcacgacaggtcaggagggcgatgtggtcacttccgttttacagacgaggtgcagcgatgcagatgagcctcagagcaggagctggagtccagtgtgtctggctccgcagcccaggctgtttccactgtgccctcccagatgggggaggggatccccagggatggagagctgagccagaaggcgaaagaggagggaggaaggcttgggtgctccttcactggtcctgtgggctagagagaggcccaggaccacagagcttccatggaggggccatagggacagcgtggccaaggcaaagtggcgactgtagggacaagttcttgcctgggggatgggtgggttcagcctctgggttctgagccatcatctagccttccctctaccgctcatcctgtaatctcagcactttgggaggccgaagtgggcggatcacaggagttcgacaccagcctggctaacatagtgaaaccctgtctctactaaaaatacaaaaaaatagccaggcatggtggcaggtgcctgtaatcccagctacttggaaggctgaggcagaagaattgcttgaacccagcaggcggaggttgcagtgagccgagatcaagccactgcactccagcttgggcagcagaacaagactccatctcaaattaaaaaaaaaaaaaaaaaagaaaagaaaagcagttttcaagccataacatgtagcatctggagcttctattgtatctcaggtgcgctcctttgaactgtgtacatattagttcagttaagcctcaactatactatagggcaggtactattattatcccattttacagatgtggaaactccttaaagcactataccgtgtgagaggttgtcaacagcatcacatctagtgcaacctgtcccactgggcagtggggagacctggagcccaggcaagagcagtggcttgctggagaggatacagctaggactaggactcagacctcctgctccctcctgcccccaacctggggtggatgttaactgtctccaagaggcaggggcaagatggattgaggtgggagcttagggaatatccctgggacttgcagctggtgggctccaaccctcctttctgcatttttgggacccagcctgtaagaggagtgctgaggcaggaggtccccctgggtcctcagctctcaggttaagtcttaagtagaatgtcggggggatgctggacaggcctgagccctgactcccagcctgtggggtggggtgcattagcattagctggtcctggccccagagctgagtcacagggtggaggggtaacggagaacagggtggggcctctgtttccccccgacctctgcagcctttgctccccatccctggcctcctgcctgtctgtggatacctaaccattgcaatgggttcattcttactctttgggctcctcatcagcaaaagaggcctttccttcctctaaggccatggacaggaaaagtctatagatgcacttccactgtgccaactttctcggcaggtggaatccaggctagttcagtatctcctctttagctaggttccttctgcggaagtttaactccagtttcttcaccctgctgttttctacctttcttcttacggttcttcctactccttgggaccttcttgaatccctgtgtccaacgtctgggggccccacacatatgcctgaaggacctggcatgggctccctgcagcagaagtggtgtccgacccccagctgtggaggaccaggcaggaaagaggctgggagtcctgggcaagttcctgcccctcagggccttggcctcctctgtacagtagtaggatggaggtggaatcgagggttggacacctgatcttttgggcctttctagctctgaagtctcttactgggtcctatcctgggccttggggtgatcccccttctgctgcccagggctgggctgttgagatggtgcaggaggtggtccagggaaggtggcagaaggactgagtgggctgggagctggggaatgcagatttcttttgggcgctgtgtgagcagccctggagactctctgaacttgagtctgtttgcctgaaatgctactattagccgattagccatgcacttatcaactaacatggatgttgccccttctaaaggcatccagagttattcccagcatgtagagccctgggcctgatatacagtaagtgctcaatgaatgcatttagaatgcactggacaatttgagccagggagtgaagagaatattatctagacagccctcaagagccctccttaaaggagaagtgggaaagcatgggtattgagcatgctatctgtgtgtagtgggtgcgtttgcagtgctcaggggtgtgctgtcctctatgccaacccttccctgctcctaatcttctttgtatggtggattctctgcagccctcggcgactgagtgccaggcacaggcaaacttccttctcttcccagcaactgtccccactggcttaaaggcagaattcgtcaagtcccttttaattcagaactgaaattcattcaccagctgcttgttcattcattcagattcttctaaattgggtcctctgcccaggttcatctccaccccccatctgtcacctggttattacacaacctcctcgagttccctgggggctgggatgaggagggaacagggcgtgcatgtctgggagatacaccaggtggcctttgaagagttgttttagaatcagcagtgtgatgggggtgggggtggggagccagggcacaggtgacatgggagagacattctgtcaggggaactgggagaggctccagtgtagaagtggcacctgatcggggccatgaattatgaataggaatccagggggcagaggtaggaaggtaggaaagagccaggtgagtttgacgaacatgggggtcagtgtggaatgcgtgcaggggccaactcccagaggtgagggccccccaggccaggcagattggtgtggaccttgatctgtaggtagtggagagctaggaaaggtgcccagcttgggatacctctttagatgctgcagagaacctgtcagaggctggggcggagggcagggagacgtggcggggctgttgtagcagtccagtgagggacagggttgaatcagttcagcaggcctatatcaggatctgctgtgggccaggccttgttctgggtaccagagacacagagaggttgaggacaggctctatcctcattgaattcatagtccatcaagcagggctgtgactggtcacatgtgggctactggtggcactgcacatttggagagaagatgatgtgcttggtttaggaggtgctgagggtgatggcttgggtaacatcctggcagagacacccaggtggctggaatgtgggtctggggctcaggaatgacgtccgagttgagctgatgagggtgctgtctgccctcaagggtacagggagcacatggagatcagagccctcacacgctgtcctctgctctgcctatgccaggcgccttcgccaaggtgaaggagagccaacgcatgagtgacgagggccgcatggtgcaggacgaggcagacggcattcgcaggcgctgccgcgtggtgggtttcgccctgcaggccgagatgaaccacttccaccagcgccgtgagctcgacttcaagcacatgatgcagaactacttgcgccagcagatcctcttctaccagcgggtgggccagcagctggagaagaccctgcgcatgtatgacaacctctgaccgcgtgtgcctgggccccctccttcccctgggcctggtcactgcagtgtaccccactttcccgacctccctataccagcagtgactgggggaggggtcagcggtgggggagataagcggcctgtcctgcctcctgggagaaggagctttcaaggagtcatgggtgcccctgggaaattccccactccttagaagtggggcacagcaggggtgagaatagagtcaggagccctcgaggccaaggcctgggctgccggtcagtcagtgaaggtcaggccagggtctcagcctcccctagagcctattttgcttgctcacctggccactgctgccttatccattcagcagacaccgaggcctgctgcacccttgggtcggatgctgggcacccagggctgtgacatgcctgctcttcaggagtcctcagtgaaggtcggggtcagacacagacagagtcaatgcagtatgactgatgtttaagtgagggatttctggaagctcatagaagggaccacagcattccactggtcagggaagactccatagagtaggcaacatttgggcagtgttttgaagaatgacaagggcctgccagacagtacatgggggagaaggactttcaggggagaggaacagcatgggcaaagttatggaggcatgcaaacatctccctcttctctcccttactttccaagcaagttaggtacgctttccatggggattctggcctgtgtggtaggaagggatctcccttgctcccatgttgctggctgtccgtacatcaccctgtcccctgcaggagggggctacaggccatctccctcctgtaggcctctgactcccctccacttttgggccctcagcttatctcgggcaggggaccattgcagcatcctcccctcctcggactcaaggtgctgaggtataagccctgggccccagatccctggtgacaccttcctggagaagactctcaaaagtgactgtatatttgagttcaccagcaataactccccacactcgaagcaggtccaaacccaggatctcagggtccttgggctctgtggcactgtcttcccaagatccttcctgttgcacaatgggaaacctaagaggaaaaagacaggggcctgcttgcccagccatgcgagggattccatgcccacctgccctctgtctgcctcgctggaatgtgggcccctgctccccgtcaggttgtgctgtctctgacctatgtttacatccccgaggggtttctgcctcctccccacccaggtcagggtgtggtccagcagcttgctgtggggtgctgacatgtgtcaccactgccccccttgcccccgggggggtcatggtctcctcctggatgctgctccttgaatcttttttcttgataaaccttttacaattaagataacacaagcatgactttttctgtttggatcccagaaaggcggagggcaggagaaggatagagccctaattgctcctgagagccattggatgagattctgaggtcgtggtgggcacaaattttccacagaacctcaaaagttcaggggagggctatgctggtggaaggtgccagcaggcaggaggagctagaggcggctgtggacccctgggtggatccatccctccctagaacgcactcttgtctctaaaacaggtggagtgctgcccaggggactggctgtactgccttgtgatctggggctgagggttgtatgaggaagggacaggacgctgtgccctaggacaattaatagatggtggctcctctccccaaggagccatgccctggccttgcccttgaaaagccctagtccaggggagggaagtgggggactcagaagctgtgtctcttccccaaaccgtcctgggtacccagccctgcggaggctcccacattggaaactgaagaggacgctggctgttgggggtgccctgatcaggatgagcggaccttgctcttggatctgttcatccacagatgagaggagggtactggttgagacttggctctcctttggaggcaatggggacttggtggagggagggcttccagggtcaaggccgtcagggaaggttggctagaccagggaccagggagcttgtgcaggaagatggagaagggccagcaggtgcggtgggggaaggggcgggcaggactccctgttcagggcatagcgtcctcagaggaacttctggaatgggtccccctggcccttggtcaacattaggtcagatttgggactttctgaggaattttcccctctctccaccctgccccattttctaacccatccgaggaacttcccgcccttaacctcttctcagctctgccatccatgtagccatctgcagaaggggctctgagcagtgggggctgggccaggccgaggcagggctggtgggaatgctcctcctaacccatggtgcctggaaagtcccctgctcatgcttcctgctctgggaacagtgttgtcctctgtgtgccttccttgagaggggaccacctcccaggccttccatcctcagggtgaggccatcagtctgatacttttctcaggagggacttggatccaggagaagcatcaggaagtggagtcttgggataatgccaggcctgctcctggtatcctgaggtctctgggctggggcaggtgtgtgtgtggcagggagggaggctgtcctggccctcctctctcttttctttctgcctctatgggggtgggggtattgggggaacttggggccgttctggggtagctaagcccctttcagcaggagattgggggaccagtgttgggggcatcctggtgatggccgattcctgcctcgtcacatgccaggcagatgttcccgactcggctggacccagctgcctcgtttcctcccttactttgctctgagggggtggaaaacaaggcttctctttctgccctggacagctaccagcacccggggtaggggatcccctggtcaccagtcttggcccagtacaggaaaaggaatccgctttgtggccacagatgggggctggggatggaagcagacctcagatcctgcatctcttcacccgctggacacaggagggctatgaaccactgtgccgtggctgcaccactggctggagcagagccaggcctgggagaggcaggtggccccatcggcccctgctctgcaccacccctcccagatgacagagccatatgtcttccacgtgtctacacactcacagactcacgaatgtaatcgctcagtctcacaacaagcacacgcagtcacacacctgcccacaggcacatacgccacataagcatgcctgtatgctcacacagtcatactgccacacgctattacacattcacagccacagccacacatgccttgccatccattcaaagcaccagtggctactttgtcagacacagccacaccacagtcctatgcacatggtcatagcctcacacagtgacacatactcgggcacacaccgccacaaagccatgcttgcacagagcaaaggtgtcataagcatctctgtgcctggactgcacctgcatgacctcccagggtccccacctcatcagagattaaggagagctttgcttggagacaccacccctggagggggtgtctccaagggggagtagagccagtcacaagcaccacatacaggcacacagcctgaggtctagggatgcaattgggatgactggataccaccaagttcagctccttattgaacagatgggcgcctgaggcccagggagcagtggtggctggccttatcacccagcagggcaggggatactctggggccagagcctggctctgggcagactctgtttcctggccctgccctcccctgggccaatcctctgggccaggctgcctctgaaggcccctggctgaaccgatccagcagagctccaggcagctcccttctcaagctagagctgagctgcagtggccacgggagccggagccaggatgcggtgggcagggcctaggcctgggcgggaggaacattcctgcaccatctcctccccaagcatgtgaggacccagcccgccctgcccgcctgcccgctgactcaggcctccaggagccaagcctgctcagctcccccacccaccctaacctgcttccccactagttcggctctggttcccctctccactggctggggcaggagaagacggtgagccctggtaggaagaccatggggaaaaatcaaacctcaccaccccccgacatagctcagaagggctgattgtgaaacccagctctgttcaacatagttgaacacaaactttttttttcttttggtttggttttgttttgttggtcaaaccccagtgcagtgcagtctgtttaagaagtagtgtcgcatagctgtggcctggatctgctcagcagccccagtaggcagcatttattccctttcgcaacaaagagactgagacttggccagagggaagatgggacctgcctaggttcacacagggaatctctggcggggctggactcaaacccagctccctgccatcactccttagagtcacactgatgaactcatttagggccaaaggaagaaggggaggcagatttcccctctagatgagtgaagggataggaggctggtgaacccaacggctgaaatgtgaagggtgagagggtagggtgagtccccccagccctgagggatgaagggtctgaagatggcactgcacggtgacagctgcagtgactcaggagctccgtttacaaaggaacatgagtgaggaacataacttaatttttttttatatctgacctgaatttctgttttcctcccccattccccacatggtagaagtgtaatctcacatcaatttggggaccctttctttccccagggatgtgtagaacttttggggatggcacatttgaagaccttagggagctttgcattttaaaggctgaatcccacactctatcatacatattaatatttacctgcattccacattaaagggttcagtttatgacttgtgtcctgtcttgtagatacttaattaaacggtattaattttgattttgcccctttctgttggtgctctgctctcttccctcctccccgccctgcccacccagcagcacacattgttacgggttgcttcttgcagaactcctggacctggatgctgccattgggcctgcgatgcccgccatggtcctggtcagcattgggccctccgatcatcttgccctgcctcctgcctttcccctgcatgctcccttgatgcccatcctgagtctctgtgtgtctggctcttctctgctcttgggcactcagggctccttccatttgccctgtactaaggggctgatagaggtcctttctgtggcctgtggccccctctggggcctgtggtcatcattccacagctcccacttcgcagtcaagcacagggagctctggggtgccgcttagacaccccatgccaccctgtttcttctgggatctggctcctttcttggggttctacctgggatgggggtatgagtcccactgcttcggaatctcccagcctctggggattctactatctcccagtgcaggcagcactgtgatgggcactggatggtcgttattttacaaccaccccatgtgcaagagattattactgtcattttacacaccaggaaatggggtccagcgaggggggtgctggagtagccaaggctggtgcgaaacagtacccaggcctgggctacctgtgctgagaggcagatggccagtgccagggccgggtgttacaggctggcggaagcctggaggcacctggagcctcttctgggctgacccgcaccccttgctgccatttggcaggagtgctctggggttggagcaagggagtatgaggctcctccatatagccctgctgcccccagatagcagcagcccccaccccaaccccattcctttccctctaccgcccagaggcaagtgcagatcctgaccagtgtggccttgctgtagggatgtttcttaactgcttcatgcttctgtttctccactgagaggggagttccagatggctgttaggagggtgacgtgagcagaacacatcatctgggcagtgcctgcacagccagcgccactgaggagcaggtggggtcatcagcctgagtagagctggagcagccctggggagagagagtgctaagaatattggtacccccacttcataggttggaaaactgactgggcaagccctttaaagccacacagtgggtagatggcagagctgggcctggaaccaggcccccaaccacccccagacctttagccttgccccgtgttgccacactgcctccgtggggagcagattccttggggtccttggctgtcattgtacttgtcatccagggcaggaggggtccgctgggccactaacagttacatataccaacatatacaggatagcacagcccaaggttaagagccccagtctcatacccaatgcctcccataaacagattcactgggtgacctcatgtaaggtcatcattcagtctcagtttcctccagcatcactcaagcgatggttaccacgattatacatggccacgagttcacgagtgtggatgctgtcactgcctcaggccggctgcatcctcaaagccacacaggtcagccaggttgggtgggcctgagtgcacaagagctaccattttttcagtcctctgtgctggtaccacgactgtttggaaggtaggaactcctattgtcaacattttccagcagacggtggctcagaggcattgagtcactgcgagattgcgcacctgccccatggcaggcctgggctgaggtctgcctgcacttggagccgtgcccttcccaccgcaccaggctgccttttgaaggctggggggctaggcgtggcgggggccactgtcctgctgcagtgtgaacacaagggtgctgggaatcgaagggaatggggagggagaggggcaggtggccgtgaggggcaggtggtgggtattgggtggaggtggctgtgttccttcaagtcagtgggtgaaaggtcagagggcttggcccacagagagtgctgagcaaatatttgtggagagataattttctggaaggcccgaggctggggcatggggtcaggttctggctgtggaggagggggctagacaggtgaggccatgggcagcgagctgggggcaggagcaggactctggtctctgagaagaactcaggagcctccttactccaggagacaatatgggggcagtgagagctggcaggaaaatgtcgagactcggggaagggggcttgtgagtgctgagccaaaaagggctctggccctggggctgggctggggtgtcaggtggggcaggcagaggtggggtgatggagtctctgcctgcatctggtacctggagtgtgtggacccacctgtgtggttgcaggtgcctgtcagtgtgtgcacctgtacctacctgcgtgtatgtccctgtggtggcgctggcgcttggtatctatagtcattcagccacacgagcttttccctgtgtttctcagcctggaaaagacaattcctctccccctgaacctcaggcccaccttgggctcatgcctggctcctctctttctctcattccacatcccatccacaagcacagccttgttagtccatcaaatgagaccccaaatgtaatgctctcaccacctgggtccaaaccactaggcttacctggactattgcagcagcctccaagctgcccttctgctgcctctcctgctccttaatggtctaacaggggccagagtgatcttttacaaaaacatgtgaatgtatatatatatatttatacatatacacacacgtgcatatacacatatataaaaatatgtatttttttttagagacagggtcttgctatattgtccagtctggtctcaaactcctggcctcaagtgattctcctgcctcaggttcctgcatagctgggattataggcataagccactgtgcacagctcagagtgaacttttaaaaccatattctttttttttttttaaagacgatgtctcactgtgttgcccaggctggagtgcaatggtttgatcttggctcactgcaacctccgcctcctgggttcaagcgattcttctgcctcagcctcccgagtagctgggattacaggcattcaccaccttgcctggctaatttttttttgtatttttagtagagatggggtttcaccatgttggccaggctagttttgaactcctgacctcaagtaattcacccgcctcggcctcccaaagtgctgggattacaggtgtgagtaccacacccagccttaaaaccatattctaaatcaaatcatgtctctcccctgctttcaacctcagggcttcctgccatacttaggaaagtttccaaactcctagcacaacccacaaggctccttcctggtcttgcgtcagacccctctgcacttcggtcatggaactccagactcattggtcggctggtttcctcttctgcgtttgctcagacctcagggcctttgcatttgctctcttctctgtcttgcatgttcttcctcccagataaacatgtggttctcacctcaattaattcagatctctacataaatgtcacctccttggagaaggcttccctgaccctgaaatctaatgaaacttcctcgtccctctgtttccttaccctgccttattttttcttcattttacttattaccagctgccaattataaatgtgtatgtatttagctcttatttatttatttttgtcacccaggctggagtgcattggcgtgatctcggctcactgcaacctctgcctcctgggctcaagcgattctcctgcctcagtctcccaagcaaatacaggcctggcacggaggctcatacccaccactttgggaggctgaagtgggcggatcacctgaggtcaggagtttgagaccagtctagccaacattacaaaaccccatctctactaaaaatacaaaaattagctgagcgtggtggtgcatacctgtaatcccacttactcaagaggctgaggcaggagaatcgcttgagcctgggaggcggaagttacagtgagccaagattgcacaacttcactccagcctgggcaaaggagtgggactatgtctcagaaaaaaagaaaagtttcaaacatacacaaaagtagagaaacgaatataacagaaccccacatgcccacctcttggctccaacaattctcaacactgggtccctattttactcccccacaccctttgccttccggtggactccagcatcacacagtctcatgtgtggatacttcagttcaaaggttatattttaaatgtagctgtttctggtctgtctccctcagtagaaagcagctttctggggagttggtgtctgtctgtcttgctcactgctgtatctccagctccggcacagtgcctggctcccagtaggtgactgaggaggtctgcatggctgtgtctgcaggtctctggggagggcatgtgtgtaggtgctggtttgcacatgtccaccaccgtgtcagcgagtgtctgcacatgcctttatgcgcagctgcatgtggcagtcctgtggatacgtgtgcatgtgtacgttgccacagcagctgatggctaaatgcgtgcctactccctgatgtcatttcccacacccctggggacccaatgactcgttctgggaagtatttccctctttctcagcaagggatggggtgtgaaggggtggaagaggggtgtgcaccagtctgctcagccctctggaggacccagagagccccttcttgaccttccttactagcagggcgccgtgctgtccccaccagtagagcaggcagcctctttcttccctggcattgaaacccagccagttgggccggcatcagctgggtggggtgtggagtgtgtgtgtatgaggcgtggtggtggcccatcctggccagctccaaaggctcctagggtgactgctgtgtaattgggcaactgaggccatttaagctggggacaattgggtgtagacatctggtccagtgccccagcagtgccccctctcccccctgcaagttctgcatcttaaagggctggccctggaaggcgggcagtggcgtaagacctcgctctcagcccagcaccgggttcattccaggggctccttgctgtcgggccaggagctccacagtggcttctcagcctgctctccagggccccttcttaccctggaggccagggtccgcgtcctctggctctgcattgtccttcccacctcccaccctgccttaggctcagctctcctccttcttcagggcccagcccagacagcccctgtgttccaggaggggcctgccccttccacctgggcagtcaggttctttggggctcctccctcttggatccctgaggccaagacctccccaccatgtaggccagatggtccccactcactccacccccaacctcagggagagccttccgaatcagtgaggtgggtgtgcagcaaggaagggcagagtggcactgccagctgctcctacccagaactggatcccttgctgcacacctcacttcactccctgccacagcccagtgaagaatggccctgcgtctctctttgccagatggggaacacatgcattcggccatccaaaagaaggactgagcatttgttcggcacctactatgtgtcgggcactgagatagctgccataaattatgataataacaataacatcagcttctaccatttgtcaagcacctacaacatgccagacccatatgctgggccattcaataggaggaaccatcataacaccaataataagaatggtcggcctggcatggtggcttttgcctgtgatcccagcactttggaaagcagatgcgggcatatcacttgaggtcaggagttcgagaccagcctggccaacatggtgaaaccgtgcctctactaaaaatacaaaaattagccgggcatggtggtatgcgcctgtagtcccagctactcgggaggctgaggcaggagaatcgcttgaacctgggaagcggaggttgcagtgagccgagatcacgccactgcactccagcctgggcggcagagcgagactccgtattttaaaaaaaaaagccggtcacggtgtctcacgcctgtaatcccagccctttgggaggccgaggtgggtggatcacgaggtcaggagatcgagaccatcctggctaacacggcgaaaacccgtctctaccaaaaaacagaaaaaaaaattagccaggcgtggtggcggacgcctgaagtcccagctactcgggaggctgaggcaggagaacggcgtgaatctcggaggcggagcttgcagcgagccgagatcgtgccactgcacatctgcctgggcgacagagtgagactctgtctcaaaacaaaacaaaacgaacaaaaaaaaaacaaaaaaacgaacaacaacaaaaaaaaggccaacatttattgagcatttactgtgtgtgaggggctgttctaagagctttgccttaacactgaccctttggaaagaaaccttggtcagttatactgttttggtagatcttcattcagagagagggcagaagctgggctggggccctctggccagacacatagcatgaatgctggaagggacaggaggagggcttctaggcagaaagcaggcactgagctcccaggcctggctcaatactctctcgaaccagtggtcccttcttgagttagaacaggtgggtggacttgtacaagctcaccaagtggacagtcactgcctctgccctccttccttcagttcatgtgttctgcccccagactctgagcttctcagggcagattagggagcagaggtcctggggccttgaaccttcatggagtccctgggccttgccccagttgcttgtccaggtgcagtactcacaaggcaaccttttagcagggctgactcagaaggggcctttctacctgagtcactgacttccaggagcgctcaggctctgccagcctcgcccacctgcccagcagctctttaggtcaccccagcacaggcgccaccttccccaacaagactcaacaaggctcccctgccgcagtctggttcttgaaggtctctgccctggccagcatgtctggcatccctggcccattgcctggccccgatgcctctccaggtgttgggcatcccactgctgagagacatatctttggcatctggaagtgtttcaagcctctaggaggcctagctctgccggtgaattgctttgtgactatggttgagtcacacctcttctctgggccccctgattgaatgcacggtcgtctgggtgggggagaggtgagggcatccgtggctctgctctgccccttgcccccgaaggttgtgatcaagtgagccctgtgagtggttagcccggctggcacagcgccccatgagcctggatgttctcaggagggctgttgggcagggggaggctgagtgtaagggggtttggggtcatctcctcctcctgccccacttaactttgcttctttctgtggtgagcccccacgtgtgatttggtgaacgtgttctgcccatagcgttctgagatagaccctataggcagaacacgttcaggcagaatgacctcaggtgtctgggtgggagggagccacgggcgagtctgaaggaggtgtgcagtgagctctgaagcatctgggagggaaagattaaatccacccgacagaaactcagggcctggggtcaggtcagcctgggccctagcagagatctggggccagagcagccatcgagagcccagccagcaaccctgggggtgagaggagcaggggagccagagtgggaacccaggagaggtctgggtaggatgggtggtcagaggcctcttggcttgagggcatgtctgagggaagggggtgctgtgttctggcagtagatgtttgctggacatctactgtgtacccagcatgggcacagcagtggctaggccaggctacacactgccttagtggagtgtatagaattgaacgatgcctactgcagggtgtgggggtctggggccttcacctgggctttggctcaacaacccaggaggggagtggagttggtgggggtcccaaaggcactcccagcaccaggatagcccacaggctgggggccatagaccagcattccttctgtggacaggagagacagtggggcacctctgcgggacagagagctctgggtgtcccatgccctccttctgaccaggcctggctggcagtgtgacaggtggcttctttcccctctcctgctggctgccctgctcctccatgggggaggccctgtgcatgacacaggcactgactggtgacattggccggacacttcccttcatctcttcccctgacaggtgagaccagatgggcagggaagggacaggaagggaaggagcagccagattacagaaggtggggtggtggggctactgtacttcccagggccccatctttgggaggtaaggatgggagtaggctgtttcctgcagagcctccccattggatcagatctggctgctggtcttaccctcctctgcttccctctcttgtcctcactggagtcccctggggaaggaacccatgtcagaacccatccctccaaacctgcagcggatgtgggggtctttgcaagagtgagagctgaagtggaatagaaaaccctgggacagggctcgaggtctgacccctcttccagctcagccaccagctcactgtatgatcttggtctgggccctgcctctcccattttagtgtcccctaattaaagggtgaggggaagacttcagtcaggacttacactgtgtcatgtgtcttctaatcaccagggaccttgttaaaacacagtctgattcagctactctggggtagggcctgagagtcttcatttccaacaagctcccaggtaatgccggtgctgccagttcatggactccactttgagcagcaaagacttaggcaactcattgcatttgagtctgcaagacccagagactgtgtctcttgggtcctttgcaatctcacgaggcatcagaaggaagccttgggattagctccaggctctggactaacagagcacggatctcaggttggcaggcaggggaactatcctagtcccctgctgaggctgtgtttgggtaaaaaagtccttcttggcaactgggcgatttaatccagggttgcttctgtctctaggggctcacaggacatctggaacatgaaggaacacaacacaacccaccaattatcttggtggccacagagggccctccaaggagctgatgccctttgtgaggctagtagccatcagttaaatactgtaatccattacactgagaatagaaatgtaaccaggatgtagctgaacatgcccagctttagctgccatgtggctgggccttccatggaaaggaccagccttctctaaggagaggaggaagcagacagaggcagtgagccctcccactctgcgcttcccctcactggcctgctcacaccgctgggtgaaggcacatgtcagggttaggtagttattcaatggtatgcctgcggctcttcaggaagggctgattggattcctatctacatcttccactgcatttttggcacaaaatgctctggctattgcctgaccaatcttagcggtaactccacagggatggcgttacctatgagaggccctagggtcggagtggagctgtgtagaggagcccagcgggtctggttctctaccttggtcccaactatttaccagggcttcccgacatcttacggccaggaatgggagatccaaccagagaggtctggagttctgcccaggaagaacctccacctctttgagatctggaatcttcagggcctggaggaagatgccagcagccctggcagttctcattggtcaggggaggtcggtgtggggtggcagaagcacttctctggcttcctattgggggatgagtgtgcaagctcagtgggctccctggctgccagagcaatctgcttaaaggactggcttctaggatgcagggaagggctcagagggagccccttctctagcacctgagagactaagccacttagggtggtgggcagggtttctaagctggggtcctggggatctgggcccctctggcaactcctaccctgtccccttcccccaccagtgggctcactttgcaattctgctgatgtcagcttgagtgccttaatgggcagaaaatcctgactcctttgcccgactaggctagctgggactgcagggggccccaggtaaggagcatatacttctgaaatttgtgtgtgcccccgcgtatgcgtttgtgtcttaggtaggtaggtatttatctctgtgttgtgtgtctgaaggtcatgcatgagcctgtgttcatatacacaatggcgtgcacaaaggcacattatggatttgtgtatgtttgtttgtgtggagagggtcaggagctcccagacattcctgaacacttgcacatgggttggctgttatctccagcgcctgggaggaactggctccttaaaggagggggatggtgagttactttgtaaagtggagacaagccccttaagccctggggaaagggatttacataaaccaaggtcccacgtttaggttgggttctcagctctggtgtgcccatgaaagaccctctcccaggtcctagcagagctgctggcacagtgccctgggtgccagcccactgtcctgcatgggctcagaggagctggaacggtgtcagctggtgccagctccctgggggcagggcaggccgggccaggctatgtgaacagagtgtgtcctcagtcctctgggggaaatcggagaccaggccagatcctgcctgctgggtctctcaccctcttctcagcttacacttccagggaaactggtcaccctgggtagagacttgctccagatatcagggccctgaggctccagcctgagctcctgggaggggatgtggtgtagagacacccttggccaggcccctgcctcaggctggcctggggcgccagagagaccaggcttgtagaaggaacggagcaggctcacgcggagccctgtgcacggtgagctcagggtgcagagggatctctggggccctggtcaccctccctggggagtcctgcttttcagtgtggcaagaagcgccttgctgtgtgacagccctcttcccctccctgactcttagtctcccctgggtcctctgggggccctaacagcaggatgtacctggcctcctgcccgaagcctctcagagtggaggaggacctaggaggctggacactgagatgcgagaggcgtcataggaggggcggtccaggggcagggtggggaggagacttctcttgctcattcctggttcaaatgtttcagatgttgggatgcagggaagaggtgactctggtccccagatgcaggtcagctgccagaggctggccagggcttcccacccactgaccctggctgcactcagaggcctctcacatttctcttcctctcttcagtctactgtcagggccaggcatatcccctgggacccagaatctgtctccattgcccccaaccctgcgacaccctcaagagaggtctagagggtggtgactcagtaactcagagagggccttctggagatgccgcggcctcagaacccctctgtaacccaatgctggcctctcaggccacgtgcggggatgcctggcttttctgaatccttgctgcttcctctggctttgagaagcagcacacttggtcctcctgttgggagggtggacaccagcagaagccttccttgtaaaagtttctaggaggcacctgtggtggttctcctccccctcccccttggtaccatgtcccagccttgggatccccaagtccccccactcccttcactttgctgctgcaaccccttgagaggtggctggggaaggacaggggtatggaggtcgaaactcaggctaataaatctagggtggggagcatttattttaatttttgtcttgcagctctttgtagaggacctagcctttctctactgaactgaaggggtttggtcccatcacccgaagactggcccacctgcccacacaggtgggggcacaggaggtctgggaggccccaggaggtggaagttcagaggcctgcctggccctgtccatcccactggctgaggccaggccggagggccgaccccaggggccctctgtatgcaagccgacgcagacaagggcccagtgcatagttaagacacaaacaccacacagctgtccagagcctccaaagcactgtttatccaggctccatggaaccaagtgcccccagctgcctgccctagtcctcaggggggcactggcaccgcagtggcctcggcctgagaccctcgatgagccccagcctaacctgctccaaagccactgacacatgcatgtttagcccttggcccatcaagatggggccctgggaatgaactggctgcagaccctcctccatcccacacccccaggggctccatcagtcctggctagctcagcaccatgttaaatagcttccttgcaatctcccttaaataaacccatccccagagcaacctacccaccctgcaccctgaatatattatcctattggcttatgccttctagactggaggcgctctctcctcttgccctctactccaggggataccatctccctaaaaaaccaggggaggaagtttttttctcaactctggggcagagacaaagggtggcctgggttggagtggaaaagccaggaatagcttcctctgtcccttccctccccagggtacttccttctccttgccctcttagcagcctgggtcaggcgcgacttacccaaggtcacagacccaggacccagagtcatgacccatgtaggaggttaccctggttttgacagcccaaaccagctccagggcaggaggactgaacttaagcctgcctccaccttggcccctgcagttctccaggctcggagtgagctgagggaggttccagctcttgactccactctgtcccggacccctgggactatctcccaggaccctccacccctggtgtctccaggtctctcttgctctggggatactcagacagcaccaggcatggaagcaatggggcccgggacatgggcaagcctgtccctggcccgatcagcatctgggcccaggccaggcctcacacccagtactggccattcttaagggcagggttgggtgtccggcagaactgcagcagctctgggtcaggctggcctcctggagggggcccctggccaggcacagctgtgagcgggatggcctggcctggctccaccttgcgaaaggtctcggtgtcaccagccaggccgttgcggggcttggcagtcaggacctggacgtcatgcttgcccgtcttgttgcgttttcggaggtagaagagcaggggcaggatgagcgccaggagcagaagtaccaggcacatggggatgatgacgctgaacatgttggcctcaaggaagctcaggaagcctcccttggccacagcgggctcagggctggatgccatggggcctggctcgcctgtgggggtgctgctctctggcttccctgcttccgtccgggcggcctcggggacactgagcagggccacgctgtagggccgggcagcattgtaaggctcagtggcaaagtccagggaggccacagcaggcgggacgccctgtgcccacagctccagagtgagactgtcacctgcggggccgggggccctcccctctggcctgcccacctccagccccagcctcccgtcctcaaggtcctgctgagtgaactgctccaccagctggctgcccccgggctccgtcctggctcggggcacgcggaccacgcggccatgccggggtccctccaggaggcggaagcgcggcacactgcctgtgcggttggccagctcgccagcatctaggacggtggggtccaggcgcagggtggcaccctggggccatggcccacctgcccacacatgcagcagagccctcacagtgacgttcactacggctgatgcattgacacccctagccagtgccaggactctgaagtggtcatgagaggaggagaagttggtgaaggcaaagaccacctcgccctggtctatctggaattggctgaaggccgaggtgggccgcccgcccaccaggagatgcccatactggggtccctggatgaggcggtatgctgcctctggctcctcccgatctgaaaccacccggagctgctgctggctcagtgaggagcgccccaaagcttggggcacctccaggggtgcccgcagctgcacctcgatggcggatggtaggatgtccacagccagggacatgggcaggggtgggctggccccatcagacatgctcagctggaagatgcctgccacgctgctcccgttggccacgaaggccagccgccctgaatccacatcggcttgcgtgaagcgggtcacgggccccaggccaccacccaccaggctgaggaagccgttgtggggtgcccgctggacctcgtactcaatctccccaggagctgagtctgggtccaccacactcagctgggcccgggagatgggggcacgagagcctcgggtgagccggagtgggacagaggcctgtggctgagggggccgctcatttacatccctcaccgtgatggcaaaggcctctgaggtttggggtccagccacggaggcccctgctggcccctggaggtgggcacgaaagtggaagccatcctgctgggtgcccccaccgccgtgggcatacactagctgccctgcagccagctgggactgcaggaagtggggctgcccagcatggaggggctcctcggacaccaacagctggccccggctggggaactgtgtgacctggaagagcacatcatgctctgagcgctggggtgatggaacgctggccaagagattggaggcatccagagcagccacggtgatcctggcccgctggccctcggggacccagagacctgggggtgggacataggctatgagggtccagcccactgaggggagagtgatggaccctcagctgggggtgcctcagggcaaggatgtgcctccccccaaccatcaagccaggtcctccagggtggggctcagggttcccaggaggataaggactatgtccccgctgtgatgtcaaagcttccccactcaccctccctgtgacttcccaggtcctgggggctgagacaggagctgctgaccctggcctcgtgtcccctcctcctgggcctctcccattgtccctccccacaatcttgccagcttatcatgctgttcacctttgttcttccagaggtggctggggcgctggggacaggcagcctcaaaagacacagccacagcaagggtggcggccacgtcccgggcaggcggcgaggacagctggagctctagggtatcatgggcctcccaaaagggctcggggggcatctcatgctcatacagaatattcccagcgtagacctaggggagacaccatcgtggggtgagaggcaggtccagcctgtgttgtccagacactgagcacttttgtctcctcaggccccactctgggctctcctgggtgtgcccaggtctgtgcgtgtgacccgctgtctccctcactaactcactgggtcacatcaggcaatgcagtgcagagctgggctctggagccggagcctgggctcaaaccccaactctgccaccctggggaaatcgcctaatttctctgacctctggggaatgcaatgatctgtctgtgctgctctctaaagcgagtacttcctcttgtgcacaggatcctatcccctcttgccttctgaagacaccacttctactgtctcttggctttctcctatggtgtcagttccccccagatgcatcattcccttcattatgcaactatgctattcttttgtctcacttacattaaagctatttaattaattattattattattattttgagacagggtcttgctctgttgcccagactggactgcagtggcgtgatcatggctcactgcagcctcgacctccagggctcaagcgatcctcccacctcagcttcccaagtagcggggactgcaggcacatgccaccacacccagctatttttttttattgtttgttgagacagggtctcactatgttgcccaggctggtcttgaacttctgggctcaagcggtccacttgcctcggcctcccagagtgctaggattacaggcaggaggcactgcacctggccagaaaaaactattcttgacttcacattttccaccagcttcacccctgcccctttgcttctctttgcagcaaaacttcaaaaagcatagtccacgctctcccccaggcattcttgggtctctctacccaggattttgctcccccatcgccacatctccttttgccaagggcaccagaggcctccgtgttgttggatccagcggtcggctctcagcctcctcttaactgctcagtggcactggtgccgccaagcaacccttcctccaagagagccacaggctctgggatacttcactctggggttcctcctacctcacagactctcctggctggtcctcctcttctccccaacatcttatggccaggtctccaggctcttttctgtctacaggcactctccatgagtccttattcagtctcctggcctcaaatgccagctgtgctgagacccccttatttgtagctccagcctagcctgctctcccctgaaccccagactcatgtttccagctacctctgccgatatctaatagacacctcaaactcaacctgccccggctgcactcccgatcggcccccacctcctacagtcatcctgcttcagagactatagctccgttttcaagggctcaggccacacccttggaaccacccttgcatcctctctttccctcaaaccaccgcatctctcacctggattatcgtaacagcttcctgtgtcccagctgcagtcccccgcccattacattttgttcctaacacagcagccagagtgagccttttgaaagggaagattatggggctctttggctcacatagtgcagtgtctccccatctgaccactaaggcctggctgtgaccatatcacccctgcgacctcaactcccctcacctccactccagacacacctgctgttctatggtgctgcctgcagttcaacaccaaagaatattcttcgctccaggaagaaaaacggttttctccacctccaatcacaatgtgttcttttggcctatcttttgctccccacccacccttttttttgagacggagtcttgctctgtcgcccaggctggaatgcagtggcacgatcttggctcactgcaacctccacctccacctcccgggttcaagcgattcccctgcctcagcctcctgagtagctgggactataaatgcgtgccaccacgcccagctcattttttgtattttagtagagatggggtttcaccatgttagccaggatagtttcgatctcttgacctcgtgatccacccgccttggcctcccaaagtgctgggattacagctgtgagccaccgcgcccggccttattttccccttttaggaaacactgggaactattttcttctcagagaaaaacaggacttgcccaatagtaacatggaaacttaacagggtcttaacctgtgaagactctaggagcagaacccggagtaagggggagcaggggccggagtaaggggagcagggccccgtctaagatggggcagggcctgggctaagggagagcagggccgggctaaggggaggcagggcccagtctgaggtgggggcagggcctggtctaaggggagcagagcctgggctaaagggcagctgagcccagtctgaaggagagccgagctatctgaataggggctagcacctgttctaaaggaagtggctgctcccctgctttcgctgtaagagggaacacaggccttttaagaaaat

SEQ ID NO: 130 - DNA, 1507 bp, Homo sapiens
ctacctaagaagtcctggaggcaccaaaatgttccttttattgggagagaaagggcaagccagaagtcccccagcaactcacctgaggtactgagctgagctgggaagggtggactcttggagcctgggatcacaaggatcagggaaggttccaaggaactgtcaccttcagggtgagggtgaaggcactgccacctttataggcgggcttgtacgtgtggccacgcctccttccctggagcgagctgagatggagggagaagcagcctgaaccgggctggtctctctgggattggagagaaaggtggcggagggcggcgggggtggggggtcgggtgggcaagaacccactatgggacacatctcggtgcctgtacatagaggggtgagggctgggaacacctggaagtcccaattccaaggcgtcccaagggcagtgcagaacccagccgaggagggggcttgagggagaagtcccaggacagcccgaagagagggtacgggaagctccatcctggggcgcggggactcctcttcgtcatttttgcacccactggaacgctgggcgtgcagatgcctccccagcgctacagcctaccaggactcggcaggcgggggcggggctgccccgtggtgacctccttcccggggttactgagtcccggctcgcgtgagaagcgctgcgaccccagccctgaggtcacgggggccggaaggccagaggcgccgcggggctggacctgtcccccagagcccgggcgactagctgaggttcgcgcctcttgattgaaggatcggaatggatggcgaaggggcaggctcgctgagcgctcactagcggctcctcgcagcctctaggatcgccttagtgctgattgcaacgcgcggtccctccagccaggacccaccggcccttgagggtccctcttggctcccggggtggctagtgctttgattggcagagcacagaaatccggcggcggggggccacggaaagactcgggcccagggaccacggagggggcacctggcgcggagcccccaccctacccccggctagcttgcgtgcgccggcgacatccctctagggggcagaggtcaggcggcccgtccccgccccacctggcccggaggcgcggtgcccaggcgttgcgtgagaaggaccggaggcccgcgcagccacccagccgacccattccccggcccggcgcgggggctcgcagtcacgcgaggggggagggagtcggggcggggctcttaaagggccagcctcgcgcgcggcgtggggttggggtggagggagaggaactgtcgaagggtggcgggtgcgcgattgaataaggggatgcggtgcaaagggtctaggtctgcgtgtggcttctgcctgcgaggagaggcagcctgcatgtgtccgcattttcggtccacgcctgtggcacgacacgaagccccagtgccatttggcatggcctagctgcctgcctccgacgctgtcccgccctccgga

SEQ ID NO: 131 - DNA, 1854 bp, Homo sapiens
ctgcatgaagcaagtttctccgcttgctttatgaaccaaaatttaacttctgattcatttttattaaaatgccaaaactcacacacttagagccagcccttgtttcaaggactatgaagttaaaatttaacatccggtgcaaaagaaagtgagacagtgaatgagggttcatttgggtatgttattgtctaaagtaatcctcaacccttcaatgaaaacataggcatctcaaaagtaaaatttaaaggataacaatattcagtctatttaaagaacaaattacaggaaccgccaatgataaacatagtatattcataatagaagtaaattccgaatacttcaatctccaaacacgaggaaaaaaaaaaaaggtgagaggcaacagagtatatgcgtgtcataaatcaatgtattttctatgatttctgtcctgcctgctcaaaaattttcaggaagtctggagtaaaatctctgggcccttgggaagatgttagatgctagatgctaccctaaccagcaacgcaacccacctgacaccccagagcagctcacagaacttcagagtagtgaaagggagggtataaataagagaacagtaaaggcaggagatttttccgggagttggaattacgactctgtaaggtcgttttccaaggctgtgcttaaactattcacggaaaaacacttctttttctacctaaagcagagatctgcagcaacagcagccagactcccctcgtcagtaccaaagaaagactaagttccaggtgcaacaagcatactagctgccctctctgcaccttggagcagacacaaatgctgaaagccacccccaaccagctcaactccaaatatctcggaaggggactgaaggaaaacggatactgaggtgcccattctcaggcttgtagcatccacagccacagagacgggagaattcctggctctgagaaggggtgaccaagatgaggacattccaaactgcgggacatgttcttgcaaaagaaacacgggagtccctggaaacagacgtgggccaggcttctcctcgctactggttaagctggggcgctcccgccaacaggctcaaagccccgggaagcccctagtgaggccccgtggccggtaacccccaacttgcaggacgctcaagacacaggccaccgccctgccggccaggaacgctggctccgcgcttacctcgcaggccttgagcttgtcaccatctccctcagacagaccagtccgacgcgtggccatcatttcatttcaaatgacaaagaagggacaaatcctttggagtccacattggacgtggcggggaatgccaccacacacccgaaggggaagaattccacaagcaggctccgaggaggggcagggctgttgaaacagacaacgtgccagggaataaaggttttcaggaagcgccttcaaatgcctcgctgatttctcgtgacttcaactgacttcgccttcttcttccatttctggagacttaaaaacaaaggcgacaggtcttcttggcagccagtgtcgaggccaattgcagaaagcggtccccttcttcccagtgccactcctgagtcctggaaaaatccgaatgggtcgtgaaggttcgagtgtcagctcctagagagatcctaggaaaacgagaagttaaaggtcatgaactttctccaggcgcctatcactgtcttgcccacatgtccacaccaagttcgcgtttcctcccgagcaaaacaaacaaaaaaaaattttaacgtaaacaaacaaaaagcctataaattcgagggggtgtttaaaaaagagaaatctcgaaactgcccagcggttgcgtcaaacacacctggc

SEQ ID NO: 132 - DNA, 7661 bp, Homo sapiens
ctgcatgaagcaagtttctccgcttgctttatgaaccaaaatttaacttctgattcatttttattaaaatgccaaaactcacacacttagagccagcccttgtttcaaggactatgaagttaaaatttaacatccggtgcaaaagaaagtgagacagtgaatgagggttcatttgggtatgttattgtctaaagtaatcctcaacccttcaatgaaaacataggcatctcaaaagtaaaatttaaaggataacaatattcagtctatttaaagaacaaattacaggaaccgccaatgataaacatagtatattcataatagaagtaaattccgaatacttcaatctccaaacacgaggaaaaaaaaaaaaggtgagaggcaacagagtatatgcgtgtcataaatcaatgtattttctatgatttctgtcctgcctgctcaaaaattttcaggaagtctggagtaaaatctctgggcccttgggaagatgttagatgctagatgctaccctaaccagcaacgcaacccacctgacaccccagagcagctcacagaacttcagagtagtgaaagggagggtataaataagagaacagtaaaggcaggagatttttccgggagttggaattacgactctgtaaggtcgttttccaaggctgtgcttaaactattcacggaaaaacacttctttttctacctaaagcagagatctgcagcaacagcagccagactcccctcgtcagtaccaaagaaagactaagttccaggtgcaacaagcatactagctgccctctctgcaccttggagcagacacaaatgctgaaagccacccccaaccagctcaactccaaatatctcggaaggggactgaaggaaaacggatactgaggtgcccattctcaggcttgtagcatccacagccacagagacgggagaattcctggctctgagaaggggtgaccaagatgaggacattccaaactgcgggacatgttcttgcaaaagaaacacgggagtccctggaaacagacgtgggccaggcttctcctcgctactggttaagctggggcgctcccgccaacaggctcaaagccccgggaagcccctagtgaggccccgtggccggtaacccccaacttgcaggacgctcaagacacaggccaccgccctgccggccaggaacgctggctccgcgcttacctcgcaggccttgagcttgtcaccatctccctcagacagaccagtccgacgcgtggccatcatttcatttcaaatgacaaagaagggacaaatcctttggagtccacattggacgtggcggggaatgccaccacacacccgaaggggaagaattccacaagcaggctccgaggaggggcagggctgttgaaacagacaacgtgccagggaataaaggttttcaggaagcgccttcaaatgcctcgctgatttctcgtgacttcaactgacttcgccttcttcttccatttctggagacttaaaaacaaaggcgacaggtcttcttggcagccagtgtcgaggccaattgcagaaagcggtccccttcttcccagtgccactcctgagtcctggaaaaatccgaatgggtcgtgaaggttcgagtgtcagctcctagagagatcctaggaaaacgagaagttaaaggtcatgaactttctccaggcgcctatcactgtcttgcccacatgtccacaccaagttcgcgtttcctcccgagcaaaacaaacaaaaaaaaattttaacgtaaacaaacaaaaagcctataaattcgagggggtgtttaaaaaagagaaatctcgaaactgcccagcggttgcgtcaaacacacctggctgttatgcagccttcaagaaaaaatgttccccattcaagtgcattttaattcatgtctttcctgggtagagcagagggctgtgcatgttgttttctgcatcacccagacagggacacttcggtgaagttttctcccccacgaggctgaaatgggatcacactttccaagccccctcttcgctcccctccgccccccaaaaacgcaagcacaaagccagcctggctggggccggcgtgggctcggcggcgtctccgggtgactcgggcgccgcccctccgcccctccgccccggccggcgtccccgaggaggcggctgttttccttggcccgcggcggggctgggtggggacggccggggaggcgtgcgcggccgcgggtgggacgccggcgccgctcccgctccagggcatgattctggagctacacccgagcaactctgaagtcgcggcttttcccccaactaccactcgacacggcttcccttcccctgtggccacctagggggaaaaaacgagaaaaagcaaaccaccacccacctccccacgattcccccgccccttcctgaggcgggtcggggacctcgagctcccgaggagagcggccccaatatggactttctcaaaggtgctaggagccccggggcgagacaaaaccgggggccttacccttcccgcccgctcgggcccggcggccgaagcgcggcggcgagctgaagcggagacgctggccgggcgccgggcccggccgggacgcgctaggccgcaggctcggttaatattcatgagcggccccaggcgcccctcctccaaggctggccggccggaccccagcgcccaccgccggcctttgtgcccttccctccgccccgccgcccgcccttgctccgcacacgcgggcgcggcccctccgcccccgccgggcgcccgccgcgggctccctccggccccgagccagcgcccggccgggtggcctgtggcgggaagggagagagcccgcggcaagccgggcactccacggcccgcgagcgcagcgccctctcggctgagacggaaaagaaaccagacacgcaccagaggaagcgggacgagtggatccgcacggggctggccggctccgggacagcgcgccccgcccgcccgcccggcgtgagccggaccccgcagccggacgatcccgcgctgcccgccgccgccgccgccgccgccgccgcgctccgaggccgccgcccccggccggccgctcccaggcaccgccgcgacctgccccggccggccccgggctctcggccgccgcaggagggcgtggggcggggcggcggccgccggactctcccctcgcctcgccgggccgggccggggcccagctccggcgcccgcgaacgccaagtgacagaagcgcctcgctccgtggccgcgcggagctgtttcccgggggcggatttctcgcttcttcctccctggatccacctcctcccactccacctccttcccctcccctccccaggggaggctctggggctgaatattttctgtcttgaataacacgggaccggggaaccgacgctggagaagggggattagccggaggccggagcggggtgctcgcctgccccctccccgtgggtcgcgggacctacaagccctcgccccccagcaccccaaaaccaggcacacaacgctccccgcccctgcagtctcccaagcgctgaacggcagcgtccagggatgggcttgctcccgggaaaggagacctggtggtagacgtctggggtggagagggggacaagcctataacagcgacatctgcagactccagggatcaaaggtcctagattgggggacagggcttggcaaattgtgcccccaccccttttttgcagcgggaaggcaatgaagctgcgacgagacgtgggacttccagataagggagtgtcccctcacgcctcacagcaaaaatctcttcctgtggtgggaagggggaagttagccaagcgttgctcattcagttctttcccttttataaattctgcagagcggctgagcgaatttggcgcggctagcggaactgtggagaggcggctgcgcttctctgtccgccacactccaggtcacagcggctccggagccgcggcacaaccgccaccctccccacccaattcccgggccttgtcacagaccccggcagctcgctccgccccgccgtgcctcacaacatctcccgctgcaaattacccaatcgggagacgcgacgagagaacgcgaaccaatcaggggctggtaaatcaggcttccctccgccctcttccccgcccccgggtgaaggccaccgccccctcggcctctccttcccaccccgccccgctccggggaggtggctccccggctccgagcctcgcggggctggagggggagttgctcgcagtcagaggcagcgtttgtcaccttgtcaccctcatcctcgccccctcccatacacactcccctccccttctcggtgctcctgctggtgctgttgagggtcatttttatcctcactgcggccggggactgccagctattgtgtctgatcagctgccaccgctgtccagagggaaaaaaagaagaacaaaacctagaaactgtggagtcctcttaccttttccttctttctttctacactctcccctgtagacttagaaacatcccttctccttccccgcccgcccaccacctgaggtcctgtttctttatgggggacaggggagcggggacaaaaaacactccctgcagctggagtacctgcgccttagtttttacatcttccttaaagtggaaggtgccaaaccaaatctacaactaaatcctccgcttcaattcgagggaagacgttgacgagatcatttttatatggccatgaaatttgcgtgttcttgacagcctgtcaccaaacaagtcagctaataatcaagaaaagaaaaatagaataaaatacaaggactgtatttcagtcagatggtaatttactaaatagcccagtggctgtagcagtatccagtgctagatacaattgagtaaattaacaagaagtgaatagaaattcagggttcaagtagctcaccgcttgtgggcttatagaatatgtccagaaaggaaaaacaacttacagcacaaaacaactccttgcacatgcaaatgtgcatgcatggcatgaacggcgtacctaacagctgaggacttttgggttaaaatttttgcactagaaattttttaaatgttgattgtgaaattttcagtttgataaaggagagtaaaatgtgggccatgaaaggagaaggaaaaggaaggaaaacacattctaggaattatggaaaaataacataacctagagaggcaatatttctataagaggtaataagatgtaaggatcaagattacaatccaactccatcatttaccacgtaacttagggaaaattatgacttatgtgtctaagtactagagctatcaaattcaatacctcctgctaggtactcctctaaaagctttacacacaacatattgagataggtgggtggtgaagcaaggattcaagcccaggggatctggctccagagtccattcttttattcacaacactatactaggctgggcccagtggcttatgcctgtaatcccagcactttgggaggctgaggtgggaggatcgcttgagtccaggagtttgagaccagcgtggacaacatagggagacccgtctgtacaaacaaaaagttagctgggcgtggtggcatgtgcctgtagtcccagctacaaaggaggctgtgaggcaggaggatcgcttgagcccagcagttcaaggctgcagtgagccctgtccaagtgtggcactctagctagggcaacagagccagactgtgtctcaaaaaataataaataaataaataaataaataaatcactgtactacctcttaatatgggtttttaataataacagctaacacttaacttactatgtgtgaattattgtggtctttgagtgccaatttaactctactcctgggacaaatataattgtgatgttctaaaatttgggaatgtttttaagaactgttatgataagttactatcttaggtatcttaagtgtattaggctatctgtacggagaagtgcaaaggcacacagctaagatttgaaaaacctgtgtcctgggcttctacaggacctctgagttgtaacagcatcctccctgtcttgctggactgttaaagagaatcaaatgagataatagatgtgaagaaattttaaggccaggtgcggtggcttatgcctgtaatctcagcactttggcaggcccaggcaggaggaccacttgagcccatgagttcaacaagcctgggcaacataacggggccctatatctataaaaaaatttttttttaattagccaggtgtggtggccaatgcctgtggtcccagctacttggaaagctaaggtgtgaggatcgcttgagcccaggaggtcaaagctgcagtgagtcttgatcacaccagcgcactccagcctgggcaacagaagacacttttaaaacgtaaaaaacattatttcaatcaaaatattatgggctgggcatgatggctcatgtctgtaatcccagcactttgggaggccaaggcgggcggatcacttaaggccgggagttcaagactaacctgggcaacatggtgaaaccccttctctactgaaaatacaaaaattagcctggcgtggtggcacgtgcctgtaatcccagctgcttgagaggctgaggcatgagaatcccttgagcccgggaggaagaggttggagtgagccgagattgcgccactgcactccagcctgggtgacagagcgagactccatctcaaaaaataaaatattactataaagcagaagtttgtactatttccccaacaggaaccctactgtttataacattttattgatactgtttaggaatatatgaacccagttaaaaattaggtctattcctttctgaagccatgaacaagaatattttaatatcagctctcatttggatgcttttttgtgtttgtttgttttgttcgtttttgtttttgagatgaggtccactctgtcaccaggctggagtgcaatggcacagtctcggctgactgcaacctctgcctcctgggctcaagggattctggtgtctcagcttcctgagtagctggaactacaggcacatgccaccacacccgggtaatttttctttcttccccgcccccaccccgtagagacagggtttcaccacgttacccagactggtcttgaacaaatgatgcctcagcctcccaaagttcagggtttacaggcgtgagccaccgcgcttggtcatcatttggatgccttctgaccagaccaaaaagtgagtgtggccccccacgcatctggaaagaggaagcctgcagctggtttttctccattccaaaggctaattggcgtaattggtggagggtgcaagcccttggaattctctttagctgcccatcgtggacatctcacttgtaaacacctccaccagagggagggcaagggaaaggaaagggggccaaacttcagtcacgcggctacgtgttagtttcagtgagagatttggtgaaacaataggttttggggccattgtaactgaaaggagattgaaactaactggttgctatcttgatagttttctttatcctcaaatatcatggataagcaagagctaacagtaattctagctttgtttgctttgaaaggctattttcctccttagagtatagctaata

SEQ ID NO: 133 - DNA, 10995 bp, Homo sapiens
agcaaaatttaaaattcatgcagaaagtcagacactcaagagtggacttaggagaaacaatgatataaaacattgaattcttaagaaacttgagaatccttgaaaaaaattctactaatatgcattgagcacctattttggtttaggccactgggatttcaatagtaaatagggcagtcaagggctagaaacaggaaagagtgagggactgtgtgtcaggaaatgcttctttaaggaagttttttgttttgttttgtatttttgagatggagtctccctctggtgcccaggctgaagtgcagtggcacagtctcggctcactgcaacctctgcctcccagttgattctcctgcctcagcctcccaagtagctggaattacaggcatgcaccacagggtccagctaatttttgtatttttagtagagacggggggtggggggggggggtctcaccatgttggctaggttggtctcgaactcctgacctccagtgatccacctgacttggcctcccaaagtgctaggattacaggtgtgagccaccgcgctggccgagaaatacttttaattagtatcagatggatgagtacctgttagctaaattgagggctagggtaaggaaaagacaatgagactaggggcaggattgggatgaaaggagagaaatataatttcatagtcaagtggaaacattgttataatattacttcaaacttacatcataagttaagttatgatgtcacctgtttctcttggagaagcctattcaccttcattggaatgggaagctttctcaagaaatgtcagaggattcaaatatattcttgctttgttagttgagtcagtaccaatagtacacttgtgattagactgtcaaacaaaatccctgaagggatttcacactgttaaatgcttggtttttatttgtttttatttgttgggtttttttttttaaacggcatagatgtaaatttgtgaattacagaaaagaagcagttttaacatgaaatggacaaaattgatttctttctctgcttacagagcttaataagaatttcagtccataagcctttcaaatgaaacaatagaaactccaacaattcagagctaatgtaaatgaaaacggttatcttccaaatcacagcataataaagtaaccttgaatcattggtgttggccctatattgttatttatttgaattaaatggcaattttcagcattatgtaacagtgatggaattaagtgatgtttctagtaaaagaattttgcaagtataatatattttagtattaaattccacttgtacatttagcaattaaaattattcctgaaatgatgatggcatttgaagggatagggagctgtcaaagaggatttgaagcttaattatctctttggtaacaaaatgcataatcttccattacaacacttattttcttatggtaattgactcatttgttctctggttatcaatttaacttcccaaccacaaacatctgctcttacaattgtgtttaattggtgtgaatactatctacagagtagttaaaatccagaaaacattttaagggcattattttataattcatgaaagggaaactaatgattaattgaacattgcttatgatgattttttctaatagtctgtgaaagtctgtttactaaaaatgcataccgaaattatctgctcccccctcctttttttttttttttttttttggaagaggcttttgctgtgttttccagagtaattatttactctgccttagggggagcctcagttcttgcagttctttagactcaaggaatatgttaatgtcttggaacatggtaccttagtagttaagagtataggctttgaaggtagaaaaaaattagtatgctatcatttataatctaaataagaggattggggacaaattgtgggtgtgggtatgtgcttataattttcataatggaataataaatcataaatttaccagtagggtaaaggaggaaataggatgagagaaacagggttagaaggtaggtaggtttgtttgaatgtaccttgtctttatagatttaaaaatttacaaagtagttcctgaaactggaaagtaaaatgaaacaggcgactccaaaggtgtatccagttggtaatacagccacacagtaagttacaattctaagtatatggaattataattccatgtaaatttaaaattgtaattggactataatgtacctagtgggatttactctaaggacacaactgcaaaaaatctttggttgttttcttttatcatattgttggtacagatgtttattctgagactatgggtgtaggataaagtaaatgagtaattatgttagtgtcattgagaacagatttttggcttgagatacagatgtaaaattaagaagattcagctaaaagctacagtcttagacttaattgaaaatatcagtaggaaatcatgatgaagtttatatttaaaaaatacaaaattgctgactttgtccacaaaaagggtctcagagcaatgaccataaactgaagtccaatagagtcatgtgaaaaaggactcaggagctttcactgtgttcaggtttcctccattggtcaaatatgggatagtttaagaatcaaaagaataataacctgagtgaattgaaacaaaccaaatatatcttaaactaaaggctcttaatacttaaatgaaaaatcctcagcaattacctttgggagaggatattagaaaaccagctcactgttttgaaaacgtaagtgaagggaaaaagtcaagcatttattctgccccttttcgaagtacggtactttaggataaccagataattgtggggttatcctaataattgaaggaatatagtaataagtaatataagggatgtttctctttacagaatgagtgatagaataagagtattactattttgcaccgcctgatgggcaatgataaccaaaggctgttaacatcaccaaaagagagatagacacacatgatgaacctcctgatagatgcacatggaactgcctatgaagtagtctcgggggaaaaaaaaaaaactagcctgactccaatcagggttctacatttaactgtgagctttcagaaagaacatgttaaataccactatggcaatgtggtcagcaaaagacagattgcaggaaaaccttatattacaaatgacttggtttcttaaacaaatttcaaacaaaagataaagaggagtctgtagatggaaaaaaaaacctaagaaacaaattaacaccagtgaatgcaccttgtttgcccaatttgaataaagtagatcatttttaagaacatagaggccaggcgtagtggctcatgcctgtaaacctagcactttgggaggctaaggtaggaggatcgcttgagcccaggagtttgagactagcctgggcaacatagtgagacctcctctgtattaaaaaatcaaaaaattagctgggtgtggtggtgcgttcctgtagtctcagctacttgagcggctgaggcaggaggattacttgagtctgggaagtcgaggctgcagtgagccatgatcatgccactgcactccagtctgtgcaacagagtgagaacattggccagttagtgaaatgtgaataccgactgggtaataggtgatattaagaaactattattattattattattattattattattattattattattacttgagacagagtcttgttctgtcgcccaggctgaagtgccgtggcacaatcctggctcactgcaacctccacctcctgggttcaagcgattctccggtctcagcctcccgagtatctgggactacaggcatgagtcaccacgcctggctaatttttgtatttttaatagagacgggtttttgccaagttggccaggctagtcttgaactcctgacctcaggtgatcacctgcctcggccccactaagtgccaggattacaggcgtgagccaccatgcccggccaataaattattttagataccagcctgatgatggtatcatggttatgtttagaaatgagagttcttggcttatagaggtactcatttatatatgaaatagtgtaatacgtggagtttgctttcaaaataatatgtgtgtagggtagaggctgggaatggaatggattaaggcatagatgaatcagtattgaccatgacttgataattgttgaatcaacgtaataggtacataggatttattctattctcttaaataaaaagttttttaaaagaatataggttttggagtcagactgcctaggttcaaaatccagatctgtcactgactaagccttgtgctatggagttacttagcgtctctgtgtattagtgtccttgcctataaaatggaaataatataatattaactgcataatagaattgttctaggaactaaatggttataagtggaaagcgcttatgaatgttagctttgatgtgttcattatcacacatcaaagatatacgttaaagttataaatcattggctaaagatcttagtgtacttaggaatagtctagttgaattccttatttagtaacccaggagtttgaaacccacatttagcaaaatgtccagtggtagaaccagaactcaactttatgtctcttgactcctagtctttacaactgcttcacagtaaatcacttcaaagaatatccaagagtcaaaagacagaatttttacaaatttagttaaatgatataatggcttttaatagtaattcatgagtcaggcagcatctcatctaaagaacagataagcactacactgggcaggcagaacagttagtttttgtagggaaacttgagcaggaacaaagaaacagtggattggttaacattagttgcttcagattactttcattgtaagggtcaaagcagaggggactttcttatgttggctaaaactgtcccatttggggatttgacacacacactctcctgatttctcagaaggtcagataaataacttaggtttagtttggtgatatgcaactttggcacgagtgactgcattttggttcagtctgtttggtttgatctgtagagtagaagctcaatccatattagtagtctcccataaattttatttaacacaagtaagcttaagtaaccttgttctaaatagaaagactcacagttgcaaacatcttcagttttcctgtatctaaaatgtattgcagttcaaatgaagactccaagttcttgtttgtctgtttgctttgagaaggaacagacaaacttaacataagatgagtctaaatttatctggggagtggaacactaaacaaacatgttagaaaaattttgaggaaataaaggaagaatatttgttccaccatatattataacatattgcatagttataataattttatggttctggcccaggaataggcagatggatgaaaccaattagtgtcctgaaataaacccccaagagtacgtagattttagtattaaatctttcaaatctgtcattctttttgggatgactgatcttgccagatatatgtaaagctggatacttagtaagtctagtttgtttcgtagaaatattagaagaaaatacaagtgaatgttgttatagtacagaagaagggaaagcctttggagtaaaaatagtgaaatacagatgctaaaatggagagaacttataaattttaccatatgcaaacgtaaaactttgttacaatagatgccttaagttaaagacagaagaggaaacaaatattggcagcatgtatagcttactgtattagtcagggcccagttaggagccagaaactatactaggcatttgaacagagcaaatttaatataaagaattattaatggccggtcgcggtggctcatgcctgtaatcccagcactttgggaggccgaggcaggtggatcacctgaggtcaggagttcgagaccagcctggccaacatggtgaaaccctgtctctactaaaaatacaaaaattagccggacgtggtggtgcacgtctgtaatcccggctacttgagaggctgaggtacaagaatcgcttgaacctgtgaggcgaagattgcagtgagccgagatcacgccattgcactccagtctgggcaatagagcgagactccatctcaaaaaaaaaaaagaattattaactattaaaatctacttactaaaaagggcaaaataggacattaaagaatacaaaaatagtaaatatagggattagctatgactacctcttgagctgagggagagaatccaaaaatcaggaagactgttgttcagaccttgttgaagaaagtgtagctgctgccaaaggacatagctatgggccaaagctggggcacaggaaatcccctgctgggaggcctcagagctggtgtgcagaaaacacctgctggggtgctgtgggctggacagatgataagccgaaaattgcccactgggatgacatgagttggagctggtgtacaggaccctatccaatgggatgcagtgtgtcagagctggtgcacagaaagccccatgctggagtaagctagagaaacttacaggagggtgatcattattgggtctttcacaatcagcctcaccataggagcaaaaagaagagcatcctccaaactgaaaattaagcccatcactctgctttgctgtgcaacaaagcaccagctgacaaaagtccatatccactactgcaaagaaggacagatttggagctgagagccttgaaataataactctcattataccaaaagctcttatatatagataagaaaattataaacactctaattggaaaaacggcagcatatttatatacataattcacaaaagaataaatacaaaaggcttgtcattgtttgaaaggatcaagtcaaatttgctattaatagatttccctgatttcatcttgttgtacagatttatgttttctggatcttccatcactgtgaatgtatgttgtttcctaagattatacatgatttccctccttgggggaggttctgcttgactggggttctatctcctttttgtactgttgttcttcatttacctaagttatgtagctagtttagatttctcttcagggcctgctctagacagtgcaataggccaaaaaagttcttttttaaaaaaggaaagggagattggaaaggcataaataaatctgtctctactcacatacaagcatgattgtctatgtagataatccccaaactgtatttacagaggctgatacagctaatgagataatttaggatggccacaggataaaaggttaatacacataaatcaatttcattcctacatactagcagagaacaactggaaattttaaaaaatttaaagtaccacttagaatagcatcaaaagtatttgaaatacctaggtatttatctaacagagcatgaatgagatttgcttactgaaatctgtaaaacatttatgaaagaaatcagacttaaatagagagataaacctgtgttcagggaaaagaagacaatatttttaagacgtcaagttgccacaaattcaacacaatcccaatcaaaatcccagcaggctgggcagatgttaggtcaactgtaaataaagctgctgtcgttgccattgttgttgttatttcatagaactagcctgcagtggagcttgctgctttgtgatgtagggagttcctgtcattcacacttttcaaatacagatcgctaagaccctttgtcaaggatgtcatataggaaattatatcattaggtaggatgctggactagatctacttcaacccttctaattaaaaatattatgatctattatttgtaagttagcaatttacagctgtggggcatgtggaaagggagctactggaatattcagactttttcaaatgtacttatcctttccccgtcaccctgtaaaaccattgcatataatgagggatcttagtaataggagtgtgttgcatgagtgagctgtttaaggactctaatgtgacgtttattttactttgttgttgttgttcttacttatcaagctgactgaaaaggaaagttttatcaatcttttccactctttgaattctaattatagctcttaaaaaatggtataaatcttagggaagtattctttaatatttatttttagacatttttaatttctccaatatagtcaacttagtaaatagttccaaataaggaaactcagaaattatctttaaaacagttagttgtaccagcaaatcattttttaaagataattgtattcctaacatgtattttttattatatatttattttatgcttttgcaaaaatatgtgaaagcttcaaataatgagtaaaaatcctgtggattttatgatttaaaaattggttgaaatatgaatagctgcctagttctattttcattaatgtcttaatttcctttttattttaaagctcaacctgaattcctgaagcagcctactaatatatatgctcacgaatctatggatattgtatttgaatgtgaagtgactggaaaaccaactccaactgtgaagtgggtcaaaaatggggatatggttatcccaagtgattattttaagattgtagtaagtatttttcaaagaagtgtgtttatttctgtaacctttagatatttttaaatgtagtcaccgagagatcagttatcttatatatactagtttgtgtactgcaaatgaaatagaagaattcacatagaatgtaataccttcattggctgatgagaaagctgagcccagaaatactttggtagcttatgtaagatcacatagcaagtcagtggcttacctaagcctagagtctagactcttacttgaacacactggcactctgaaacacagctgccaccattttctggcagatgattagcacacatgtgtgtgcgtgtatgtgtgtccccagttgtcttcacagctctctgttcaagaagcagaaatctttccacacttctccttgaagtgtggaaagatgatccttttgaaaaacataatatgtaagaatgcaactgactatacaaaacttaaccttaaatcgtataccgatgcccagacccttcaaaataaggatgacccagtgtcggacaattgtggtagcaatagttataaagattcttttttaaaaatgcatttaaaaagtgtcaagtgtatttaagaatactcagccataattgctttttactatactttatatatagtaaatgattcttagatattacctactattatcatcaatatctaacattttagtaatagaattatccagctttagtaataaagattaatgacataccttgagatctatacatgacattcataaaaatgatcagaactatagttgttaaagacataatgtctcattacaaatttgtcatacaagtaaacattcttagaaatatattttctatttttgaaatgcatgatctcctgttgcaaaaagtaatttacaagtatttaacattaaaaagcaatctgttatagttaaaatagcctcttaaaatcaatatttggaaactagaaaatttttaaatcatatttattataccaataacagtagttaaaaattttttttgttttttaagacagggtctcgctgtgtcaccctggctggagtgcagtggtttgatcatagctcaccacagcctcaaactcctgggcttaagcgatcctcctgccaacctgagtagctggaactacaggcacgcactaccatgaccagccaattttgtattttttgtagagatggggtttcactgtgttgctcagtctggtcttcagcgcctgggctcaagtgatactcctgcctcggcctcccaaagtgctggggttacaggtgtgagccactgctcctggcccagtagtaatagttgacattcatatagtactttttcatttaaggaaagctcacatggcttcatttaatttattgtagtctaatctgttagaactattgatattatagatagtcttaggaaaaataataccttaaattcacaaattggactttaactgtggtcagttggtattgcgtgccagatctttttccaggcaaaggtgtagtttgcaaacagtgagagtatgactttccatgcgttaagttcttcatcgtgaatgacagtatgtactcttctattcagttaaattggtaccttgccaatgctttagtatgaaattgagttaacaagtacttggataatatttaataattggatcataaaaactttacttgtttttttcctctccaaaaagcatatttttgagattttgatctggtatttatcaattaaattatgtaattttatttatgcttttcttcttcagaaggaacataatcttcaagttttgggtctggtgaaatcagatgaagggttctatcagtgcattgctgaaaatgatgttggaaatgcacaagctggagcccaactgataatccttgaacatggtaagaagggctgaaatagtcagatgatagaggctgtgtgcttgatgaacaagcacccatccgtccaaataactcatgattgataacccattagtaaaggccaatatgtggcatagctaagagaaaaagaatagcagtctaaatcatttctattacataaaattacctagaagcacaattttggataatgttgaaaagaaatttttactaagaaaaggaaaactgaatattatagtcttaataaattaatttttaaaagaatttagtcatcttaatctcacaaatatatttctgtcctataaagaaaaacttcttttttttccaattctatacacttttattaatacacttacaaaaaataacattcaaacactgagaaaactaaataactttggaagcagagctcattgttttctgcttacatataagtgacaattctgggctgttggcacaaaatagtcaacattcataaaaccctgactactatatatcaaacataagttaaaatcata

SEQ ID NO: 134 - DNA, 12783 bp, Homo sapiens
gcataacaggacacattaggtagaagaacagaaagattacaggactagattcagagtgaaaaacaaagaaaacaagtcacttactaaagtgtgctccatcaacagggatgaagagtttgtgggcctgaagcttattcagttttggaggccctcttcaaaataaaaaattaaagagaattaggccccgggcctcaaaggggcccatgcaagtgagatgtcctgaggtttaagcttcctcagctgcaatggtaaatctactgttgggggcagttcaacttactgcctggagggattttttgctatatgtagtctcttaagttgcattctcctgtcactgtttctccaaaagaagtaagtgaaagaatttttgttttgcctcaaactaccttttatttgcaactacatgatttcatgcaattcttctaaacaacgacataaaatagatttccttgtttataaataacttaaatatgccccatatagtacatgctgaaagttgctagaacagttcatccactcctatagtattctggtatccaacagagttgatgcacatatataaatgccaagtccaatattaaaaactcaggcaactgactaactttaataaagtttcccaaactatgtcaatatacctaaaaatgcgtatatgtacaaaagaaagattattctcaataacttctataaaaataaattcaattgtttgttccatctaacttcactactattagtatgaatttttagtgtatggtaagatttattttacctttttctcaacatgacaccaacacagtcaaaaggagctagtgaggtgctaacatgcgagaattaacccagtgattctggtcacaatgcatttcaggtagaggtacctatgtcactgggattgggtgatatggtttattttcattccctgatttagataaccaaatggatcagatagagattctgatgggcattccttcaaaagaattttttaagaagcagaaataaaggagaaggccactgcctagctttactagagagaatgccacatcttagctgtgggtctcataatctgcagggttagcgcacagacctcagatgttgctgtttacaattcattctcggattggcaggtgtttgttgttccttgaagctagaggcactgggctcactaatcgttctgagaaaagaagctaatccaagatcttaccaattcagcatacttcttgaataaaaaatcaaacttttcttccggtgtttgcaacttgttcagattttgcattagcaggttggcttctttgccttaaaaaaaaaagacatgaaaaaaataagtgttgaatttacagtcaggtgataagggctggagtctcagattgaccacttgctaattattcccaaccttggctaagccattcatcttatcagatgtaattttctttcctatagaaatgatgacacctaccttacagagtgaacattagttgggaagtttgtgaatgtgtggtacggtgtgaggttcatggcagactctcaataaatgtttgctataacagaagtctcccagttttcatcacaagaatccgttcttatttctcctccctgtattcttcagaatcaaaagattttatacatcaaaaatactttctgaaagaatacgtcacccgttttcccacttgaattaacaaaaaggaagcaaaacagccaatcaaaatttccgactagtatgaaacagcaacacggagttgctgggattccagccagaagcagagaagcttgatgaagtagcctgcccgttttttcccctgtgttttttgttcttttggtacttcttttccctcttttagggggaaccaagtttctcttttttgtacataaacccattccctggcgttggagtgggaataactctgatcctgtttcctaccaaatagaataaaatcattatagaaggaaaaccaagtaaagacatggagagcctttccacaagcctttttctgtctctgtgataatggacacagccttctctggccttcctttcccccacctaggccttaatatccgttggcagtttcattttgtttccagttggagtttatgctacactaaaaaaaaattaaccctgttaaataatcatgaaagggtggggcatttttcccatccctacctatctatgaaaaccactctgtttaatcagaatagggtggtcaagccacacaacaaagcccacacttcctgacataaatctgcttaagaaaattgacaacctttcccccaagaacagacatttccccttggctagagtacttgctttcatcttggagaggcatatatgtcatgaaattaggattgccagatgaaatataggacatggggcatatttgtactaaaaaatgattcgttgtttacctgaaattctaatttttctggacatcctgtattttcctttgctaaacctggcaactttacatggaatcaaggaattttaggtctagaaggaatttcaaagagcatccagactaaccggttaattttatgcattttagtatttaaggcccagaaaagtccaaagttacatgattagtgctggcagagagaaggcttgaatccaaggctagcctacttgttctaagtcactccactctcatgtggaattctgatgctagagagacctagagaaatagaaggcaactttttttttaaatgacctcattcccaacagttagttttgtctatctttgcctagtgagtcagttcagattagcctaaaacaggggaaggtgggtgtgagtagggtccctcccagctctccaattatggcctgtggcatttgcagctgataatcactgacgcctcgcccctgccaggcatgtgctttgggttatccctctactgacagggatggatttgcattggtcaggccatcccttcacctttgtcttcagtccagggaaggtgcccacatgaagactacaatctcaagttagagtgtcatctattaaagtcaagagactactcttgatcattcttggcccaggatgcaacacagtgtttggcccatggcaagtgctcagtaaatgatgataataatagaataaaacaaagctggccaggcacggtggctcacgcctgtaatcccaacactttgggaggctaaggcgggcggatcacgaggtcaggagatcaagaccatcctggccaacatggtgaaaccccatctctactaaaatacaaaaacttagctaggcttggtggtacatgcctgtagtcccagctactcgggaggctgaggcaggggaatcacttgaacccaggaggcagagattgcagtgagctgagattgcaccactgcactccactgcaaaaaacaaacgaacaaataaaaaaatcaaagccaactagctcaaactcgtatcatgtgaatcaaataaacactgtcatgaaaacaattttttgtgaccaactagaggaaaaacaggtcttactctcacctgtgatgttttatgtatcctggaatacctctcagtgtgtgtaccgacatgtgaaaccattacctgtcttgtttgggagagatagaaatgagtgagtccaaaggttcttgctttcttcccacattaagtatcttctcccctttggttttattttctgtgactgtgagaagaggtttctttttggttttgtttgttttgttttttactcttcacactcactgaggtctctttctgctctactgtgttattttgtatagaaggttaacatccaggtgcatcaatatgccttcaaaaattattcttcccttcaacaaaaaatccaggaaacagaatttctatttgtaagtctcacaggaaaagcactaaaactggagattaattaaaaaaaatccaggaaactggagatgggcatgtgcagaattcataaatttacaacatcactgacctcagtttttaaacttccattggtgttgtgggactagggtgctatgtgaagtaatcatggaggaggggagtagacagagacttgctcatcatctacaaaaggctatcattacatctccatggaaatagggtcatttggtgacagtgtcaaacaaaagaggaaaaactgactttattcagggacgctttatcaggaaggaatcacctgccttctccctaatgtgttcttccaaagcaagcttcatttcttcctcatgaaagctaggaaggcatgtgggcatgtagccaccacactgcgaaatgctcagcgtggtaggaagtctacatgaaagtggaaccacctgtgtagcagacacagcgctgttgcataaggctgtggtcactggcacagttttattggaaggtggagaaattatttttacatcaaagaaacaaaaaaactggccgagcgtggtggctcatgcttgccgaggcgggcagatcacgaggtcaggagatcgagaccatcctggccaacgtggtgaaaccctgcctcttctaaaaatacaaaaattagctggtgtcgtggcacatgcctgtaatcccagctactctggaggctgaggcaggagaatcgcttgaaccagggaggcagaaattgcagtgagccgagactgtaccactgcactccggcctggcaacagagcaagactctctctctaaaaaaaaaaaaaaaaaaaaaaaagaaagaaagaaagaaacaaaaaacctgaaattaaaggcaactaagccagctgcagaaatgtggaccaggatttttctgaaacttttagcatagtaatgattgtttatactaagtttggtgacaacttatgcagatttaatgtgttcaaatcaccagaggtcgggagaaccagcctggccaatacatagtaaaaccgcgtctctactaaaaaatacaaaaattagctgggcgtggtggcgcacgcctgtagtcccagctacttgggaaactgagcaggagactcgcttgaacctgagaggcagaggttgcagtgagctgagattggccactccactccagcctgggggacagagcgagactccatctctcaaaaacaaaagtatgccttttctcttccaaaattttttttttagaactttggggttaaatttcattataaatacgtacttgtgtacctctctaaccaccttcctgatttccatgaattgtggcagaaacttaaagccagaaaagactgtgaatgtccctctttcaaatgttagacctagatttatatttcactgttagttttgtttttcttctaataggatatgatttctaaaaataagcatgagataaataattcctgagcatctatagatatcttttaagggaagtaaaattcatgtatgcaggggataggaaggaaagtattattaaattcacactggattaaggataggagacctgggttccagaaccaactctgccatcaactagttgagtgatttatttatttatttttttatttttttatttttattattttgtgtgtgtgtggactctcaaactctctggctttaatttccctgtctataaaattagtgggttgactaaatggattctgagttcaacctttaagatttggtcatttcacaactaaaatagctttcaccatttttagcttgatttagataacaatgaaaacaaaagcaacattgtttggatggcatatttgttatcttagactattatggtccacttttttaatttacaaaggttctcttactcctcactgtcaccactcattgtcagggttttcatttgcttgtttcgtttggttttaaggcctgtatcagcttcgaaaataccacctagcctgtgttttcttgtcagattttgttccctttggctgacattttctatctcttatctttcagtggccttgtcatatttgtaggggaactttggcctctcactcagtaggagagtggatctggagttctttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacgggttttcaccgtgttagccaggatggtctcgatctcctgacctcgtgatccgcccgcctcggcctcccaaagtgctgggattccaggcgtgagccaccgcgcccggccctggagttcttattaggtcaacagtgatgatgtgtatacactattaccaataacaaaaataaaaatattagaaaaaacagtaaaatattcatccatccactccctaccttggtcagaagagagtactaataattttcctcaaggcttttctctccccttccatctgcttctgtaaactctcctccctgtcaaggtctggtctaggttctagcttctctatgaatctacctgtcaagctttgtctctgcttattcctctttcccttgaatttctctggtcttcttatcatctccttcagaaaatttagtctccttcagaaaataccatctccttcagaaaatatcaaagctgcagtttattactctctcagagaaactagaaatcaagctaaaacagatgaaacagactatctgggagagtgaccggaccgttcaaaggaagactaggggccgggcgcggtggctcacgtctgcaatcccagcactttgggagggtgaggtgggcagatcacttgaggtcacaagttcgagaccagtctggccaacacagtgaaaccccgtctctactaaaaatataaaaattggccatgcatggtggcacgtggctgtaatcctagctacatgggagactgaggcagtagaatcgcttgaacctgggaggtggaagttgcagtgagctgagatcgcaccactgtactccagcctgggcaacagagtgagactttgtctcaaaaaataaaggaagactatgtaaatggatgtctgaagacatttcagaatactgatgtcctagtcaggagcctctcagaaggtaccactgaagctcacttgtaactagaaagacaaaattcattaactgaggtgtaataaatgctccttaaccaatatgatgcttgcttctgtaccactttggtcctgcgatgtcagtgacacaaagtccatcccttgctttatgactaatctcacaatcacatcaactagatgagtaacattttttggtggattctgaaactccctaggcttcaatttccctgtctataaaattagtaggttgactagatggattctgagctcagaatagccctgtgaatgagctttgtttttctcccagcccacataatgttgtcaaagaagtgataaatgagagatacctctgagcctggaggatgcgagtaggagaacaaaggggatactttagatgtgaacttggcatggtgccgcataatgggaaatctgttttcatttctttcatttcagatgccaaggggaaagtgactttacccacgagagagatttttaaatattcccccaactgctccggtaagtactgcgtttattgtaggagaaagtgcagcctcaaaaggaaaaagaagtcctgggagcttaggttgtagagacatttcccaaatattcaaggtgttctgtaaaaaaaaaaaaaaaaaagccttggccaggcgtggtggttcatgcctgtaatcccagcactttgggagaccgacgcaggcggatcacctgaggtcgggagttcaagaccagcctgaccaacatggagaaatcctgtctctactaaaaatacaaaattagccgggagtggtggcacatgcctgtaatcccagctacttgggaggctgaggcaggagaatcgattgaacccggagggcggaggttgtggtgagccgagatcgcaccattgcactccagcctgggcaatgagagcgaaactccgtctcaaaaaaaaaaaaaaaaaatgtctctcatagatccaatcagtcaataagttttggaaatgatggaaactatgcccatcactattttagatcttcattgtgtatacagtaaaggtcagagaattctggcagtaaagaaactgtttaactttgtgaaatctcaagcatcccaaagtagacacactttggaaaatgttgtagtagagagtcaaaacattttagcatctcaaatgtgccaataaagcaaatagcatctaataaatacaatgattaaagacatctttgatcaagtacataagcaaaatctaagaatatatcttcagatatgggttgaatgacttattaaaattctctaagaggtccaaataggttataaaaggagaccacagccagatgtttatattttctccaaaagagcagagaaaacactttctgaagaatcagaaccattgcttccacaatctgtgtcaaaattacccagggtgaacatctcccatgctcgcctaaaaattttcctgttcctgctcttgcacttacactatatgacaattagcttatgtgtcttcttcttcctctctacctagagatccttgactaaaggccatgacttatttatctttgcgcacctagcacagtgcatcataaagactaggcattaataaatactcattgtgggccgggtgcggtggctcacggctgtaatcccagcactttgggaggccgaggcgggtggatcatgaggtcaggagatcgagaccatcctggccaacacaatgaaaccccgtctctactaaaaatacaaaaattagctgggcatggtggcacatgcctgtaatcccagctactcgagaggctgaggcaggagaatcgcttgaactagggagctggaggttgtagtgagccgaaatcgcgccactgcactccagcctggcaacagagtgagactctgtctcaaagaaaaaaagtaaataaataaaaataaataaataagtactcattgaggacgtgaggataggtagaaatttctaggcaaagaaactagaatgtgcacaggccttgtgggagatggcgtatagcatgttcaaagaactgagaaactagatcatgcttcactccaggcctacaaactccaaatatctgtgtgtgggggctcaggaggagcatttttcacaaattttgcaattgattctaataaacagttaagttggaaaaccattagtctagacgatagcacagtaccatttaactgaaaagtagctaagaaggctgccaaagctacttgcaaacaactgaaagtttaaaatggtggttacaagttgaggttagcctaaaaatgttgttttcatgcataatgtagctgttaaatagtacagtgtttaaaataatatgctaatgatgatgagtgggaaggcacagaaaggtcatgagcccacacatactcaattagagtggacacacctaggtactctaatccacaagcattgattttggtcaaacacagtcagttggaatttggtatcgtaaatagcggcagaattagggagttggaatttttaaaaacatcatcctgactatttggtaattgtaaggttaatgcagattatgaaataactcatggaagagagtagaaacccaaattggttattttaactttatccctattttcttcatatctttcccctcaacacacacacacacacacacacacacacacacacacacacacacacaccccaattcttatgtaaaagttttagggtgattgaaaaataacttttctggttaggaacacttgaagttgcttacctctggaatgagattttgtatattgtcttacggaaacttgaataatgactaactttgcaaagggacacatttgagatgttttgtcagagaagaaaaaattgctctgtaacacagagcaattttattatgtttttccatgttccaaaacactagagtgattccaaccctgcactttggaacttgaagatacttaaaagttattatctgagttcttttaattttatcctagttgggtgaagtatgctacctgaatgtattatttaggccttcttgaaagcattgtagcaatgggttttagcatcatagcgatatctgtaggaaaatagccccttgcatggcaagagtgatgccatcgtaaagcaaacctgccatgatgaccaatgtttgactcctccataccaaggtgttctgcagcagatatctccaaccctcaggccacggactggtaccagtcattgtgggctgcataatgggaaatctgttttcatttctttcatttcagatgccaaggggaaagtgactttacccacgagagagattttacccacgagaggcctctatcagtttcgaaaataccacctagcctgtgttttcttgtcagattttgttccctttggcttacattttctatttcttatctttcagtggccttgtcatatttgtaggggaactttggcctctcactcagtaggagagtggatctggagttcttattaggtcaacagtgatgatgtgtatacactattaccaataacaaaaataaaaatattagaaaaaacagtaaaatattcatccatccactccctaccttggtcagaagagagtactaataattttcctcaaggtttttctctccccttccatctgcttctgtaaactctcctccctgtcaaggtctggtctaggttctagcttctctatgaatctacctgtcaagctttgtctctgcttattcctctttcccttgaatttctctggtcttcttatcatctccttcagaaaatttagtctccttcagaaaataccatctccttcagaaaatatcaaagctgcagtttattactctctcagagaaactagaaatcaagctaaaacagatgaaacagactatctgggagagtgaccggaccgttcaaaggaagactaggggccgggcgcagtggctcacgtctgcaatcccagcactttgggagggtgaggtaccagtccgtggcctgttaggaactgggctgcacggcaggagatgagtggcaggcgacagagcaaaacttcatctgtatttgcagctgctccccatcactcacattaccacctgagctccacctcctgtcaggtcaacggtggcattagattctcataggagcgtgaaccctattgtgaactgcacatgcaagggatgtaggttgcatgctccctgtgagaatctaatgcctgatgatctgtcactgtctcctgtcacccccagatgggaccgtctagttacaggaaaacaagctcaaggctcccactgattctacattacggtgagttgtataatcatttcattatatcttacaatgtaataataatagaaataaggtgcacaataaatgtaatgcacttgaatcatcccgaaactatccctccccagtccatggaaaaactgtcttccctggtgccaaaaaggttgacggctgttctgcagcaaggtctttaaacaatgcctgtgacatagacaatccctcagaaagatgcttatctaacgttcccagtggtcatgacttttggcaagaaagttggagatgtgaccagctgcacatgactttacctaaaagcttgctatgtaaaggacactttctggagagtgggtgtaggaattcactgtctcactgctgcccaagacagcactactgtttgtaagcccctattaaatatttctttctgagaaagtggatttgtcagcctctgtttttggccttcagctcccttggcctttgtgggtaggtttgtatatacctgctcactgcagaaaaatattctactccagtttgtgatatatttgggtttacagatagtctggttactggagtttgaacccagttctgactccaatgctcatgatctttcactctaccacatagtcttccagaaacaaatcatatgtggtctctgcccttgatagattctccatctagcatgagagatgggtatataaacaaatgattgctgcagaaaatttaatagaaaactaaggaaggtgatgctaactctacctgggcatgtcagggaaagtatcacataggagggagtattcgtagtgagtgtttccaccaggaaagacaagcagagggactttcctatgtacagtaacatgcttcactcatagttttaaaaattaacgttctcacccttttttcccagccatcgttggtgtcaccaatctcccatgctctcctaaaaaattttccttttcccgtttttgcacttctcctatataattaatttacatgtcttctgttttctctatacttacagctccttgaccaaaagaccatgatttatttatctttgtgcacctagcacagtgccttacaaagactaggcattaataaacactcattgggcacctgaagataggtacagatttctaggtaaagaaactaggatgtgcacaggccttgtgggcgatggagcatagcatgttcaaaggcctgaaagacaagatcagaatgactagctattaggcagtagtggtggtggtggtaatagaggcagagtgttcaggaaggtgatgttgtagggtagagtaatctgagataaaactgggactggttggagttagaccattaggatcttagagaacatgttaaagattttggtcttcatcctaagagcagtaggaggccacggaacaaagggtcaatgggtaacacactgaaaagttcacctgagctccattgaggggtaagggctggggacaaatacaacaagggaaaatatagaaggctactacagtcatccaaatattggatgtggcttttagtgaagtttggaagaag

SEQ ID NO: 135 - DNA, 12853 bp, Homo sapiens
agtatagatgtgagcctttaattttgcaccatagttattagataggcgtgaaatttcttgtacatatatttggatttaaaatgactattgtcctttcttgaaatttatatattgtaggccaggcacggtggctcatgcctgtaatcccagcactctgggaggctgaggcaggcggatcacctgaagtcaggagatggagaccagcctggccaacatggtgaaacctcatctctactaaaaatacaaaaattagctgagcctaggggcgggtgcctgtaattccagctacttgggaggctgaggcaggagaatcacttgagcctgggaggcggaggttgcagtgagttgagatcgtgccattgcactccagcctgggtgacaagagcaagactccatctcaaaaaaaaagaaaaaagaaaaagaaaagaaatttatatattgttattattattgccattctggcgtagactttaccttctgaagattaaaccatatgtcagggcttctgaaccccagcacaagtaacatactgggccagataattttttgttgttggggctgtcctatgccttgtaagttgctcaacaccatccctagcccctacctgctatatgccagtagcactgcccaattgcgacaccccaaaatatctccagacagacatgcctattgtcgcctggtgaacaaaactgtccctgtttagggaactctgcactatgtggctttatctgagtgtcaggaggaagacaccctacaggtgtttcataaattggaaagagaaatgatttgtgcttgctcattttccatttaatgttttatttttatttttaattttaattttttagagacagcgtcttgctcagtcatccaggctggagtgcagtggcacaatcattcatagttcactgaagcctcaaacgcctagctccagccatcctcctgcctcagcctcctgagtagctgggacaacagttgtgtgccaccatgcccagctaatttttttgtagagatgggttcttgccatattgtccaggctagtcttgaactcctgagctcaagcaatctgcctgccttggcctcccagagtgctgggattacaggcatgggccactgtgcttggcctattttgtttctaatattaagccagataatactccagaactttcctttatatttaaaaaaatttaaattattaacaaagtaattcagccaatattcaagtgattcttggcattgaagacaatgaaaaatacacattccctgccctctaggttcttactgcctagcttcaatcaaatgctggctttgtgatttaacttaggcatagttcttctgtacaactgtaataggcatatagaatttctgtctgtaatttctcttgttttctttctctttttttactaagttaaaaagtaaaattaatgctaagtactaaattaaaatcctattactgatgttgtcttaactacataagaattgaggaaattaaatgtgaaaaatatttctcccaggccatttcctaatttagtcatgaaatgtccttacttattaatgagcttatctttatttattaatgaatacaatgtcagataatattacaggatttagactctgcaaggatgagtgagctagagtggcagtttgattcacagctttgaatttgatgatttattctatgtgaacacttatatttcagtcattttctatattaatatccaaatcagtgagcaaggaaataggctttagtctccacgtaaaaaattgaaattcctcataatttttcttttctgaaaaggaaatgtgataagttttttgggttaatcttctcctattcattttttctaaggtgatctctcaggttcgaaagttttttacgagagatgatacaaatgccaaaatatagcaagtaaggcttgaattgaatatggtctctggaaaaacaatctcttgtttattgggggtgactgctttgctaggaggatgagtaggtacagggagttccctgagaccaggatgaacaaccctggctcatggagaaaatatcggtaagtctggaaaagtgatgcttccccagtgcactgtcgtgggaatgtaacaccacacatcacttcctgtattagtctagaatgctgcccagtcccctcaagtatagaacatggcgctggaaactaaacatgaatggccttggtatgagttggtaaatcgaaggggtaaaggaaaaatgactcagaaaatactaaaaagagcaaggatggataggtgagaatcgcatggaaacgtgagagtgggggccagatttggggagaaaatattatttttgacacctaaattatttttatggtattgaaattgttaatagccaatgcaatacaagttgcaagaaaattgatacactgatacttgctttgtgagtttctactgctcttttggaaagcaatatggccataaagtttaaaaaccagaaagcactcatcttgtttaatttagtaagcctatttctggaaatttttcttaaaatcataaaaaagaaggaaaaagaacaaagctaatacgtgatgatgttcaatgcagaaatatttggtaaagcaaaacagtgagaggaatttaaatatattcaaattattgaatcagtagatacagccacttaatggaatatgacacaacttttacaaaatatatttgtgaagactatatattatatggaaaaatgcctgtcacgtaagaaaaccagatatcaacttatatgtaccttatgactgtaattataataaaaatctgcatacacagtagaacaggaaaagaatatgcatagaacaaagtttgtattttacatgagggattagagattttttgtttattttgtgtattcagcattatatatcttcgtgaagtagtttgtgtgtctaaaaaataatttaaaaatactgttggcagggttaagcaaacagccagtcacgcagagtttcagaatttttctggatctactgcataatagttcagcataacaggacacattaggtagaagaacagaaagattacaggactagattcagagtgaaaaacaaagaaaacaagtcacttactaaagtgtgctccatcaacagggatgaagagtttgtgggcctgaagcttattcagttttggaggccctcttcaaaataaaaaattaaagagaattaggccccgggcctcaaaggggcccatgcaagtgagatgtcctgaggtttaagcttcctcagctgcaatggtaaatctactgttgggggcagttcaacttactgcctggagggattttttgctatatgtagtctcttaagttgcattctcctgtcactgtttctccaaaagaagtaagtgaaagaatttttgttttgcctcaaactaccttttatttgcaactacatgatttcatgcaattcttctaaacaacgacataaaatagatttccttgtttataaataacttaaatatgccccatatagtacatgctgaaagttgctagaacagttcatccactcctatagtattctggtatccaacagagttgatgcacatatataaatgccaagtccaatattaaaaactcaggcaactgactaactttaataaagtttcccaaactatgtcaatatacctaaaaatgcgtatatgtacaaaagaaagattattctcaataacttctataaaaataaattcaattgtttgttccatctaacttcactactattagtatgaatttttagtgtatggtaagatttattttacctttttctcaacatgacaccaacacagtcaaaaggagctagtgaggtgctaacatgcgagaattaacccagtgattctggtcacaatgcatttcaggtagaggtacctatgtcactgggattgggtgatatggtttattttcattccctgatttagataaccaaatggatcagatagagattctgatgggcattccttcaaaagaattttttaagaagcagaaataaaggagaaggccactgcctagctttactagagagaatgccacatcttagctgtgggtctcataatctgcagggttagcgcacagacctcagatgttgctgtttacaattcattctcggattggcaggtgtttgttgttccttgaagctagaggcactgggctcactaatcgttctgagaaaagaagctaatccaagatcttaccaattcagcatacttcttgaataaaaaatcaaacttttcttccggtgtttgcaacttgttcagattttgcattagcaggttggcttctttgccttaaaaaaaaaagacatgaaaaaaataagtgttgaatttacagtcaggtgataagggctggagtctcagattgaccacttgctaattattcccaaccttggctaagccattcatcttatcagatgtaattttctttcctatagaaatgatgacacctaccttacagagtgaacattagttgggaagtttgtgaatgtgtggtacggtgtgaggttcatggcagactctcaataaatgtttgctataacagaagtctcccagttttcatcacaagaatccgttcttatttctcctccctgtattcttcagaatcaaaagattttatacatcaaaaatactttctgaaagaatacgtcacccgttttcccacttgaattaacaaaaaggaagcaaaacagccaatcaaaatttccgactagtatgaaacagcaacacggagttgctgggattccagccagaagcagagaagcttgatgaagtagcctgcccgttttttcccctgtgttttttgttcttttggtacttcttttccctcttttagggggaaccaagtttctcttttttgtacataaacccattccctggcgttggagtgggaataactctgatcctgtttcctaccaaatagaataaaatcattatagaaggaaaaccaagtaaagacatggagagcctttccacaagcctttttctgtctctgtgataatggacacagccttctctggccttcctttcccccacctaggccttaatatccgttggcagtttcattttgtttccagttggagtttatgctacactaaaaaaaaattaaccctgttaaataatcatgaaagggtggggcatttttcccatccctacctatctatgaaaaccactctgtttaatcagaatagggtggtcaagccacacaacaaagcccacacttcctgacataaatctgcttaagaaaattgacaacctttcccccaagaacagacatttccccttggctagagtacttgctttcatcttggagaggcatatatgtcatgaaattaggattgccagatgaaatataggacatggggcatatttgtactaaaaaatgattcgttgtttacctgaaattctaatttttctggacatcctgtattttcctttgctaaacctggcaactttacatggaatcaaggaattttaggtctagaaggaatttcaaagagcatccagactaaccggttaattttatgcattttagtatttaaggcccagaaaagtccaaagttacatgattagtgctggcagagagaaggcttgaatccaaggctagcctacttgttctaagtcactccactctcatgtggaattctgatgctagagagacctagagaaatagaaggcaactttttttttaaatgacctcattcccaacagttagttttgtctatctttgcctagtgagtcagttcagattagcctaaaacaggggaaggtgggtgtgagtagggtccctcccagctctccaattatggcctgtggcatttgcagctgataatcactgacgcctcgcccctgccaggcatgtgctttgggttatccctctactgacagggatggatttgcattggtcaggccatcccttcacctttgtcttcagtccagggaaggtgcccacatgaagactacaatctcaagttagagtgtcatctattaaagtcaagagactactcttgatcattcttggcccaggatgcaacacagtgtttggcccatggcaagtgctcagtaaatgatgataataatagaataaaacaaagctggccaggcacggtggctcacgcctgtaatcccaacactttgggaggctaaggcgggcggatcacgaggtcaggagatcaagaccatcctggccaacatggtgaaaccccatctctactaaaatacaaaaacttagctaggcttggtggtacatgcctgtagtcccagctactcgggaggctgaggcaggggaatcacttgaacccaggaggcagagattgcagtgagctgagattgcaccactgcactccactgcaaaaaacaaacgaacaaataaaaaaatcaaagccaactagctcaaactcgtatcatgtgaatcaaataaacactgtcatgaaaacaattttttgtgaccaactagaggaaaaacaggtcttactctcacctgtgatgttttatgtatcctggaatacctctcagtgtgtgtaccgacatgtgaaaccattacctgtcttgtttgggagagatagaaatgagtgagtccaaaggttcttgctttcttcccacattaagtatcttctcccctttggttttattttctgtgactgtgagaagaggtttctttttggttttgtttgttttgttttttactcttcacactcactgaggtctctttctgctctactgtgttattttgtatagaaggttaacatccaggtgcatcaatatgccttcaaaaattattcttcccttcaacaaaaaatccaggaaacagaatttctatttgtaagtctcacaggaaaagcactaaaactggagattaattaaaaaaaatccaggaaactggagatgggcatgtgcagaattcataaatttacaacatcactgacctcagtttttaaacttccattggtgttgtgggactagggtgctatgtgaagtaatcatggaggaggggagtagacagagacttgctcatcatctacaaaaggctatcattacatctccatggaaatagggtcatttggtgacagtgtcaaacaaaagaggaaaaactgactttattcagggacgctttatcaggaaggaatcacctgccttctccctaatgtgttcttccaaagcaagcttcatttcttcctcatgaaagctaggaaggcatgtgggcatgtagccaccacactgcgaaatgctcagcgtggtaggaagtctacatgaaagtggaaccacctgtgtagcagacacagcgctgttgcataaggctgtggtcactggcacagttttattggaaggtggagaaattatttttacatcaaagaaacaaaaaaactggccgagcgtggtggctcatgcttgccgaggcgggcagatcacgaggtcaggagatcgagaccatcctggccaacgtggtgaaaccctgcctcttctaaaaatacaaaaattagctggtgtcgtggcacatgcctgtaatcccagctactctggaggctgaggcaggagaatcgcttgaaccagggaggcagaaattgcagtgagccgagactgtaccactgcactccggcctggcaacagagcaagactctctctctaaaaaaaaaaaaaaaaaaaaaaaagaaagaaagaaagaaacaaaaaacctgaaattaaaggcaactaagccagctgcagaaatgtggaccaggatttttctgaaacttttagcatagtaatgattgtttatactaagtttggtgacaacttatgcagatttaatgtgttcaaatcaccagaggtcgggagaaccagcctggccaatacatagtaaaaccgcgtctctactaaaaaatacaaaaattagctgggcgtggtggcgcacgcctgtagtcccagctacttgggaaactgagcaggagactcgcttgaacctgagaggcagaggttgcagtgagctgagattggccactccactccagcctgggggacagagcgagactccatctctcaaaaacaaaagtatgccttttctcttccaaaattttttttttagaactttggggttaaatttcattataaatacgtacttgtgtacctctctaaccaccttcctgatttccatgaattgtggcagaaacttaaagccagaaaagactgtgaatgtccctctttcaaatgttagacctagatttatatttcactgttagttttgtttttcttctaataggatatgatttctaaaaataagcatgagataaataattcctgagcatctatagatatcttttaagggaagtaaaattcatgtatgcaggggataggaaggaaagtattattaaattcacactggattaaggataggagacctgggttccagaaccaactctgccatcaactagttgagtgatttatttatttatttttttatttttttatttttattattttgtgtgtgtgtggactctcaaactctctggctttaatttccctgtctataaaattagtgggttgactaaatggattctgagttcaacctttaagatttggtcatttcacaactaaaatagctttcaccatttttagcttgatttagataacaatgaaaacaaaagcaacattgtttggatggcatatttgttatcttagactattatggtccacttttttaatttacaaaggttctcttactcctcactgtcaccactcattgtcagggttttcatttgcttgtttcgtttggttttaaggcctgtatcagcttcgaaaataccacctagcctgtgttttcttgtcagattttgttccctttggctgacattttctatctcttatctttcagtggccttgtcatatttgtaggggaactttggcctctcactcagtaggagagtggatctggagttctttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacgggttttcaccgtgttagccaggatggtctcgatctcctgacctcgtgatccgcccgcctcggcctcccaaagtgctgggattccaggcgtgagccaccgcgcccggccctggagttcttattaggtcaacagtgatgatgtgtatacactattaccaataacaaaaataaaaatattagaaaaaacagtaaaatattcatccatccactccctaccttggtcagaagagagtactaataattttcctcaaggcttttctctccccttccatctgcttctgtaaactctcctccctgtcaaggtctggtctaggttctagcttctctatgaatctacctgtcaagctttgtctctgcttattcctctttcccttgaatttctctggtcttcttatcatctccttcagaaaatttagtctccttcagaaaataccatctccttcagaaaatatcaaagctgcagtttattactctctcagagaaactagaaatcaagctaaaacagatgaaacagactatctgggagagtgaccggaccgttcaaaggaagactaggggccgggcgcggtggctcacgtctgcaatcccagcactttgggagggtgaggtgggcagatcacttgaggtcacaagttcgagaccagtctggccaacacagtgaaaccccgtctctactaaaaatataaaaattggccatgcatggtggcacgtggctgtaatcctagctacatgggagactgaggcagtagaatcgcttgaacctgggaggtggaagttgcagtgagctgagatcgcaccactgtactccagcctgggcaacagagtgagactttgtctcaaaaaataaaggaagactatgtaaatggatgtctgaagacatttcagaatactgatgtcctagtcaggagcctctcagaaggtaccactgaagctcacttgtaactagaaagacaaaattcattaactgaggtgtaataaatgctccttaaccaatatgatgcttgcttctgtaccactttggtcctgcgatgtcagtgacacaaagtccatcccttgctttatgactaatctcacaatcacatcaactagatgagtaacattttttggtggattctgaaactccctaggcttcaatttccctgtctataaaattagtaggttgactagatggattctgagctcagaatagccctgtgaatgagctttgtttttctcccagcccacataatgttgtcaaagaagtgataaatgagagatacctctgagcctggaggatgcgagtaggagaacaaaggggatactttagatgtgaacttggcatggtgccgcataatgggaaatctgttttcatttctttcatttcagatgccaaggggaaagtgactttacccacgagagagatttttaaatattcccccaactgctccggtaagtactgcgtttattgtaggagaaagtgcagcctcaaaaggaaaaagaagtcctgggagcttaggttgtagagacatttcccaaatattcaaggtgttctgtaaaaaaaaaaaaaaaaaagccttggccaggcgtggtggttcatgcctgtaatcccagcactttgggagaccgacgcaggcggatcacctgaggtcgggagttcaagaccagcctgaccaacatggagaaatcctgtctctactaaaaatacaaaattagccgggagtggtggcacatgcctgtaatcccagctacttgggaggctgaggcaggagaatcgattgaacccggagggcggaggttgtggtgagccgagatcgcaccattgcactccagcctgggcaatgagagcgaaactccgtctcaaaaaaaaaaaaaaaaaatgtctctcatagatccaatcagtcaataagttttggaaatgatggaaactatgcccatcactattttagatcttcattgtgtatacagtaaaggtcagagaattctggcagtaaagaaactgtttaactttgtgaaatctcaagcatcccaaagtagacacactttggaaaatgttgtagtagagagtcaaaacattttagcatctcaaatgtgccaataaagcaaatagcatctaataaatacaatgattaaagacatctttgatcaagtacataagcaaaatctaagaatatatcttcagatatgggttgaatgacttattaaaattctctaagaggtccaaataggttataaaaggagaccacagccagatgtttatattttctccaaaagagcagagaaaacactttctgaagaatcagaaccattgcttccacaatctgtgtcaaaattacccagggtgaacatctcccatgctcgcctaaaaattttcctgttcctgctcttgcacttacactatatgacaattagcttatgtgtcttcttcttcctctctacctagagatccttgactaaaggccatgacttatttatctttgcgcacctagcacagtgcatcataaagactaggcattaataaatactcattgtgggccgggtgcggtggctcacggctgtaatcccagcactttgggaggccgaggcgggtggatcatgaggtcaggagatcgagaccatcctggccaacacaatgaaaccccgtctctactaaaaatacaaaaattagctgggcatggtggcacatgcctgtaatcccagctactcgagaggctgaggcaggagaatcgcttgaactagggagctggaggttgtagtgagccgaaatcgcgccactgcactccagcctggcaacagagtgagactctgtctcaaagaaaaaaagtaaataaataaaaataaataaataagtactcattgaggacgtgaggataggtagaaatttctaggcaaagaaactagaatgtgcacaggccttgtgggagatggcgtatagcatgttcaaagaactgagaaactagatcatgcttcactccaggcctacaaactccaaatatctgtgtgtgggggctcaggaggagcatttttcacaaattttgcaattgattctaataaacagttaagttggaaaaccattagtctagacgatagcacagtaccatttaactgaaaagtagctaagaaggctgccaaagctacttgcaaacaactgaaagtttaaaatggtggttacaagttgaggttagcctaaaaatgttgttttcatgcataatgtagctgttaaatagtacagtgtttaaaataatatgctaatgatgatgagtgggaaggcacagaaaggtcatgagcccacacatactcaattagagtggacacacctaggtactctaatccacaagcattgattttggtcaaacacagtcagttggaatttggtatcgtaaatagcggcagaattagggagttggaatttttaaaaacatcatcctgactatttggtaattgtaaggttaatgcagattatgaaataactcatggaagagagtagaaacccaaattggttattttaactttatccctattttcttcatatctttcccctcaacacacacacacacacacacacacacacacacacacacacacacacaccccaattcttatgtaaaagttttagggtgattgaaaaataacttttctggttaggaacacttgaagttgcttacctctggaatgagattttgtatattgtcttacggaaacttgaataatgactaactttgcaaagggacacatttgagatgttttgtcagagaagaaaaaattgctctgtaa

SEQ ID NO: 136 - DNA, 15782 bp, Homo sapiens
agtatagatgtgagcctttaattttgcaccatagttattagataggcgtgaaatttcttgtacatatatttggatttaaaatgactattgtcctttcttgaaatttatatattgtaggccaggcacggtggctcatgcctgtaatcccagcactctgggaggctgaggcaggcggatcacctgaagtcaggagatggagaccagcctggccaacatggtgaaacctcatctctactaaaaatacaaaaattagctgagcctaggggcgggtgcctgtaattccagctacttgggaggctgaggcaggagaatcacttgagcctgggaggcggaggttgcagtgagttgagatcgtgccattgcactccagcctgggtgacaagagcaagactccatctcaaaaaaaaagaaaaaagaaaaagaaaagaaatttatatattgttattattattgccattctggcgtagactttaccttctgaagattaaaccatatgtcagggcttctgaaccccagcacaagtaacatactgggccagataattttttgttgttggggctgtcctatgccttgtaagttgctcaacaccatccctagcccctacctgctatatgccagtagcactgcccaattgcgacaccccaaaatatctccagacagacatgcctattgtcgcctggtgaacaaaactgtccctgtttagggaactctgcactatgtggctttatctgagtgtcaggaggaagacaccctacaggtgtttcataaattggaaagagaaatgatttgtgcttgctcattttccatttaatgttttatttttatttttaattttaattttttagagacagcgtcttgctcagtcatccaggctggagtgcagtggcacaatcattcatagttcactgaagcctcaaacgcctagctccagccatcctcctgcctcagcctcctgagtagctgggacaacagttgtgtgccaccatgcccagctaatttttttgtagagatgggttcttgccatattgtccaggctagtcttgaactcctgagctcaagcaatctgcctgccttggcctcccagagtgctgggattacaggcatgggccactgtgcttggcctattttgtttctaatattaagccagataatactccagaactttcctttatatttaaaaaaatttaaattattaacaaagtaattcagccaatattcaagtgattcttggcattgaagacaatgaaaaatacacattccctgccctctaggttcttactgcctagcttcaatcaaatgctggctttgtgatttaacttaggcatagttcttctgtacaactgtaataggcatatagaatttctgtctgtaatttctcttgttttctttctctttttttactaagttaaaaagtaaaattaatgctaagtactaaattaaaatcctattactgatgttgtcttaactacataagaattgaggaaattaaatgtgaaaaatatttctcccaggccatttcctaatttagtcatgaaatgtccttacttattaatgagcttatctttatttattaatgaatacaatgtcagataatattacaggatttagactctgcaaggatgagtgagctagagtggcagtttgattcacagctttgaatttgatgatttattctatgtgaacacttatatttcagtcattttctatattaatatccaaatcagtgagcaaggaaataggctttagtctccacgtaaaaaattgaaattcctcataatttttcttttctgaaaaggaaatgtgataagttttttgggttaatcttctcctattcattttttctaaggtgatctctcaggttcgaaagttttttacgagagatgatacaaatgccaaaatatagcaagtaaggcttgaattgaatatggtctctggaaaaacaatctcttgtttattgggggtgactgctttgctaggaggatgagtaggtacagggagttccctgagaccaggatgaacaaccctggctcatggagaaaatatcggtaagtctggaaaagtgatgcttccccagtgcactgtcgtgggaatgtaacaccacacatcacttcctgtattagtctagaatgctgcccagtcccctcaagtatagaacatggcgctggaaactaaacatgaatggccttggtatgagttggtaaatcgaaggggtaaaggaaaaatgactcagaaaatactaaaaagagcaaggatggataggtgagaatcgcatggaaacgtgagagtgggggccagatttggggagaaaatattatttttgacacctaaattatttttatggtattgaaattgttaatagccaatgcaatacaagttgcaagaaaattgatacactgatacttgctttgtgagtttctactgctcttttggaaagcaatatggccataaagtttaaaaaccagaaagcactcatcttgtttaatttagtaagcctatttctggaaatttttcttaaaatcataaaaaagaaggaaaaagaacaaagctaatacgtgatgatgttcaatgcagaaatatttggtaaagcaaaacagtgagaggaatttaaatatattcaaattattgaatcagtagatacagccacttaatggaatatgacacaacttttacaaaatatatttgtgaagactatatattatatggaaaaatgcctgtcacgtaagaaaaccagatatcaacttatatgtaccttatgactgtaattataataaaaatctgcatacacagtagaacaggaaaagaatatgcatagaacaaagtttgtattttacatgagggattagagattttttgtttattttgtgtattcagcattatatatcttcgtgaagtagtttgtgtgtctaaaaaataatttaaaaatactgttggcagggttaagcaaacagccagtcacgcagagtttcagaatttttctggatctactgcataatagttcagcataacaggacacattaggtagaagaacagaaagattacaggactagattcagagtgaaaaacaaagaaaacaagtcacttactaaagtgtgctccatcaacagggatgaagagtttgtgggcctgaagcttattcagttttggaggccctcttcaaaataaaaaattaaagagaattaggccccgggcctcaaaggggcccatgcaagtgagatgtcctgaggtttaagcttcctcagctgcaatggtaaatctactgttgggggcagttcaacttactgcctggagggattttttgctatatgtagtctcttaagttgcattctcctgtcactgtttctccaaaagaagtaagtgaaagaatttttgttttgcctcaaactaccttttatttgcaactacatgatttcatgcaattcttctaaacaacgacataaaatagatttccttgtttataaataacttaaatatgccccatatagtacatgctgaaagttgctagaacagttcatccactcctatagtattctggtatccaacagagttgatgcacatatataaatgccaagtccaatattaaaaactcaggcaactgactaactttaataaagtttcccaaactatgtcaatatacctaaaaatgcgtatatgtacaaaagaaagattattctcaataacttctataaaaataaattcaattgtttgttccatctaacttcactactattagtatgaatttttagtgtatggtaagatttattttacctttttctcaacatgacaccaacacagtcaaaaggagctagtgaggtgctaacatgcgagaattaacccagtgattctggtcacaatgcatttcaggtagaggtacctatgtcactgggattgggtgatatggtttattttcattccctgatttagataaccaaatggatcagatagagattctgatgggcattccttcaaaagaattttttaagaagcagaaataaaggagaaggccactgcctagctttactagagagaatgccacatcttagctgtgggtctcataatctgcagggttagcgcacagacctcagatgttgctgtttacaattcattctcggattggcaggtgtttgttgttccttgaagctagaggcactgggctcactaatcgttctgagaaaagaagctaatccaagatcttaccaattcagcatacttcttgaataaaaaatcaaacttttcttccggtgtttgcaacttgttcagattttgcattagcaggttggcttctttgccttaaaaaaaaaagacatgaaaaaaataagtgttgaatttacagtcaggtgataagggctggagtctcagattgaccacttgctaattattcccaaccttggctaagccattcatcttatcagatgtaattttctttcctatagaaatgatgacacctaccttacagagtgaacattagttgggaagtttgtgaatgtgtggtacggtgtgaggttcatggcagactctcaataaatgtttgctataacagaagtctcccagttttcatcacaagaatccgttcttatttctcctccctgtattcttcagaatcaaaagattttatacatcaaaaatactttctgaaagaatacgtcacccgttttcccacttgaattaacaaaaaggaagcaaaacagccaatcaaaatttccgactagtatgaaacagcaacacggagttgctgggattccagccagaagcagagaagcttgatgaagtagcctgcccgttttttcccctgtgttttttgttcttttggtacttcttttccctcttttagggggaaccaagtttctcttttttgtacataaacccattccctggcgttggagtgggaataactctgatcctgtttcctaccaaatagaataaaatcattatagaaggaaaaccaagtaaagacatggagagcctttccacaagcctttttctgtctctgtgataatggacacagccttctctggccttcctttcccccacctaggccttaatatccgttggcagtttcattttgtttccagttggagtttatgctacactaaaaaaaaattaaccctgttaaataatcatgaaagggtggggcatttttcccatccctacctatctatgaaaaccactctgtttaatcagaatagggtggtcaagccacacaacaaagcccacacttcctgacataaatctgcttaagaaaattgacaacctttcccccaagaacagacatttccccttggctagagtacttgctttcatcttggagaggcatatatgtcatgaaattaggattgccagatgaaatataggacatggggcatatttgtactaaaaaatgattcgttgtttacctgaaattctaatttttctggacatcctgtattttcctttgctaaacctggcaactttacatggaatcaaggaattttaggtctagaaggaatttcaaagagcatccagactaaccggttaattttatgcattttagtatttaaggcccagaaaagtccaaagttacatgattagtgctggcagagagaaggcttgaatccaaggctagcctacttgttctaagtcactccactctcatgtggaattctgatgctagagagacctagagaaatagaaggcaactttttttttaaatgacctcattcccaacagttagttttgtctatctttgcctagtgagtcagttcagattagcctaaaacaggggaaggtgggtgtgagtagggtccctcccagctctccaattatggcctgtggcatttgcagctgataatcactgacgcctcgcccctgccaggcatgtgctttgggttatccctctactgacagggatggatttgcattggtcaggccatcccttcacctttgtcttcagtccagggaaggtgcccacatgaagactacaatctcaagttagagtgtcatctattaaagtcaagagactactcttgatcattcttggcccaggatgcaacacagtgtttggcccatggcaagtgctcagtaaatgatgataataatagaataaaacaaagctggccaggcacggtggctcacgcctgtaatcccaacactttgggaggctaaggcgggcggatcacgaggtcaggagatcaagaccatcctggccaacatggtgaaaccccatctctactaaaatacaaaaacttagctaggcttggtggtacatgcctgtagtcccagctactcgggaggctgaggcaggggaatcacttgaacccaggaggcagagattgcagtgagctgagattgcaccactgcactccactgcaaaaaacaaacgaacaaataaaaaaatcaaagccaactagctcaaactcgtatcatgtgaatcaaataaacactgtcatgaaaacaattttttgtgaccaactagaggaaaaacaggtcttactctcacctgtgatgttttatgtatcctggaatacctctcagtgtgtgtaccgacatgtgaaaccattacctgtcttgtttgggagagatagaaatgagtgagtccaaaggttcttgctttcttcccacattaagtatcttctcccctttggttttattttctgtgactgtgagaagaggtttctttttggttttgtttgttttgttttttactcttcacactcactgaggtctctttctgctctactgtgttattttgtatagaaggttaacatccaggtgcatcaatatgccttcaaaaattattcttcccttcaacaaaaaatccaggaaacagaatttctatttgtaagtctcacaggaaaagcactaaaactggagattaattaaaaaaaatccaggaaactggagatgggcatgtgcagaattcataaatttacaacatcactgacctcagtttttaaacttccattggtgttgtgggactagggtgctatgtgaagtaatcatggaggaggggagtagacagagacttgctcatcatctacaaaaggctatcattacatctccatggaaatagggtcatttggtgacagtgtcaaacaaaagaggaaaaactgactttattcagggacgctttatcaggaaggaatcacctgccttctccctaatgtgttcttccaaagcaagcttcatttcttcctcatgaaagctaggaaggcatgtgggcatgtagccaccacactgcgaaatgctcagcgtggtaggaagtctacatgaaagtggaaccacctgtgtagcagacacagcgctgttgcataaggctgtggtcactggcacagttttattggaaggtggagaaattatttttacatcaaagaaacaaaaaaactggccgagcgtggtggctcatgcttgccgaggcgggcagatcacgaggtcaggagatcgagaccatcctggccaacgtggtgaaaccctgcctcttctaaaaatacaaaaattagctggtgtcgtggcacatgcctgtaatcccagctactctggaggctgaggcaggagaatcgcttgaaccagggaggcagaaattgcagtgagccgagactgtaccactgcactccggcctggcaacagagcaagactctctctctaaaaaaaaaaaaaaaaaaaaaaaagaaagaaagaaagaaacaaaaaacctgaaattaaaggcaactaagccagctgcagaaatgtggaccaggatttttctgaaacttttagcatagtaatgattgtttatactaagtttggtgacaacttatgcagatttaatgtgttcaaatcaccagaggtcgggagaaccagcctggccaatacatagtaaaaccgcgtctctactaaaaaatacaaaaattagctgggcgtggtggcgcacgcctgtagtcccagctacttgggaaactgagcaggagactcgcttgaacctgagaggcagaggttgcagtgagctgagattggccactccactccagcctgggggacagagcgagactccatctctcaaaaacaaaagtatgccttttctcttccaaaattttttttttagaactttggggttaaatttcattataaatacgtacttgtgtacctctctaaccaccttcctgatttccatgaattgtggcagaaacttaaagccagaaaagactgtgaatgtccctctttcaaatgttagacctagatttatatttcactgttagttttgtttttcttctaataggatatgatttctaaaaataagcatgagataaataattcctgagcatctatagatatcttttaagggaagtaaaattcatgtatgcaggggataggaaggaaagtattattaaattcacactggattaaggataggagacctgggttccagaaccaactctgccatcaactagttgagtgatttatttatttatttttttatttttttatttttattattttgtgtgtgtgtggactctcaaactctctggctttaatttccctgtctataaaattagtgggttgactaaatggattctgagttcaacctttaagatttggtcatttcacaactaaaatagctttcaccatttttagcttgatttagataacaatgaaaacaaaagcaacattgtttggatggcatatttgttatcttagactattatggtccacttttttaatttacaaaggttctcttactcctcactgtcaccactcattgtcagggttttcatttgcttgtttcgtttggttttaaggcctgtatcagcttcgaaaataccacctagcctgtgttttcttgtcagattttgttccctttggctgacattttctatctcttatctttcagtggccttgtcatatttgtaggggaactttggcctctcactcagtaggagagtggatctggagttctttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacgggttttcaccgtgttagccaggatggtctcgatctcctgacctcgtgatccgcccgcctcggcctcccaaagtgctgggattccaggcgtgagccaccgcgcccggccctggagttcttattaggtcaacagtgatgatgtgtatacactattaccaataacaaaaataaaaatattagaaaaaacagtaaaatattcatccatccactccctaccttggtcagaagagagtactaataattttcctcaaggcttttctctccccttccatctgcttctgtaaactctcctccctgtcaaggtctggtctaggttctagcttctctatgaatctacctgtcaagctttgtctctgcttattcctctttcccttgaatttctctggtcttcttatcatctccttcagaaaatttagtctccttcagaaaataccatctccttcagaaaatatcaaagctgcagtttattactctctcagagaaactagaaatcaagctaaaacagatgaaacagactatctgggagagtgaccggaccgttcaaaggaagactaggggccgggcgcggtggctcacgtctgcaatcccagcactttgggagggtgaggtgggcagatcacttgaggtcacaagttcgagaccagtctggccaacacagtgaaaccccgtctctactaaaaatataaaaattggccatgcatggtggcacgtggctgtaatcctagctacatgggagactgaggcagtagaatcgcttgaacctgggaggtggaagttgcagtgagctgagatcgcaccactgtactccagcctgggcaacagagtgagactttgtctcaaaaaataaaggaagactatgtaaatggatgtctgaagacatttcagaatactgatgtcctagtcaggagcctctcagaaggtaccactgaagctcacttgtaactagaaagacaaaattcattaactgaggtgtaataaatgctccttaaccaatatgatgcttgcttctgtaccactttggtcctgcgatgtcagtgacacaaagtccatcccttgctttatgactaatctcacaatcacatcaactagatgagtaacattttttggtggattctgaaactccctaggcttcaatttccctgtctataaaattagtaggttgactagatggattctgagctcagaatagccctgtgaatgagctttgtttttctcccagcccacataatgttgtcaaagaagtgataaatgagagatacctctgagcctggaggatgcgagtaggagaacaaaggggatactttagatgtgaacttggcatggtgccgcataatgggaaatctgttttcatttctttcatttcagatgccaaggggaaagtgactttacccacgagagagatttttaaatattcccccaactgctccggtaagtactgcgtttattgtaggagaaagtgcagcctcaaaaggaaaaagaagtcctgggagcttaggttgtagagacatttcccaaatattcaaggtgttctgtaaaaaaaaaaaaaaaaaagccttggccaggcgtggtggttcatgcctgtaatcccagcactttgggagaccgacgcaggcggatcacctgaggtcgggagttcaagaccagcctgaccaacatggagaaatcctgtctctactaaaaatacaaaattagccgggagtggtggcacatgcctgtaatcccagctacttgggaggctgaggcaggagaatcgattgaacccggagggcggaggttgtggtgagccgagatcgcaccattgcactccagcctgggcaatgagagcgaaactccgtctcaaaaaaaaaaaaaaaaaatgtctctcatagatccaatcagtcaataagttttggaaatgatggaaactatgcccatcactattttagatcttcattgtgtatacagtaaaggtcagagaattctggcagtaaagaaactgtttaactttgtgaaatctcaagcatcccaaagtagacacactttggaaaatgttgtagtagagagtcaaaacattttagcatctcaaatgtgccaataaagcaaatagcatctaataaatacaatgattaaagacatctttgatcaagtacataagcaaaatctaagaatatatcttcagatatgggttgaatgacttattaaaattctctaagaggtccaaataggttataaaaggagaccacagccagatgtttatattttctccaaaagagcagagaaaacactttctgaagaatcagaaccattgcttccacaatctgtgtcaaaattacccagggtgaacatctcccatgctcgcctaaaaattttcctgttcctgctcttgcacttacactatatgacaattagcttatgtgtcttcttcttcctctctacctagagatccttgactaaaggccatgacttatttatctttgcgcacctagcacagtgcatcataaagactaggcattaataaatactcattgtgggccgggtgcggtggctcacggctgtaatcccagcactttgggaggccgaggcgggtggatcatgaggtcaggagatcgagaccatcctggccaacacaatgaaaccccgtctctactaaaaatacaaaaattagctgggcatggtggcacatgcctgtaatcccagctactcgagaggctgaggcaggagaatcgcttgaactagggagctggaggttgtagtgagccgaaatcgcgccactgcactccagcctggcaacagagtgagactctgtctcaaagaaaaaaagtaaataaataaaaataaataaataagtactcattgaggacgtgaggataggtagaaatttctaggcaaagaaactagaatgtgcacaggccttgtgggagatggcgtatagcatgttcaaagaactgagaaactagatcatgcttcactccaggcctacaaactccaaatatctgtgtgtgggggctcaggaggagcatttttcacaaattttgcaattgattctaataaacagttaagttggaaaaccattagtctagacgatagcacagtaccatttaactgaaaagtagctaagaaggctgccaaagctacttgcaaacaactgaaagtttaaaatggtggttacaagttgaggttagcctaaaaatgttgttttcatgcataatgtagctgttaaatagtacagtgtttaaaataatatgctaatgatgatgagtgggaaggcacagaaaggtcatgagcccacacatactcaattagagtggacacacctaggtactctaatccacaagcattgattttggtcaaacacagtcagttggaatttggtatcgtaaatagcggcagaattagggagttggaatttttaaaaacatcatcctgactatttggtaattgtaaggttaatgcagattatgaaataactcatggaagagagtagaaacccaaattggttattttaactttatccctattttcttcatatctttcccctcaacacacacacacacacacacacacacacacacacacacacacacacaccccaattcttatgtaaaagttttagggtgattgaaaaataacttttctggttaggaacacttgaagttgcttacctctggaatgagattttgtatattgtcttacggaaacttgaataatgactaactttgcaaagggacacatttgagatgttttgtcagagaagaaaaaattgctctgtaacacagagcaattttattatgtttttccatgttccaaaacactagagtgattccaaccctgcactttggaacttgaagatacttaaaagttattatctgagttcttttaattttatcctagttgggtgaagtatgctacctgaatgtattatttaggccttcttgaaagcattgtagcaatgggttttagcatcatagcgatatctgtaggaaaatagccccttgcatggcaagagtgatgccatcgtaaagcaaacctgccatgatgaccaatgtttgactcctccataccaaggtgttctgcagcagatatctccaaccctcaggccacggactggtaccagtcattgtgggctgcataatgggaaatctgttttcatttctttcatttcagatgccaaggggaaagtgactttacccacgagagagattttacccacgagaggcctctatcagtttcgaaaataccacctagcctgtgttttcttgtcagattttgttccctttggcttacattttctatttcttatctttcagtggccttgtcatatttgtaggggaactttggcctctcactcagtaggagagtggatctggagttcttattaggtcaacagtgatgatgtgtatacactattaccaataacaaaaataaaaatattagaaaaaacagtaaaatattcatccatccactccctaccttggtcagaagagagtactaataattttcctcaaggtttttctctccccttccatctgcttctgtaaactctcctccctgtcaaggtctggtctaggttctagcttctctatgaatctacctgtcaagctttgtctctgcttattcctctttcccttgaatttctctggtcttcttatcatctccttcagaaaatttagtctccttcagaaaataccatctccttcagaaaatatcaaagctgcagtttattactctctcagagaaactagaaatcaagctaaaacagatgaaacagactatctgggagagtgaccggaccgttcaaaggaagactaggggccgggcgcagtggctcacgtctgcaatcccagcactttgggagggtgaggtaccagtccgtggcctgttaggaactgggctgcacggcaggagatgagtggcaggcgacagagcaaaacttcatctgtatttgcagctgctccccatcactcacattaccacctgagctccacctcctgtcaggtcaacggtggcattagattctcataggagcgtgaaccctattgtgaactgcacatgcaagggatgtaggttgcatgctccctgtgagaatctaatgcctgatgatctgtcactgtctcctgtcacccccagatgggaccgtctagttacaggaaaacaagctcaaggctcccactgattctacattacggtgagttgtataatcatttcattatatcttacaatgtaataataatagaaataaggtgcacaataaatgtaatgcacttgaatcatcccgaaactatccctccccagtccatggaaaaactgtcttccctggtgccaaaaaggttgacggctgttctgcagcaaggtctttaaacaatgcctgtgacatagacaatccctcagaaagatgcttatctaacgttcccagtggtcatgacttttggcaagaaagttggagatgtgaccagctgcacatgactttacctaaaagcttgctatgtaaaggacactttctggagagtgggtgtaggaattcactgtctcactgctgcccaagacagcactactgtttgtaagcccctattaaatatttctttctgagaaagtggatttgtcagcctctgtttttggccttcagctcccttggcctttgtgggtaggtttgtatatacctgctcactgcagaaaaatattctactccagtttgtgatatatttgggtttacagatagtctggttactggagtttgaacccagttctgactccaatgctcatgatctttcactctaccacatagtcttccagaaacaaatcatatgtggtctctgcccttgatagattctccatctagcatgagagatgggtatataaacaaatgattgctgcagaaaatttaatagaaaactaaggaaggtgatgctaactctacctgggcatgtcagggaaagtatcacataggagggagtattcgtagtgagtgtttccaccaggaaagacaagcagagggactttcctatgtacagtaacatgcttcactcatagttttaaaaattaacgttctcacccttttttcccagccatcgttggtgtcaccaatctcccatgctctcctaaaaaattttccttttcccgtttttgcacttctcctatataattaatttacatgtcttctgttttctctatacttacagctccttgaccaaaagaccatgatttatttatctttgtgcacctagcacagtgccttacaaagactaggcattaataaacactcattgggcacctgaagataggtacagatttctaggtaaagaaactaggatgtgcacaggccttgtgggcgatggagcatagcatgttcaaaggcctgaaagacaagatcagaatgactagctattaggcagtagtggtggtggtggtaatagaggcagagtgttcaggaaggtgatgttgtagggtagagtaatctgagataaaactgggactggttggagttagaccattaggatcttagagaacatgttaaagattttggtcttcatcctaagagcagtaggaggccacggaacaaagggtcaatgggtaacacactgaaaagttcacctgagctccattgaggggtaagggctggggacaaatacaacaagggaaaatatagaaggctactacagtcatccaaatattggatgtggcttttagtgaagtttggaagaag

SEQ ID NO: 137 - DNA, 17603 bp, Homo sapiens
cttgggatggacaccattgatatccccaggtctgacataaacaggcaggggggtgctctcagtcctcagatgtgatccctgcctgagctctgttggcattccatggcgaggctcttcagcctcatttgggcagaagcggtcctggggattgcaaaagggctttctttttcttttatttatttctttttagaaacagagtctccttgtgttgcccaggctggagtgcaatggtacaatcatagctcactgcagccttgaactcctgggctcaggcgaccctcccgcctcagccttctttgtaactggaactacaggtgtgcaccaccatgcttagataatttttgtattttttgtgtagagggtgggttctcgctatgttgcccaagctggtctcgaactcctgggctcaagcaatcctcctaccttggcctcccaaagttctgggattacaggcacaagccaccgcgcccggccatttcttttcttttcttttcttttcttttcttttcttttcttttcttttctttttgagacagatttttgctcttgttgcccaggctggagtgcaatggcgcgatcttggctcactgcaacctctgcctcccaggttcaagcaattctcctgcctcagcctcccgagtagctgggagtacaggcatgcaccaccatgcccaactaattttttgtatttagtagagatggagtttcaccatgttagttaggctagtcttgaactcctgacctcaagtgatctgtcaacctcggcttcccaaagtgctgggattacaggcatgagccaccgtgcccggcctccggccatttcttaatatgatccaattacatacctactgataaatatttatcataacttttcctattgtaaacaatgttgcaattaatatctttgggtatccgcaaatttgtgcaaagtgcatgtatttctgtagcaagtttcctagaaatgttaggtcaaagatatgcacatttgaaagttcaacagtcattgtcaaatgccttctaagaagttttctggccaggcactgtggctcacacctgtaatcccaacactatgggaggccaaggtgggtggatcacctgaggtcagaagttcgagaccagcctgaccaacatgatggaaccccatctccactaaaaatacaaaattagccgggtgtgatggcacatgcctgttaatcccagctacttgggaggctgaggcaagagaattgcttgaactcgggaggtggaggtttgcagtgagctgagattgtgccattgctctctaggctgggttgactcctcccccaaaacaaacaaacaaaccaaaaaacaaatgccttctaagaagttttcaccggctgggcacagtggctcatgtttgtaatctcagcactttgggaggctgaggcaagcggatcactggagcccaggagtttgagaccagcctgggcaacatagtgagaccctatctctacaatacaagcaagcaaaaaaaacaaacagaaattagctaggcatggtggcttgtgcctgtaatcccagacaccccgggaggctgaggtgggagaactgcttgagcctgggaggttgagactgcagtaagctgtgacggcaccactgcactccagcctgggcaacagagtgagacgctgtctcaaaaaaaaaaaaaaagttttcaccaacattctttttttgttttgttttgagacagggtctcgctctgttgctctggctggagtacagtggcttgatcatagctcactgcagccttgaacgcgtaagtcctcccgcctcaacctcacaaccagctgggacctacaggcacatactgccatgcttggttaatttttaaattttttgtagagacagggtctcactgttttgcccaggctggtctctagcctcaagcggtcctaccatctcggcctccaaaaagcacttgggattaccagcatgagccactgcacctggccaccaacctacagtcttatcatcactgagttcgtatctacctgcatcctgtccaatactccgtactaccaatctttcaaatttttgtcggctgggcacagtggctcatgcctgtaattccagcactttggaaggccaaggcaggcagactgcttgagcccaggagtttaagaccagcccgggagacatggcaaaaccccatttctgcaaaatatacaaaaattagctgggcttggtggcatgcactggtagtcccagctactccagaggctaagatgggaagatcacctgaccccgggggtttgaggctgtaatgagccaagtcatgctgctgcgctccagcctgggtgacagaacgaggccctgtctcaaaaaaaagaaaaaaaaatttttttttggtcaatataagagtcatagttttgattagcatttcccttattactagtgaagcagaacagcttttcaaatgtttgctgcctgtttgtatctcttcctctgtgacttatctttctccgtgatttgccagtaggcatttgcagtcctttttttcttttttttttgacttggagtctcgcgatctcggctcactacaacctccgcctaccaagttcaagtgattcttgcgcctcagcctcctgagtagctgggattatgagcatgtgccaccacccctagctaattttttgtatttttagtagagatggggttttgccatgttggccaggctggtctcgaactcctgacctcaagtgatccacccgccttggcctcccaaatgctgggattacaggtgtgagccaccacgtccagccgtttgcagtccttccttcacctaactctccagttgccactgttgccagttatagaattttaggtttgaaatggttttctgttggaattctgcagacaatgttccactggctcttagactccatggttgctattgaaaagctggatgccatgttgatttctgatccttggtatatgacttgttattttctatctgaaagtgtttcagatcttctcttcacccctgatagtctgaagtccagtgcttccatgggtctctatgctttcatcaccctggacacctttttaatctagagacttgtatatttcagttctggatattttcttgtgcgtttttctttttaaaataataatttcttttcctttgttctctctttttgaactcctttcgtttgaggttagacttcctggattgatcctccaaacctgtttcctttttgtttctttctctttttttttctcttctctctagtttatttccctcgatttcaatctacgatgcttctactggatggtaactttcaactctcataattttaatttcccagagcttttctgtgtttctctgttcattcttcatggcatccttggaaggatgccaagctaaggaggccaggggggaataaaaggagtccaggctcccaactgtgcccttcccctctcccctgggagcaaccacttagggtcctcatggttcctccagtctggactctgctgcttctggtgggggctgcccttttcaggtaagctgggcccagggggtaatgataaaccagggtcagctgagggtggctgtaaggaatatggaaggacagagctggagggggcgagcaggctaactacaaaagatctggagagaggccaggcacggtggctcacgcctgtaatcccagcactttgggaggctgaggtgggcagatcacgaggtcaggagatcgagaccatcctggccaacatggtgaaacctcgtctctactaaaaatacaaaaaattagccaggcgtggtggtgtgcacctgtagtcccagctacccaggaggctgaggcaggagaatcgcttgaacctgggaggcggagtttgcagtgagctgagatcatgccattgcactccagcctggatgacagagcgagactccgtctcaaaaaaaaaaaaacaaaaaaaaagaccttgagaggaagggggaaacccggtgggatggaaatgggttgaccttgactgctgaacaggaattaaggggcgggttctgggagcgggacagggctacaatgtgagaagggacggaggaggtgcagagctggaagacagatctaagcctaggagagaaggattgaggggtcaggccctcaggaaacggacaagacccagggtggacccagctgatgagagagacttaagtacgaggcagcaaagaaatgacggatgacaggccaagcgcggcggctcacccctgtaatcccagcactttgggaggccgaggcgggcggatcacctgaggtcaggtgttgagaccagcctgaccaacatggtgaaaccctgtctctactaaaaatataaaattagccaggcatggtggtgcatgcctgtaatcccagctacttgggaggctgaggcaggagagtcacttgaacccgggaggcggagactgcagtgagcggaaattgcaccattgcactccagcctgggcaacaagagcaaaactccatctcaaaagaaaaaaaaaaagaaatgatggatgtcttggtgtcctgcagtgtgtttgggagaatttgaacaagtagaacttcaacaacaacaaaaaacagagggctgagcacagtggctcccaccggtaatcccagcactttgggaggccaaagtgggaggattgcataaggccaggaggtcatgaccagcctgtgcaacatagaaagaccccatctctataaaaaataaaaataaattagctgggcgtggtggcatgctcctgtagtcccagctactggggaggttgaggtgggaggattgctggagcccagaggtttgaggctgcagtgagctgtgattgtatcactgcactctagcctgggtgccggaaaaaaaaaaaaagaaaagaaaaaaagaaaaaaagtcaagtcagacacattcactgcataaacactgatcatccttacgtgaccactcagaaagctcacagtcactgaatcttataattcttgataatgacacgagttgcatttttgctttcttcaaacgacccccaaggaaagagaagcctccggaccagaagctggttgttcgcagctctagggacaactgtgagttggaaaccaggagtgctaagatttctcctccctcctccgaacccacattctgccaccagaatgccagttcctgagttcctagcaggagcagccacctccagtcccctccgggcatcagccaggactacaaaatgtgtcctgccaggccaagtccagccctccaacctcagttcatgaccccggaccttgtcattctgtccactctcccagccccgaatttctcctaaaagattctctctttcaaatctctgctctgggccgggtgctgtggctcacacctgtcatcccaacacttagggaggccaaggtgggaggatggcttgaggccaggagtttgagagcagcctgggcaacatagtaagactccatctccacaaaaaacagacgagcaatttctgctctggaccccaaggctttgcaacagctttctttttcttttctttgagacggagtctccctctgtccctcaggctggagtgcagtggcgcgatcttggctcactgcaaagtccgcctcctgggttcaagcgattctcttgcctcagcctccccagtagctgggactacaggtgtgcgccaccacacccggctgatttcatggcagctttctctaagtgtagcaatcttgctacttccctctccctgtgtggctctgggccctgcccctgccctctctgaaacctcactgtgacccattcttcctagatgtcctcacccagtgtgattttgaggatgacgccaaacccctctgtgactggtcccaagtgtccgcagacgatgaagactgggttcgagccagtgggccctctcccaccggctccaccggggcccccggggggtaccctaacggaggtgaggggctatggtttccaggggaccatgagcagggaggtggctgggaggcgggagtggctagatggagagagaagggaggcagccagacctggatgcctgggctctgagaaggggatgggtgggggcagccctcagaggtggctgggcctcagtgtcttgggctctgcctcccccagagggcagctatctgcatatggaatcgaacagcttccaccgtgggggagtggcccgcctgctcagccccgacctatgggagcaaggccccctctgtgtgcactttgcccaccacatgttcgggctgtcttggggcgcccagctcaggctgctgctgctctcgggtgaagagggccgccgccccgatgtgctctggaaacactggaacacccagagaccctcctggatgctcaccaccgtcactgtgcccgcagggttcaccctgcccacccgggtaaggccggggacaaattgtgggacctcgggggggagtctgggtgttggagagcctgagggtgggggtgtggcaaaaagggattgtgggggccaagccatctgaattcaggaagaaaactaggagccaggaggcctggctgaggggctcatggggttggggtccccttatcctcttgcagctgatgtttgagggaacacggggtagcactgcctacctggacatcgccctggatgccctctctatccgccggggctcctgtaatcgcggtgagtccctgtccctcctcccgcctgccctcggacccttttctctccgtccttgcacaacaagaagaggatccagggcgggcgcggtggctcatgcctgtaatcccagcactttgggaggccgaggcgggcggatcacgaggtcaagagatagagacctttctggttaacacggtgaagccccgtctctactaaaaatacaaaaaattagccgggcgcggtggcgggcgcctgtagtcccagctacttgggaggctgaggcaggagaatggcatgaacctgggaggtggagcttgcagtgagccgagatcgtgccactgcactccagccttggcgatggagtgagactccgtctcaaaaaaaaaaaaagaagaatgagaaaggagatgaggagctggctgtattgggtctgccaggtagagctattagggctttgactctggaagcagccgtgcctaaagagaggtctcggcccagcacagtggctcaggcctgtaatcccagcaccttgggaggccaaggtgggaggatggtgtgaggccaggagtttgagatcagcctgggcaacataaggagacccccatctctacaaaagaatttatttatttatttatttatttatttgagacggaatttcactcttgtcacccaggctggagtgtagtggcacgatctcggctcactgcaacttctgcctcttgggttcaaatgattctcctgcctcagtctcccaagtagctgggattacaggtgcccaccaccatgcctggctaatttttgtatgtttagtagagccggggtttcattgtgttggcaaggctgttctagaactcctgacctcaggtgatccactcacctcagcctcccaaaatgctgggattacaggagttaagtcaccgtgccaagaactttttaaaaattagctcggcatggtggcgcacacctgtagtcctagctacttgagaggttgaggtgggaggaccgcttgagtccaggagttcgaggccgcagtgagctatgatcacaccactgtactctagcctgggtgacagagaccctgtctctaaaaaagaagaaaacattatatcttcccttctttctttcctctcagtctgtatgatgcaaacatgcagctttgacattccaaatgacctctgtgactggacctggatcccaactgcctccggggccaagtggactcagaagaaagggtcatcaggaaagccaggcgtggggcctgatggcgacttctctagccctggtagtgagtagcggccatgcttctgtcccttgactttctgggcaccaagcaccctacgataattgccctgggacggtctgtcatgaacacctacagcttcaagcctcttaccagctcaagtttcacgcaagaagctgatttcaagcacccagccagcctcccccaccaccgccctacaagctctacctggcagacccaatacagccagctcctcatctcctttctgtggctcttcttcttcttctttctcttcctcttcttcttctccctctccctctccctctccctctccctctccctctccctctccctctccctctccctctccctctccctctccctctccctctccctctccctctccctctccctctccctctccttctccttctccttcttctttttctttttttttttttgaagcagagtctcgttctgtcacccagtctggagtgcagtggcgtgatctctgctcactgcaacctctgcctcctgggtttaagcaattctcctgcctcaacctcccaagtagctgagactgcaggcgtgcaccaccatgcccggctaatttttgtatttttggtacagacagggtttcaccatgttggccaggctggtctcgaactccggacctcaagtggtccacctgcctcagcctcccaaatgctgggattacagcgtgagccattgcttctggcccctttcattcttcattcattcaagaaatactgagcacctacaatatgccaggtgctgtcctaggcacttaaaatacaccagtgcagaaaacagacaaggaagagtagggtgtggtagcgggggggcagttaccgacacaaagtaaatatagttataaagtgagcgatgctactgggaaaataaaaagtcaaacaagtttggagccaagtgcactggctcacgcctgtaatcccagcgctttgggaagctgagacgggaggatcacctcaagtgatctgcccactttggcctcccaaagtgctgggattacaggcgtgagccactgtgccccgccgtgagttatcaattatttatttatttattttggagacagagtctcgccctgtctcccaggctggagtgcagtggctctatctcggctcactgcaagctccgctgcccaggttcaattgattctcctacctcagcctcctaagtaactgggactacaggtgtacaccaccacgcccagctaatttttgtgtttttagtagagacggggtttcaccacgttggccaggctggtcttgaactgctgacctcaggtgatccggccacctcggcctcccaaagtgctgggattataggcgttgagccactgtgcctgggcgagttaccgattttaaataggctggtcagagtaggtcacattcaggacacatttgagcacgaacttgaaaaaggtgaggtagtagcagaggacattccaggctgaggggccagctgtgcaaaggtcctgaggtagcagtggggctgtcggggaaggaggggatcaaggcacagcaaagagccatgtggccagcatgaagagggtgacctgagatccacaggagcggcagatcacatagagccttgaaggccattgtcaggactgtggctttcctattctgtgtgaatggggagcctttgcaggattttgagcagtgacttgatctgacttatttatttttttttttttaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcccgcctttctattccacaaagccgccattgtcatcctggcccgttctcaatgagctgttgggcacacctcccagacggggtggtggccgggcagaggggctcctcacttcccagtaggggcggccgggcagaggcgcccctcacctcctgggcggggcggctggccgggcggggggctgaccccccccacctccctcccggatggggcggctggccggtcggggggctgaccccccacctccctcccggacggggcggctggccaggcagaggggctcctcacttcccagtaggggcggccgggcagaggcgcccctcacctcccggacggggcggctggccgggcaggggggctgacccccccacctccctcccggacggggcggctggccgggcggggggctgacccccccacctccctcgcggacggggcagctggccgggcagaggggctcctcacttcccagtaggggcggccgggcagaggcgcccctcacctcccggacggggcggctggccgggcaggggggctgaccccccccacctccctcccggacggggcggctggccgggcaggggggctgaccccccccacctccctcccggacggggcggctggccgggcggggggctgacccccccacctccctcgcggacggggcggctggccgggcagaggggctcctcacttcccagtaggggtggccgggcagaggcgcccctcacctcccggatggggcggctggccgggcaggggggctgaccccccccacctccctcccggacggggcggctggccgggcggggggccgacacccccacctccctcccggacggggcggctggccgggcggggggccgacccccccacctccctcccggacggggcggctggccgggcagaggggctcctctcttcccagtaggggcggccgggcagaggcgcccctcacctcccagacggggcggctggccgggcggagggctgacccccccacctccctcccggacggggcggctggccgggcagaggggctcctcacttcccagtaggggcggccgggcagaggcgcccctcacctcccggaccgggcggctggccgggcggggggctgacccccccacctccctcccggatggcacggctggccgggcggggggctgaccccccacctccctcccggatggggcggctggccgggcggggggctgaccccccctcacctccctcccggacggggtggctgccgggcggagatgctcctcacttcccagatggggtggctgctgggcggagaggctcctcacttctcagacggggcagctgccgggcggaggggctcctcacttctcagacggggtggttgccaggcagagggtctcctcacttctcagacggggcggccgggcagagacgctcctcacctcccagacggggtctcggccgggcagaagcgctcctcacatcccagatggggcggtggggcagaggtgctccccacatctcagacgatgggcggccgggcagagacgctcctcacttcctagatgtgatggcggctgggaagaggcgctcctcacttcctagatgggatggcggccgggcggagacgctcctcacttcccagactgggcggccgggcagaggggctcctcacatcccagacgatgggcggccaggcagagacactcctcacttcccagacggggtggcggccgggcagaggctgcaatctcggcactttgggaggccaaggcaggcggctgggaggtggaggttgtagtgagccgagatcacgccactgcactccagcctgggcaccattgagcactgagtgaacgagactccgtctgcaatcccggcacctcgggaggccgaggttggcggatcactcgcggttaggggctggagacccgcccggccaacacagcgaaaccccgtctccaccaaaaccagtcaggcgtggcggcgcgtgcctgcaatcgcaggcactcggcaggctgaggcaggagaatcaggcagggaggttgcagtgagccgagatggcagcagtacagtccagcttcggctccgcatgagagggagaccgtggggagagggagacggagacggagacgagggagagggagggggagggggacggggacgatctgacttattttttaaggattttttttgtgttgagaatccactgaggagaacaggcaagggtcgatgcagagaggctgtttaggaggcttttgcaaaaatccaggcgacactctttctttttctttctttttttttttttgagacagaatcttgctgttgccaggctggagtgcaatggcacgatctcagctcactgcaacctctgccttccgggttcaagcgattctcctgcctcagcctcccgagtagctgggattacaggtgtgcgtcaccatgcccagttaattttttgtatttttagtagagatggggtttcaccatgttggtcagggtggtctcgatcttctgacctcgtgatccacccacttggcctcccaaaatgctgggattacaagcgtaagccaccatgcctggctgatattctttctttctatgcacccaagtctatccctagcttctttccaccacctccctgtgcactcagctgagcttctttctctttctactgttgacttcttccttttctctctcacacaacattcactttctctcttaatcttctcacacagcccacatttcaacccctcactgagccaagcactgtaggtcaagcatagagggttctgctccctaatttcctgagtttataattcttatttttgaatttaaaaaaatgtttttaaaaactaggccaggtgcagtagctcatgcctgtaatcccagcactttgggaggccgaggtgggcagatcacttgaggccacgagttcaagaccagcctggaacatatagtgagatcttgtctctacaaaaaatacaaaaattagcccagtgtggtggcacacacctgtagtcccagatactcgggaggctgacgtgggaggactgattgagcctgggaggtggaggtggcagtgagctgtgatcgcactactgcactccagcctgggcgacagagtgagattgtgtctcaaaataaataaataaataaaaatagagatggggtcttgctacattgcccaggctggtctcaaactctgggcctcaagccatcttcctgcttcggcctcccaaagtgcttgaagtacaggtgtgagctgccacgcccagcctatatctctttgttcttcttttcccttaatacttatcctttctcaatccatttcctcccttccactttaccatttccacactttattttattttctttatttgtaaagatggggtcttgctatgttgcccaggctggtctcggactcctggcctcaagtgatcctcctgcctctgccgtattttcttttctgtttttccccatcttttcctctctccactccatcagtgtccacttggactcctgcactcctgtctctgatctttcctgctgcctaaactttgttttctagaagggccctggccaggcgtggtggctcatgcctgtaatcccagcactttgggaggcggaggcaggtggatcaccagaggtcaggagtccgagaccagcctggccaacatagcgaaacccgtctctactaaaaatacaaaaaattagctgggcttggtggtgtgcacctgtaatcccaacactcgggaggctgaggcaggagaattgtttgaacctgggaggcggaggttgcagtgagccgagatagcgccactgcactccagcctgggcaacagagtgagactccatctcaataaaaataaataaataaatacgtacataaataaataaggccttaagaagccctggccccaccttcactgaaagccgaccagccctctctgcaacccctcagcatttagcaccgtgtaccgcgcccagcagcttcagtaaatgctggttggctttttatttttcctttctttccctttccttttccatcttgctcgcttccttatattttcttcacctttcacttctttttctcccatttctcctcttctgtttctcataggtctccttggttttttttttgttgttgttgtttgtttgttttttgagacagtctcgctctgtcgcccaggctggagtgcggtgacgcgatctcagctcactgcaacctccgcctcccgggtttaagcgattctcctgcctcagcctcccgagtagctgggattacagatgcccgccaccacgcccggctaatttttgtacttttagtagagacgggatttcgccatgttggccaagctggtctagaacccctgacctcaggtgatccgcccgcctcggtctcccaaagtgctgggattacaggcgtgagccaccgcgccagcccgtgtccttgatttctctttcatcattttcccacttcctttcctttcccttccctcttccttcccggttgtttcctttcttctccttcctcccgcccattcccgccattccagcctcttcgccgccgctcaggatcccaccttcggcaggagtgagcgcgcgccaggcaagactcccttggactcgggcgtgagcacgcacgcgagcgcgctccccacgagtggcagccgcttacattttctttttcgctaccagttgcgtcacctagcgaggtccacgctgattggctgtctgagctgggggccgaggtggtgttgggtgagagggggtttgcctcttgctcctctgtgtcagagccgctgtatctctcgccagtttgcgtgaataggttatgtccagcgggtaaagaaaaggaagaggcaatcgggtgtagtggctcaagcctgtaatcccagcactttgggaggccaaggcgggaggattgcttgaggccaggagttcaagaccagcctgggcaacatcgtgagaccgcccatctcttaaaaaaaaaaaaattagctgggcggactccaggtccgcacctggagtcccagctactcaggaggctgtggcaaaaggattgcttgagcctaggagtttgagacctgtgccactgcactttagcctgggcaacagaaccataccttgtctcaaaaaagaaaaaggaaaaaagaaaaggaacaggctatgactctagtggaccttaagagttagcacccaggccagatgtgatggctcatgtctgtaatcccagcactttgggaagccaaggtgcgtggatcatttgaacctaggagttcaagaccagcctgggcaatgtggtgaaaccctatcttttcaaaaaaaaatgcaaaaattagcagggcgtggtggcgcacacctgtagtcccagctacttaaggaggctgaggcgggaggatcacctgagcccggggaggttgagtctgcagtgaaccatgagagccatgattgcgccactgcactccagactgggcgacagagtgagactgtctcaaaaacaaaaacaaaacaacaacaacaaagagttagcacccaaaggtcaaagttctagttgctgctttggagaaggtgtccgccgcttcccatggcagcgccgggtccttacccagcccaagcatttctaggaaaagttgaagacctcagtcagttgggataggaccacctcagtgctgcctgattctaggctgctgttggggatccccagagacaagtccacagcctcctcagggccctatctctgctgccatcttccctcaattccatccaccccagttccctggccttttgcttcacaggtggctgctacatgctcctggaccccaagaatgcaagacctgggcagaaagctgtcctcctgagccccgtgagcctgtcctctggctgtctgagcttttccttccactacatcctccggggccagtctcctggtgcagccctccacatttatgcttcagtcttgggttagagcggagaattaatgggatttacactgatctgggcgcatctcccagggttggcttgatggggaaacatggggcatccctcagggtctagggaggtctggaatatgtgcgagactattccatgaagtggaaatcatggctgggagggcactttgggaggccgaggcaggcggatcacgaggtcaggagatcgagaccatcctggctaacatggtgaaaccccgtccatactaaaaatacaaaaattagctgcctgtagtcccagctacacgggaggctgaggcaggagaatcgcttgaacccgggaggcggaggttgcagtgagccgagatcgcgccactgcactccggcctggtgacagagcaagactccctctcaaataaaaaagaaagttgtgctggcctggcacagtggcttatgcttgtaatcctagcacgttgggagggtgaggctggtggatcacctgaggtcaggagttcgagaccagcctggccaacatagagaaaccttgtctctactaaaaatacaaaaattagccaggtgtggtggcacacgcctgtaatctcagctactcaagaggctgaggcaggagaatcgcttgaacctgggagacagaagttgcagtgagccaagatagtgccactgcactccagcctgggcaacagagcaatactccatctcaaaaaaaaataatgaataaataaaataaaaaagaagattgtgctttcatttggtggtaatcgtccccagctatgccctctgctcctcatcctcctaggtatagttcaaagtcgtttcccagtccccttaagctcacttctccttccaattcctttcactgcagggagtatccggaaacacactctcttctcaggacaacctgggcccaactggcaggctgtttctgtcaattacacagccgtgggacggatacaggtacagagaagcaaggggtcaggtccttgcacatggtaggcacacccaatgttgaaataaattgaggggcctggtgctgtggctcatgcctgtattcccaatactttgggaggctgaggagggaggatcgcttcaggacaggagttcaagaccagcctgggcaacatagaaagaccccatctctacaaaaaaatacaaaaattaggcgggcacagtgatgtgtgcctgtagtcccagctactagggagcctgaggtgggaggatcacttgagccctggaggtcaaggctgcagtgagctatgatcacaccactgtactccagcctgggcaatagagcaagactctgaaaaaaaaaaaaaaagaaagaaagaactgaattgagggtctgggcacagggagtagggattctgggtcctggaatggagtcgagttagatcaggggcttgggggtgtgggctgtgtgctcactcctgctccatctccctttctctccagtttgccgtggtaggcgtttttggaaagaccccagagccagctgtggcagttgatgcaaccagcattgctccttgtgggggtgagagcaggccctgagaggcccggatctctcagaatccggggtgggctgggggagggctggagagcgtcactcaacttgctca

SEQ ID NO: 138 - DNA, 18561 bp, Homo sapiens
aggaaaatcataggcaaagtctccaagaagaagcaagagtaagactctgaaaaatgtagacatttaaaagcagtcagggaactgaaacaaaagtgtctgtgcacacacacaaacacaaacacaagcacgaacacttgctcagggaaggtgcatccccagaaaaggtttgagaggactcttgagccttcacactacactgaaggttttccacagcacagagccagctcccaaagatggagagacatggctgtttttgcaaacatctaattttcaacaaaaaagaaacacaaggcatgtaaagagacagaggattgacctatttacagaaacaaaatatatctctagaaactgactttaaagaaacacaagccactgaattccttgaagaagctttaaaacaattgtcttaaatgctcaaagaattaaaggagaacacacagagacaactaataaaattaagaaaattatgtattaacaaataaaaatatcaacagatagaaattatttttacaaaaactcacaaagaagttctggggctgaagaatacaataacttaatagaaaaattatttagagaagttcaacagcagagtcaaagaggcagaagaaagaatcagcaaatttgaagacaagttatttgaaattattgaatttgaggaggaaaatgaaaataaagcgaaaaaacctgagacttattagacaaaatagactttaactcaaagactgttacaaaagacaaataaggacattacataatgataaaaggaataatttaacaagaatatagaaccattataaacacacatgtgcctcaaatcagagctccaacatatacgaagcaaatattgactgagttaaagggagaaatggagaggtctttaataatagtaagagacttcatattccactttcagtaataggtagaacaaccatacagaatatcaataagtatacagaggacatggaatacactatacatcaattggaccaaaagacatatgcagaacattccacctgggattagcagagtacacatttatctcaaatacacatgcaacattctcccggataggcctcatacggaagcccacaaaacaagtcttaataaatgttaaaatactgaaactagacaaatatctttttccaactacaatggaataagactagaattcagtagcaaaaggaaaactggaaaatccacaaatatgtggaaattaaacaacacactcttatacaaccaatgggtcagagtaaaaattacaaaggaagttataacatatcttgagaaaatgaaaatgagaacacagcataccaaaatttatgagatgcaaagaaagcagtgctaggagaggaatttatacctataaactcttacattaaaaagaaaaaaaatctcaaatcagtaacctagttttacaccttaagacttaagaaaccaaaagaaaattaaaaaaataaaacaaacaaacaaacaacaacaacaaaaaaaaaaaccgtctgcatcaaagctagtagaaggaatgaggaaataaaaaaagattaggacagaaataaatgaagtgaaaactagaaaaatcaatagtgaaaatcaacaaaaccaaaagtttgttctttgagaagaccacaaaaactgataaacttttcactagcttgaagaagaaaaaagagaagaatcaaagaactaaaataaaaatgagagggaaggcattacaactaacttatagaaataaaaaattataggagaataccatgaacaattgtatgctaaattggataacctagatgaaatggatagatccctagaaacaaatctgaaaagacctataactagcaaagatcaaaactctgccaacagaataaagtgcaggaccagacagcttcactcattaattctaccaaacatttgaagagaaatcaacacaaatcttactcaatgcttccaaaaaattgaagaaatgaggacatttatgaattcgttctctgaggccagcattatcctgatgccaaagccagaaaactacataacaatatctctgatgatattgagggatgataaaaatcctcaacagcatatcaaaaggattatacaccttgactaattgtgaattattcctcaaatagccaaaccaatgctgaagaagaaaaatatagttagagtcacatacttcctgactttaaaacttatcacagacagacatagtggtgcatacctgtagtctcggccactcaggaggcagaggatagaggatcccttgatcccaggagttctagacaagcctgagcaacatagtgagaccttgtctctaaaaaaaaataaaagtaaattaacacaatttattacaacaaagcaaccataatgaaaataatgtgttattggcataaagatagacatataggtcaatgaaatagaatagaagagtagcagagaaacttaaaataaataaaccttcatatatatggtcaaattattctttttttgtccaaaaacaggatcttgctatgttgcccaggcaggactcaaactcctggactcaagcaatcctcctgtctcagcctcccgagtagctggagctataggcacaaactatcatgcctagctgattaaaatgattcttgataagggtgccaataccactcaatggagaaaggacaatcttttcaacaggtggtgttgggaaatttagatatgcacatgcaaaagcatgaagctggaccctcaggttacaccatacacaaaaattaactcattaaggatcaaagacataaacatagagttaaaactacaggctgggcgtggtggctaacccctgtaatcccagcactttgggaagccaaggcaggcagatcacaaggtcaagagatagagaccaggctggccaacatggtgaaaccccatctctactaaaaatacaaaaattagctgtgtatggtggtgcatacctgtagtcccagctacttgggaggctgaggcaggagaatcgcttgaacccgggaggtggaggttgcagtgagccaagatcatgcaactgcactccagcctgcacgacagagcaagactccatctcaaaataaataaataaataaataaactacaaaatttctaaaaggaaacataggaggaaatcttcatgacattggatttgacaatgatttcttaactatgataccaaaagcacaggcaacaaatgtaaaaatagataaattagactacataaacattagaaatgtatgtgaatcagtgaacaaagtcaataccatgaaaaggaaatctttgttatgggagcaaatattagcaaatcgtgtatctggtagtgggttgctatacaaaatatgtaaagaacccccacaattaaacaacaagtaaacaaacaaccttattaaaaatggaaaaaaaaacttgaatagacacttatccaaaagaaatttacaaatagccaaaagacacatgaaagtatgctcaacaccattcataattagattaaattatttaaagtaaaacccacagtaagatatcacttcaaacccgagagaatgactactataaaaaataaagcaaaacaaaacagaaaataacaagtgttggtgaggatgtggaggaattagaacccttgtgcactgttggtgagcatataaaatggtataattactatgaaaaagagcatggtgattcctcaaaaagttaatagaattaacatagggtccagcaattccacttgtgggtatatacaatacaaaaagattgaaagtagagtcttgacagggtacttgtacacccacgttcatagctttattattcacaatagctaaaaggtggaagcaatccaagcattcactgctggatgattatagaagcaaaaggaggcatacacatacaatgtgatattatatggccttaaaaaggtaagaaatttatgcacatgctacaatatgaatgaatcctaaagatatgctaaatcaaataagccagtcacaaaaagacaaacactgtatgattccacttatgtgagatatggggtgtagtccatttcatagaaaaagaaagtaaaatggtgattgccaggggctggggagagggagtaagagagaactgttgtttaatgagcgtagagtttcagtgttgcaagaagacaaaaattctagagattggctacacaacgatgtgatgctatttaacattactaaactgtgcactaaaaaaatgattaagacagtaaattttggattatgtattttaccaatttttttaggaaagtattcactgcaaaaatttaggagagttcaacacagttgcagtatatcaatatattaacaatcataacaacaacagcaataaaaatatttttaaaatatactatttaaatagaatagaattttcttctagactttaatagtattttctcatcactgtaattgtttaaagggttgtagatatggaaagaacaaaacaaagattactaacttaacttgttactggttatagaacacatacaaaaaattattccatttgaattatttctggttagatcgcaatagtattcactcacatcccatgagacggtgaatttttgactacctaaaagagaaaaaccttgacaaataggaaatttcagaaagtcagtgctttgctggacaagatatcttatttgacctaatagctaagccatgatatctcatagccaagattcaagttccaatcttcctaatacaactatgttgctgactcaacacctacatctgagttatgtcagttgagagcttgggtgttgccctgcatgaagacagaggcatggaccagatggtatcccagccctatcatcctagataccaggagttgaacttctgagtagacctgccattgtgacgacctgggaaccaatgtcctgaccactcccccattactaagccctttggaacaatctgagcaggagaacaaatgtcatacccaggagggatggtgtcagacctctcagggtgatgtggcccacacacctcactgagcctgtctcagagtgtgtctcctatgagggtggcctgagtcataaggaatagctgtttataaactgtaaatcaatgctaataccaatgagagcatttaaaagtcattaaatatccattgtgcacatagctctgtgttgaaaaacggaggtaagaagtatgaaacacccaaggcaggccatcaaagcatttactgttatctcattagagtgatatgccacatgaaggataaataaaaaagtgggattgagccacactgtcctggaagggtagaggccacggcatgcactgcagggagaagcataatcaaagtacagaatataatccagttcagtttcagaacatttctgagagtagatgacaaaggcttaaactaaagggagaacacagagtcttatttcactgaaggaatttggacatttacccttatacagtgtgcaatcatgaacaagactttactaatgatttagtgttaattatgtacagggatggaagatgttttcttggatgtcataaaagaacagaatcaaagacacactacagtgtttggagatactacgttatcacaggagtctgggcagctgtaataattgatgctctgagacaggtggtacacacacatatacatctctctcaatatgtatgctctgtatatgtgtttataaatatacatgtatctccaccacgttttggttagggtcaccatgtccattttgacctagatatcattcccaagttctgggcatatccagagtctgtcaggggctgggaagaagaggacttgtccctcatatggtttaatctggcttttcttggtcttcctctgaagaaatagtttaatttgtggataaccttgcagtcatggctgtcttagtgactagtgtgtcctagaatgaacagcagcccatttcattaatatcctaaaaatgtataaattcagaacactccattcatataaatcctgtggacatgtagaaagctagtgattctagtggagagagaggagaggggcttccaaagtagcagcataaacacattcacattaaatattaaggactcttgttcttaaaaggcacccgtccccttatggtccaggacggggttctgccagccatttgaccccacatggaagcgtagacttataatgtctcacaaccatgtctcttttcttcctgtttctcatctgtgaccatcatccggtgctcccagtgtgaacccagaaaagtccaaattctcacaccaatacaaagagcagagctgctgcttcttgtttctctaatgagctgcttccttgttcacatctcagtgctgacacatcaaggaccccaccagaagaaaagggctatttaaaagcaaacagatcaccaaacagccagactcactctcattagaaaaaagctgtgcttcgtttgttaaacaaagatcagtatcttcattctgtattcagcaagttatgaatgtttcacttattcagagcctacaatgtttcagtctctctgtcaggcacattttctcttttttgtgttactttattgactttcacaaccaactaattcttctgtaactaattctttttcatcttccagctttatggtttaaaaaatggtacaggctaaatagtttcaacagtcccatctcgcagggcctggtcctgggccgggttatacttccagggttttacttgtgtagatgtctacactgcacccacagccacacagtttggtggtgcacagggacagaaataaacatgcatggaaacctcagggattagtacttcaacttcaacccaggctgcacggagcatcaggtacttcggaagagacagaaatgagataggtcctaagttctaagactgagaactgagaggctctcagggcaagcagccttcaagtgaatgaggtaggtgatggtaggagtcatcctggaaccccgtttcaagtaggcactttcctacctgggagtggctgccttgagcctggggagagaggcaggtgaggagctgtcagtcaccaaccatcacaagacccacgtgggtgtcagaaggaaggtcctctcatgcccaggccctgtctcacagctggggcagagcccaggccaggataaaagggctcagggccagaccaccccatccactcacctcctgaggtgctaaagaaccctgtgctgcctgtgactccggtaagaacagagcagggatgctcagaacagagcaggagggaaggaggggcagggcctccggggctagggccatgttgtcagaggtggagagtttagaaaagactgaaggggcgggggccaaaaggggtctggcactaactgggagcaggaaggaaaagaggaaaagagctggcgggctgtgccatgtgcctttgaactctagaggaaacaaactgctctgggatgaggtgggtgttccagagtgggaactttgaagcacagagacctgctccactctggcagcccacaggagggaagcccacctctgaagatacaaccctgtctctgcctgcaagggaagaactggagctgtggacatgggactaaagactctttggggtttatgaaccccacattttcatgggtctgagatttgttcacaaacttcccagcttggttaggacacaccaagcctgagacccaccgtgtcatcccatcagcctgagcaggtggtgagtgaggaagtctgagctccaacctgagatcagggggtcagggttcaagtactagtctgcagaaactgctaagtttatctgtctctattgaagtgagtttactgacctagtagtctccaagatcctgcacaatgctgaccttccaaagtaaaatcgtcttgcaaattatgaccagagagaatgactgcttcttctcctttaaaaataattttctcttaaatgactcataaattagacaatttcagtcttaagatatatttgtaataatttcttcctccactgacaacacatcagaatcttagatgcattttgcaatattgtttagtcttagtttacagttgtctgacatccaaagatatcttgaaaaagatgatgtgagattttgaggaaattattggaaataaaactactgaagatgatgcttttaaacttgagaggtgctaagagtgtcacaggggcagaggtggcctctgcctgggtctgacttgttatttgactctccctcagctcctgaacacccaccaccgagatgtcctgccagcagagccagcagcagtgccagccccctcccaagtgcactcccaagtgcactcccaagtgccccgcccctaaatgtccccctaagtgccctccagtctcttcctgctgcagtgtcagctccggaggctgctgtggctccagctctgggggcggctgtggctccaactctgggggctgctgcagctctgggggtggtggctgctgcctgagccaccacaggcgccacaggtcccaccgtcgcagaccccagagctctgactgctgcagccagccctcggggggctccagctgctgcggtgggggcagcagccagcactctggaggctgctgctgaagtggaccttgacttcctcttccttctgattctgcctgaatagctgagaggttccagcaaaagcttgaagtcttgcctggagaatccctctgctctggtgtcaggaaacccaaaatctttctccttaatggcatttagagactttcttctgcagatccatggctgccctgggaactccaaagcacacacctacttcctccccagctcacgctactgtattctgtgctgcctgaactgaagaaataaaatccagaatctgctccccaatttgctaccagcctgcttgattttcctgtttgtgtcatccttgttctgctcccctgtgtctgctggtggctgctgaggccttggtggacagaggatggggaaggggtcaggaggaaaaagcttgcatttctgtgtgttttgtgttttttcttctttctgtgttttccttttaaaccaagggactgaaatagcattgagaaatatttttctttcaaattctggttcctttcacctatgtaaccgcatccctcaggcatggccaggaggccgacttcatcctccttctcactgtcacctcttcactcttgtgttcctcgttccccactccttccactaacaatctccccggactcctccttcagattgtatgtacacgtagtagacatataaatatatgtgtgtgtacatgtatatatatacacacatatttatatatactcacattatatggaataaatctttagtttttaaacttaaatcacttttattgatctataactttcacacaataaaacccctttttaaaataaacaattcaattagttttaccaaatgtatacactcttttgtaaccacaattgcaaggaacactctaaaaatgtagttgattatttattaatcattatttgcagtaaggtttaaaaataggctataagtttatggatttacttctggattttctatttttttttttggttcatacatctgtttttatgccagcactatactgttttggttagtataactttgtagtataatttgaaatcaggtagtatgatgcctccagctttattcttttttactcaggagcactttcgctatttggagtcttctatggttccataaaaatgttaagccttttttttctgttgtattagtcagggttctccagagggacagaactaataggatatatgtatatatgaaaggaagtttattagggagaattggctctcgtggtatttcaacagagattgcattgaacctgtagaccactttgaatactgtagactttttaacaatattaattcttccagttcatgagcctgagacatctttccatttgtttgtgtcttcttctatttcttcatcaatgcttttagctttcattgtagttctttcacttctttggttaaatttatttctggctattttatttttgtggctattataaatgagattgttttcttgatttctttttcagattgatttctataagtgtatagaaacactactgatttttgtatgttgattttgtatcctgccactttactaaatttgtcatttctaagagtttcttggtggagtctttagtttttctaaatctaatatcatgttatctgcaaaaaggataatttgacttcttcctttgaaatctggatgccacttatctcttttccttggctaattactccggttaggacttctaccatatgttgaattaaagtggtgaaagtgggcatccttgtcctatttcatacttagtagaaagcctctccatttttcttcattccgtatagtattaggtgtgggttttatcatgttgaggtatgttccttctacatgcaatgtcttgaaggtttttaaccaccaagagatgttgaattttattgaatgctttttcagcctctattgacaaaacttaagctagaccaagaaaaaaagagagaagccccagaaaaatgaaatcaggtaaaaaatgaaacataataacttgtatcacagcaatataaaggataattagagactgttatgaacaactgtacaccaacaaattggaaaacctggaaaaaaatagataaattactggacaacctactgagattgaaccataaagaaatagagaacctgaacagaccaataatgagtaatgagattaaagcagtaataaaaagtttcccatcaagaaaaagctccagacctgatagattccttactggagtctaccaaacatttaaagaagagctaattctgattctactcaaactatttcaaaaaactgaagaacaccaaatacttctaaactcattctacaaggccagaatcacactgataccaaaccaaacagacacaatagaaaaagaaaactacagaccaatatctctgatgaatatagatgcagaaatcctcaacaaaatactagcaaacagaattcaatactaccctgaaaagattattcaccatgatcaagtgggattcatcccagaaatgcaagaatggttcaacatatgcaaataaatagacataatgcatcacatcagcagaatcaaggattgtcttcttttttaaggctgaataatattccttctgctatatagtatatatattcagaatttttaaaattcattcatccactgacagaaatttaggttgtttccagatcttggttattgctaataatgccgaaataatgctgggagtacagatatctctggaaaatactgattttatttccagaagtggagttagcagatcatgaggtagttttattttctatacttttaggaaattccatacggttttacataatggctgtaccaatttatatttccaccaacagtgtacaagaattccctttttgccacatccttgccaacacgttatatttcatccttctgataatagccactttaacaggcatgaagcgatatctcattgtggttcagatttgcatttccctgatgattagtgagattgagaaactttttctgtatacctgttggacatttgtatgtctgagaaatagctattcagtcttttgctcgtttttaaattgggttgtttggttgttgccattcagttgtatgagttccttcatgtataattattaagagtttgtcaagatgagaaagcaaaacaagatcaccagtttccttggtgctggctctgatgcacagagataaaaatataactctgcttaaagtattatatttccagttagatctcaataatgtttccttccatcccatgttatgataaaatgttgatgatgtaaaagataaatgccttgaccctcagaaaagtcagtgctttgctgatcaacatgtctgtattgacctgatagctaggctgtgatttctcaaagccaagacttaatttccagtcttcctgatacaactatgttgctgactcatcacctacatctgagttacgtcagttgagggcttggggttgccctgcatgaaggcagaggcatggaccagatggcatcccagacccatcatcctagataccaggagttgaacttctgagtatacctgccattgtgacaacctgggaaccaatgtcctgaccactgccccattactaagccttttggaacaatctgagcaggagaacaaatgtcatacccaagaaagacggtgtcagacctctcaaggtgatgtggctcacacacctcactgagcctgtctcagagtgtgtctcctataaggatggcctgagtcataaggaatagctgtttataaactgtaaagtcaatgctgttaccaatgagaggatttaaaagtcattaaatatccattgtgtgcatagctctgtgttgaatattgaggtaaagaaatataaaacactcaaggcaggccatcaaataatttactattatctcattagagtgatatgccacaggaagggaaaaaaaaagtgggattgagccacgctgtcctggaagggcagagaccatggcttgcatcacagagagaagcataatcaaagtacaaaaaaataatccagttcagcttcaggtcatttctgagagtacatgacaaaggcttaaatgcgagggagcacacaaagtcttatttcactgcaggaatttggacatttacccttaaacagtgtgcagtcctgaacaagactttactaatgattgagtgttaattatttatggagatgagagagtcttttcctgaatctcacactggaacagtatcaaggaggcccttttatcctggtcttgggctgtgctcctgatgggtgaggcagcacctgggcataagaggaccttacaacatgggttgtatgaccaggtgataaccagcagcttctcacctgcctccctccacaggagatcagaatagctcccatcagtgccacctcatttttcttggagctgccttaggcctttttcttggagtttggcctcccaagtcctctttttctatatccctgatggtatcatttaaaccaaaattttacagaagtcttttaatgtccctgatgtgtcccagattctgtgtgtgtgtgtgtgtgtacgcatgtgtgtgtaaatacatgtctatgccatcacagttacaagcctggtaggagtcagacatatctgggacagaatcctggttctgtcacttattagctgtgtgacttctgaaaatcccaaattatctcatcctccgtttcctgaaatttaaaatgaagataataaagattagtctccaggatgtcgtgaggatcaatgaaattgtagaaagaaaatgcacattaaagttcctgtaacacagtgaaccctcatatgaaacacctgtctatcaataattttaaagggaatgaacactttttgagatggtccaagtctcgggcactatgtggagtgaaggaaaagagttccctagtggaggaggctggaagacctgaaaaaataggaggacttgaaatacaatgggaaacttttagtgttattgctttgtttcaacatgaacaaaagtttttgtctgaaggtctatttaaaaacatttttaggagattaagatttactaatgtcaatttggtatataacaggtgttccttttgtatcttgaggaaaatattatttaaaaagtaaaagaactaattagatgaaagcaaattagactagggagtaatcatgtgaaaaagttctcttttcaggaagtgtccaaaacaattctccagaacgtgtgatgaggtagaaatggccacaataataccaatatccaggtcataatgggtatagagaatcaatatctgagatatgtatatgaacataggcatagatagatatagaagtagattatatagatatggatatataatcggccttgttctattattacagtatcatatatctcaagatgcatggccttccctgaagttacaatgccttacttctctagggtttctccatgattctaattttcactggaatctgaaaatgatctttccacaccatcccgcactccagaaataattacccctgaccattaagaaaatctcatccagagctctgcactgtgttcaggatcaaggtcaatgtccattgagtgacattcaaggctctgtgcataagaccctgtacaattcctctaatttatgctttgctaagcaggactgcctattagctatactttgaagatgtctcttcctactttacctctatgttttattccaatatttttttttctctctgagacactgcagttcaaatctcacttgctccattttccttttttttttttttgacatacctcatgaatcaggttttaacaaaactttggacagcacaatttgtgacttatattgtgtagtccccatcagctactagtacaaggtcatggccacatgggtggttaaaactttttaaatcctgtcagcagcattagtgctggggtttcatggaaggtatgaatggtaagacttagaaaagaagttggaaacactttctgttaagtcttaaatgtaatacttaagaagcacatgcatttttctatagagagtcatgggcaagttgagaaatatggtacagggagtgtgttctggaataaagtgtagataatttaatgaagatggagaaggaagaaagcaacaagatttgatggaaggttaatagaaaagcaatttttacttgcaaatgtgcctggaactaaacttattgcagaagtagtcagtgggaaaactgtattttcaaaatatattcatgggttttgttcttttttatttcatttgtttacttattatatttttctttttttatccatttatatacatgcatgtgtgtgcatgtttgtgtgtgcacctggagatgtgcagaagtgtgtgtttttgcatgtgatgtgtgtgagggaggaaggatattggtggggctaggtcaggaggagcagactgcactcacagagaaagagaagcttggagagactggtcaagcccttgaaagggaccagaaacaaagaagctatgtttataagagacagttcagacttggtcagaagcaatgctgcttcaggccagttgacataggacagacagagttgggagcaatggtcccttcccactcctgcccccattaaccccaattcactccagagtgccccactgtcccctgaggttccaaggccaccaactgcagaggacaaggtgaagagaacaagagccactcaaggagaatagggtcctcatagaacaagacactgagcagattccttgttttagtcctttaatcagcagatgcacgctgcaaatgacattgagtaagctaggggcttagacagagcgtgggagggtagccacaaaggtgaggtccaaggccagtgaatggagatccaggagaggatctgagtttctggactccagggaaaagatatgctcttggcaagttcagagctttcccttggacctgtgagcctctcaggcaggcctagtaggagaagggggatgtccttggcagtttgcggtcctggattctgctcttctaggctcagggtccacttcagcagcagcctccagagtgctggccactccccccgccacagcagctggagccccccgagggctggctgcagcagccagagctctggggtctgtggcagtgggacctacggcgcctgtggtggctcaggcagcagccacctcccccagaactgcagcatcccccagagctggagccacagctgcccccagagctggagccacagcagcctccggagctgacactgcagcaggaagagacaggagggcacttagggggacactttgggggacactttggggtggggcacttgggagggcacttgggggtgcacttgggagggggctggcactgctgctggctctgctggcaggacatcttggtggcggattcaggagctgaaagagagtcaaacagcaagtcagacctaggcagaggccacccctgcctattcttgtcctttccacattgtttctatttcctttattttgatgaactgttcaaatgtcatggtaaatcattaatcactgaaaattttgttgtttcttgtagtttggcaaatgctctcacactgtatcttttgagttcacaatttcatcttaagacagtcaagaattactatatcttttacaaagaaggaaactgaggcagtaagccatatgaaaaaatatctgtcaagattaaacatttagtaaattaaaggaagcagtttttctcattgtgtcaaataaaaccctgaaactgtccagtgtggaaacctggggatataaacattttcttggaaaaagataatgaaggattatctcttggagtaacttcctaggagactttgtcttgtaaaaacctgcgcatgtacaattgtaaatggttttggagacaggctggtctcacaggctccctttgttaaggaagatgctggagaacagtatttttggtgcatagaggggatctgaactcaggtgccctggctctaggctggtgcactgccatattcatcacgcaacggcctcacagtaacatgttggcacagtgatcctcagcttgctatgtctaactactttaagagattctcaattccaatttgaatctagagataagtgagtttcaaaaagccctaaaagatccattaattatctctactccactgattgagaactactatctccagctcaaatttgcaaggagtgtcacagttttgctctgaaaagtaagtgtcctatttgaagttgttctagcagagtctatttgcctgggcttcaactccctctgtccttaaaactcaactagctgaagcacaaagacagagacatctaattcttatttgtgttaccagttggccctctccctgcctcctgagcacatcctccttcaatctttctgaggtcttgacttctatccagatggatctcagccctcaaggtcctgcccagcctcccctcctgcctagggctgagcaacactctgtggaagccccagcaactattctcaaagaacacttaccggggtcacaggcagcacagggtccttcagcacctcgggaggtgagtggatggagtgctcaggcccagagcccttttatcctggcctgggctctgcctccagctgtgagacagggcctgggcatgagaggacctgccttctgacacccacatgggttctgaggtgggtggtgactggcagctcctcacttgccttcctccatggggctcagaaaagctgctcccagcttggactatggccacttagaaatagaaatggagtgggaaaatccctaccatcatttcctgtgttgttctccgtggagaatacctaatctgtttagtcttggagcttgagttctctgttttgttaactcccaaatcttacctctgtggctctgggcaacctggcttaactcaagtttcatagaatcctccaaccctcaactatcttatagttgtgtgtgtgtgtgtgtgtgagtgtgagagagagagagagagtgtgtgtgtgtgtgtgtgtgtgtgtgtgcgtgtgcttctgtattaaagccattaggtaactggttaaagagtcagacatagagagaaacctgattctgccacttattacctgcatgaccttatgaaaagcattaatacctcatcgttcttgttctcagtttgtcaactctgtaatagagataatataaaaacaattgtccagggatggctgagagtcaatgaaataatgcaaaggaagtttctggtggagagcttataacatgtcattttctctaaacaaatgccaatgcattaatatttttaaattatagctgctttctaaggagagataatagcctccagctccatccatgtttcttcaaaggacatgatcttattcttttttatggctgcatactattccatggtatatgtgtaccacattttctttatctagtctaccattgatgggtatttgggttgattccatgtctttgctattgtgaatagtgctggagtgaacatacacattcatatgtcattatgatagaacaatttatattcatttggataacgctccttcttcaacatccaggctttattccgtgacctatgcatttctaaaacagtgccattcaactgtaacttctttatgagtcttaattttcaaatatgactacagtaaactatccttgattctgcagctttgttcttatatttatgtacccctcaacagtttctacaacagaggtggactccataggtaagcaatttaaaaatgaattgattactattagcatcatctttactttgtgtatgacttaagccatcatcattggaattctcactctgagacatttacattacagtatactagccttatcaccctgcagaagtctgccactgaattacctggctatggctcatgttgttccaaagaatgtatttaataatagagtagtcaagatattgattactcagcttacattggcagttctgatccagaagcccagcccattcattccaaggatgatgaggattagaagctattctgtccatgactctgataccacaaagggtagcacccaaactgtcaattaat

SEQ ID NO: 139 - DNA, 21009 bp, Homo sapiens
ggaactttcctctgaactgtgatcatggttataattaacaacacattcaatctgtggcatctgcatgctgcgattctcacccgaactccacgaagcaggaatacaatgagtatcatccccatttgtcagatggggaactaagttctgctggaaagtgacagagccaacacttttgactttctggtggggacaggagccagcaaagcctagttctgagtcaaggggttacataattgtttaaagatgatgccttctgtttgtagagagcttggctatttacatgaaaagcatgtgatttcctggcatgcttttcatttgctctcctaacgccaagaggaaggcagggatgatggagggtccccattttgcagaggaggaaactgaggcccaaagagattatgggccttgcccaggtcataaaacacggagatggggctggacgaagtggctcatactagtaatcccagcactttgggagactgaggcaggaggagggcttgagcacaagagttccagactggccccagaaacatagggagaccctgtctctaaaaaaaattttaaagcagtggggcatgatggtgtgcacctgtaggcccagcagaagcaggagggatcacttgaacccagggatttgagactgcattgagctatgattgcagcgctgcactccagccagggtgacagagcaagaccctggctcaaaagagagaaaaaaaaaaagtccgggtgtggtagctcaagtctgtaatccctgcactttgggaggccaaggtgggtggatcacttgaggtcaggaatttgagaccagcctggccaacatggtgaaaccccatctctactaaaattacaaacattagccaggtgtggtggtgcatgcctgtaatcccagctacttgggaggcagaggcacgaggattgcttgaacctgggaggcagaggttgcagtgagctgagagatcgagtcactgcactccatcttgagcaacaagagcgagactccgtctcaaaaagaaaaaaaaaagagagagagagagagtcccttttctctctgacccaggatcaccagggagaggaaagagaagagatggagtgaatgagacagctgtggtcagcaaggcgtgtccatcttccacgaccgactccttcccattcaatcccctgccttgggatcctgcttcttccctgcataggcagaaagtacctaccaacttcccttcttcccaactccctgctctgagtactgcgctaggagccaactcagccacctcctgcagccccagctctccatcttaactgcagcctctcgctcttgggtactcactgactcaaatcctccctctgggcccaagcatcaggctgaacaaagacctgtccctagttcacaggtcacctaggattctttttttttttctttgagatggggtttcgctcttgttgcccaggctggagtgcaatggcgcgatctcagctcactgcaaactttgcctcccgggttcaaatgattctcctgcctcagcctcctgagtagctgggattacaggcatgtgccaccacacctggttaattttgtatttttagtacagacagggtttctccgtgttggtcaggctggtctcgaaccccgacctcaggtgatccacctgcctcaacctcccaaagtgctgggattacaggcgtgagccactgtgcctggccagtcacctagggttctgctggaactactgaactgtagttcagtaggtgatcttaccacagtagggtttgttgctggagttgcattagctaaacagggtcttttagacactggaatctaagctgaaggctaataatattatttgaagatggtgaaagttaattctactaaaattccatcataaaactgtggcattgtgaaggattgttggcaacaaataaatagacgatagtatagtttctcaatttatgggagtcatggccaaatgtctctaaactcccttctttatttaagaaaattgattattaaaaatggccagtggttcacgcctgtaatcccaacactttggggggccaaggtgggcggatcacctgaggtcaggagttcgagaccagcctgaccaacatggtgaaatcccgtctctactaaaaataaaaaattagctgggtgtggtggtgcatgcctgtaatcccagctagttggaaggttgaggcaggagaattgcttgaacctgggaggcggaggttgcagtgagccaagatcgtaccattgcactccagcctgggcaacaagggcaaaacaagataaaaaaaaaattacgtgaccgggcgcggtgatgtacacttgtaataccagcactgtgggaggccaaggtgagaggatcacttgaggctggtagtttgagaccagcctagtcaacatagtgagatccctgtttctataaaaaatttgctgggctactaaaaaatagactgtagttccaactacttgggaggctgaggttgtagtgagctatgattgagccactgaactctaacctgggtgatagagcaagacactgtctcaaaaaaaaaagtgactgccacacataaatttctttcttttattattattattattattattttttgagacagagtctcactctgtcacccaggctggagtgcagtggtgcgatctcggctcactgcaacctacccctcctgggttcaagagattctcctgcctcagcctcctgagtagctgggactacaggtgcgcaccaccatgcccagctaattttgtatttttagtacatacggggtttcaccatgttggccaggctgatcttgaactcctggcctcaggtgatctgcccaccttggcctcccaaagtgttgggattataggtgtgagccactgcacccagccaacatcatagatttctggctttaaaaaaatcttggctgtactgattgagcctcctccccaatcttacagaggaaggaactaagacacagagagggtgagaaaagttcccaaagacacacagcaaatttaggactgggctccagttctctcaagggcttttccacagcccaaggtctctcacacctgttcccacagctgccagtcttgtcaaggttgccagtctctggggcgttgctggttcctggctccctaaaatacagggcccaagggtcctcccccactttcctgtcctgccgtgagccccccacccccacttccagacggattgggagctgtgacccccagctctgtggtcccaaagggaggtcagctaaagcagctaccaggggacttattgcccaacagggagtggctatgatcaatgtcttctgctcctcttccctgggttaaccatttcctggccctggcccctctgttaattcctctgctaacctggtatggaggaagggtggacaagggcttgggatggacaccattgatatccccaggtctgacataaacaggcaggggggtgctctcagtcctcagatgtgatccctgcctgagctctgttggcattccatggcgaggctcttcagcctcatttgggcagaagcggtcctggggattgcaaaagggctttctttttcttttatttatttctttttagaaacagagtctccttgtgttgcccaggctggagtgcaatggtacaatcatagctcactgcagccttgaactcctgggctcaggcgaccctcccgcctcagccttctttgtaactggaactacaggtgtgcaccaccatgcttagataatttttgtattttttgtgtagagggtgggttctcgctatgttgcccaagctggtctcgaactcctgggctcaagcaatcctcctaccttggcctcccaaagttctgggattacaggcacaagccaccgcgcccggccatttcttttcttttcttttcttttcttttcttttcttttcttttcttttctttttgagacagatttttgctcttgttgcccaggctggagtgcaatggcgcgatcttggctcactgcaacctctgcctcccaggttcaagcaattctcctgcctcagcctcccgagtagctgggagtacaggcatgcaccaccatgcccaactaattttttgtatttagtagagatggagtttcaccatgttagttaggctagtcttgaactcctgacctcaagtgatctgtcaacctcggcttcccaaagtgctgggattacaggcatgagccaccgtgcccggcctccggccatttcttaatatgatccaattacatacctactgataaatatttatcataacttttcctattgtaaacaatgttgcaattaatatctttgggtatccgcaaatttgtgcaaagtgcatgtatttctgtagcaagtttcctagaaatgttaggtcaaagatatgcacatttgaaagttcaacagtcattgtcaaatgccttctaagaagttttctggccaggcactgtggctcacacctgtaatcccaacactatgggaggccaaggtgggtggatcacctgaggtcagaagttcgagaccagcctgaccaacatgatggaaccccatctccactaaaaatacaaaattagccgggtgtgatggcacatgcctgttaatcccagctacttgggaggctgaggcaagagaattgcttgaactcgggaggtggaggtttgcagtgagctgagattgtgccattgctctctaggctgggttgactcctcccccaaaacaaacaaacaaaccaaaaaacaaatgccttctaagaagttttcaccggctgggcacagtggctcatgtttgtaatctcagcactttgggaggctgaggcaagcggatcactggagcccaggagtttgagaccagcctgggcaacatagtgagaccctatctctacaatacaagcaagcaaaaaaaacaaacagaaattagctaggcatggtggcttgtgcctgtaatcccagacaccccgggaggctgaggtgggagaactgcttgagcctgggaggttgagactgcagtaagctgtgacggcaccactgcactccagcctgggcaacagagtgagacgctgtctcaaaaaaaaaaaaaaagttttcaccaacattctttttttgttttgttttgagacagggtctcgctctgttgctctggctggagtacagtggcttgatcatagctcactgcagccttgaacgcgtaagtcctcccgcctcaacctcacaaccagctgggacctacaggcacatactgccatgcttggttaatttttaaattttttgtagagacagggtctcactgttttgcccaggctggtctctagcctcaagcggtcctaccatctcggcctccaaaaagcacttgggattaccagcatgagccactgcacctggccaccaacctacagtcttatcatcactgagttcgtatctacctgcatcctgtccaatactccgtactaccaatctttcaaatttttgtcggctgggcacagtggctcatgcctgtaattccagcactttggaaggccaaggcaggcagactgcttgagcccaggagtttaagaccagcccgggagacatggcaaaaccccatttctgcaaaatatacaaaaattagctgggcttggtggcatgcactggtagtcccagctactccagaggctaagatgggaagatcacctgaccccgggggtttgaggctgtaatgagccaagtcatgctgctgcgctccagcctgggtgacagaacgaggccctgtctcaaaaaaaagaaaaaaaaatttttttttggtcaatataagagtcatagttttgattagcatttcccttattactagtgaagcagaacagcttttcaaatgtttgctgcctgtttgtatctcttcctctgtgacttatctttctccgtgatttgccagtaggcatttgcagtcctttttttcttttttttttgacttggagtctcgcgatctcggctcactacaacctccgcctaccaagttcaagtgattcttgcgcctcagcctcctgagtagctgggattatgagcatgtgccaccacccctagctaattttttgtatttttagtagagatggggttttgccatgttggccaggctggtctcgaactcctgacctcaagtgatccacccgccttggcctcccaaatgctgggattacaggtgtgagccaccacgtccagccgtttgcagtccttccttcacctaactctccagttgccactgttgccagttatagaattttaggtttgaaatggttttctgttggaattctgcagacaatgttccactggctcttagactccatggttgctattgaaaagctggatgccatgttgatttctgatccttggtatatgacttgttattttctatctgaaagtgtttcagatcttctcttcacccctgatagtctgaagtccagtgcttccatgggtctctatgctttcatcaccctggacacctttttaatctagagacttgtatatttcagttctggatattttcttgtgcgtttttctttttaaaataataatttcttttcctttgttctctctttttgaactcctttcgtttgaggttagacttcctggattgatcctccaaacctgtttcctttttgtttctttctctttttttttctcttctctctagtttatttccctcgatttcaatctacgatgcttctactggatggtaactttcaactctcataattttaatttcccagagcttttctgtgtttctctgttcattcttcatggcatccttggaaggatgccaagctaaggaggccaggggggaataaaaggagtccaggctcccaactgtgcccttcccctctcccctgggagcaaccacttagggtcctcatggttcctccagtctggactctgctgcttctggtgggggctgcccttttcaggtaagctgggcccagggggtaatgataaaccagggtcagctgagggtggctgtaaggaatatggaaggacagagctggagggggcgagcaggctaactacaaaagatctggagagaggccaggcacggtggctcacgcctgtaatcccagcactttgggaggctgaggtgggcagatcacgaggtcaggagatcgagaccatcctggccaacatggtgaaacctcgtctctactaaaaatacaaaaaattagccaggcgtggtggtgtgcacctgtagtcccagctacccaggaggctgaggcaggagaatcgcttgaacctgggaggcggagtttgcagtgagctgagatcatgccattgcactccagcctggatgacagagcgagactccgtctcaaaaaaaaaaaaacaaaaaaaaagaccttgagaggaagggggaaacccggtgggatggaaatgggttgaccttgactgctgaacaggaattaaggggcgggttctgggagcgggacagggctacaatgtgagaagggacggaggaggtgcagagctggaagacagatctaagcctaggagagaaggattgaggggtcaggccctcaggaaacggacaagacccagggtggacccagctgatgagagagacttaagtacgaggcagcaaagaaatgacggatgacaggccaagcgcggcggctcacccctgtaatcccagcactttgggaggccgaggcgggcggatcacctgaggtcaggtgttgagaccagcctgaccaacatggtgaaaccctgtctctactaaaaatataaaattagccaggcatggtggtgcatgcctgtaatcccagctacttgggaggctgaggcaggagagtcacttgaacccgggaggcggagactgcagtgagcggaaattgcaccattgcactccagcctgggcaacaagagcaaaactccatctcaaaagaaaaaaaaaaagaaatgatggatgtcttggtgtcctgcagtgtgtttgggagaatttgaacaagtagaacttcaacaacaacaaaaaacagagggctgagcacagtggctcccaccggtaatcccagcactttgggaggccaaagtgggaggattgcataaggccaggaggtcatgaccagcctgtgcaacatagaaagaccccatctctataaaaaataaaaataaattagctgggcgtggtggcatgctcctgtagtcccagctactggggaggttgaggtgggaggattgctggagcccagaggtttgaggctgcagtgagctgtgattgtatcactgcactctagcctgggtgccggaaaaaaaaaaaaagaaaagaaaaaaagaaaaaaagtcaagtcagacacattcactgcataaacactgatcatccttacgtgaccactcagaaagctcacagtcactgaatcttataattcttgataatgacacgagttgcatttttgctttcttcaaacgacccccaaggaaagagaagcctccggaccagaagctggttgttcgcagctctagggacaactgtgagttggaaaccaggagtgctaagatttctcctccctcctccgaacccacattctgccaccagaatgccagttcctgagttcctagcaggagcagccacctccagtcccctccgggcatcagccaggactacaaaatgtgtcctgccaggccaagtccagccctccaacctcagttcatgaccccggaccttgtcattctgtccactctcccagccccgaatttctcctaaaagattctctctttcaaatctctgctctgggccgggtgctgtggctcacacctgtcatcccaacacttagggaggccaaggtgggaggatggcttgaggccaggagtttgagagcagcctgggcaacatagtaagactccatctccacaaaaaacagacgagcaatttctgctctggaccccaaggctttgcaacagctttctttttcttttctttgagacggagtctccctctgtccctcaggctggagtgcagtggcgcgatcttggctcactgcaaagtccgcctcctgggttcaagcgattctcttgcctcagcctccccagtagctgggactacaggtgtgcgccaccacacccggctgatttcatggcagctttctctaagtgtagcaatcttgctacttccctctccctgtgtggctctgggccctgcccctgccctctctgaaacctcactgtgacccattcttcctagatgtcctcacccagtgtgattttgaggatgacgccaaacccctctgtgactggtcccaagtgtccgcagacgatgaagactgggttcgagccagtgggccctctcccaccggctccaccggggcccccggggggtaccctaacggaggtgaggggctatggtttccaggggaccatgagcagggaggtggctgggaggcgggagtggctagatggagagagaagggaggcagccagacctggatgcctgggctctgagaaggggatgggtgggggcagccctcagaggtggctgggcctcagtgtcttgggctctgcctcccccagagggcagctatctgcatatggaatcgaacagcttccaccgtgggggagtggcccgcctgctcagccccgacctatgggagcaaggccccctctgtgtgcactttgcccaccacatgttcgggctgtcttggggcgcccagctcaggctgctgctgctctcgggtgaagagggccgccgccccgatgtgctctggaaacactggaacacccagagaccctcctggatgctcaccaccgtcactgtgcccgcagggttcaccctgcccacccgggtaaggccggggacaaattgtgggacctcgggggggagtctgggtgttggagagcctgagggtgggggtgtggcaaaaagggattgtgggggccaagccatctgaattcaggaagaaaactaggagccaggaggcctggctgaggggctcatggggttggggtccccttatcctcttgcagctgatgtttgagggaacacggggtagcactgcctacctggacatcgccctggatgccctctctatccgccggggctcctgtaatcgcggtgagtccctgtccctcctcccgcctgccctcggacccttttctctccgtccttgcacaacaagaagaggatccagggcgggcgcggtggctcatgcctgtaatcccagcactttgggaggccgaggcgggcggatcacgaggtcaagagatagagacctttctggttaacacggtgaagccccgtctctactaaaaatacaaaaaattagccgggcgcggtggcgggcgcctgtagtcccagctacttgggaggctgaggcaggagaatggcatgaacctgggaggtggagcttgcagtgagccgagatcgtgccactgcactccagccttggcgatggagtgagactccgtctcaaaaaaaaaaaaagaagaatgagaaaggagatgaggagctggctgtattgggtctgccaggtagagctattagggctttgactctggaagcagccgtgcctaaagagaggtctcggcccagcacagtggctcaggcctgtaatcccagcaccttgggaggccaaggtgggaggatggtgtgaggccaggagtttgagatcagcctgggcaacataaggagacccccatctctacaaaagaatttatttatttatttatttatttatttgagacggaatttcactcttgtcacccaggctggagtgtagtggcacgatctcggctcactgcaacttctgcctcttgggttcaaatgattctcctgcctcagtctcccaagtagctgggattacaggtgcccaccaccatgcctggctaatttttgtatgtttagtagagccggggtttcattgtgttggcaaggctgttctagaactcctgacctcaggtgatccactcacctcagcctcccaaaatgctgggattacaggagttaagtcaccgtgccaagaactttttaaaaattagctcggcatggtggcgcacacctgtagtcctagctacttgagaggttgaggtgggaggaccgcttgagtccaggagttcgaggccgcagtgagctatgatcacaccactgtactctagcctgggtgacagagaccctgtctctaaaaaagaagaaaacattatatcttcccttctttctttcctctcagtctgtatgatgcaaacatgcagctttgacattccaaatgacctctgtgactggacctggatcccaactgcctccggggccaagtggactcagaagaaagggtcatcaggaaagccaggcgtggggcctgatggcgacttctctagccctggtagtgagtagcggccatgcttctgtcccttgactttctgggcaccaagcaccctacgataattgccctgggacggtctgtcatgaacacctacagcttcaagcctcttaccagctcaagtttcacgcaagaagctgatttcaagcacccagccagcctcccccaccaccgccctacaagctctacctggcagacccaatacagccagctcctcatctcctttctgtggctcttcttcttcttctttctcttcctcttcttcttctccctctccctctccctctccctctccctctccctctccctctccctctccctctccctctccctctccctctccctctccctctccctctccctctccctctccctctccctctccttctccttctccttcttctttttctttttttttttttgaagcagagtctcgttctgtcacccagtctggagtgcagtggcgtgatctctgctcactgcaacctctgcctcctgggtttaagcaattctcctgcctcaacctcccaagtagctgagactgcaggcgtgcaccaccatgcccggctaatttttgtatttttggtacagacagggtttcaccatgttggccaggctggtctcgaactccggacctcaagtggtccacctgcctcagcctcccaaatgctgggattacagcgtgagccattgcttctggcccctttcattcttcattcattcaagaaatactgagcacctacaatatgccaggtgctgtcctaggcacttaaaatacaccagtgcagaaaacagacaaggaagagtagggtgtggtagcgggggggcagttaccgacacaaagtaaatatagttataaagtgagcgatgctactgggaaaataaaaagtcaaacaagtttggagccaagtgcactggctcacgcctgtaatcccagcgctttgggaagctgagacgggaggatcacctcaagtgatctgcccactttggcctcccaaagtgctgggattacaggcgtgagccactgtgccccgccgtgagttatcaattatttatttatttattttggagacagagtctcgccctgtctcccaggctggagtgcagtggctctatctcggctcactgcaagctccgctgcccaggttcaattgattctcctacctcagcctcctaagtaactgggactacaggtgtacaccaccacgcccagctaatttttgtgtttttagtagagacggggtttcaccacgttggccaggctggtcttgaactgctgacctcaggtgatccggccacctcggcctcccaaagtgctgggattataggcgttgagccactgtgcctgggcgagttaccgattttaaataggctggtcagagtaggtcacattcaggacacatttgagcacgaacttgaaaaaggtgaggtagtagcagaggacattccaggctgaggggccagctgtgcaaaggtcctgaggtagcagtggggctgtcggggaaggaggggatcaaggcacagcaaagagccatgtggccagcatgaagagggtgacctgagatccacaggagcggcagatcacatagagccttgaaggccattgtcaggactgtggctttcctattctgtgtgaatggggagcctttgcaggattttgagcagtgacttgatctgacttatttatttttttttttttaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcccgcctttctattccacaaagccgccattgtcatcctggcccgttctcaatgagctgttgggcacacctcccagacggggtggtggccgggcagaggggctcctcacttcccagtaggggcggccgggcagaggcgcccctcacctcctgggcggggcggctggccgggcggggggctgaccccccccacctccctcccggatggggcggctggccggtcggggggctgaccccccacctccctcccggacggggcggctggccaggcagaggggctcctcacttcccagtaggggcggccgggcagaggcgcccctcacctcccggacggggcggctggccgggcaggggggctgacccccccacctccctcccggacggggcggctggccgggcggggggctgacccccccacctccctcgcggacggggcagctggccgggcagaggggctcctcacttcccagtaggggcggccgggcagaggcgcccctcacctcccggacggggcggctggccgggcaggggggctgaccccccccacctccctcccggacggggcggctggccgggcaggggggctgaccccccccacctccctcccggacggggcggctggccgggcggggggctgacccccccacctccctcgcggacggggcggctggccgggcagaggggctcctcacttcccagtaggggtggccgggcagaggcgcccctcacctcccggatggggcggctggccgggcaggggggctgaccccccccacctccctcccggacggggcggctggccgggcggggggccgacacccccacctccctcccggacggggcggctggccgggcggggggccgacccccccacctccctcccggacggggcggctggccgggcagaggggctcctctcttcccagtaggggcggccgggcagaggcgcccctcacctcccagacggggcggctggccgggcggagggctgacccccccacctccctcccggacggggcggctggccgggcagaggggctcctcacttcccagtaggggcggccgggcagaggcgcccctcacctcccggaccgggcggctggccgggcggggggctgacccccccacctccctcccggatggcacggctggccgggcggggggctgaccccccacctccctcccggatggggcggctggccgggcggggggctgaccccccctcacctccctcccggacggggtggctgccgggcggagatgctcctcacttcccagatggggtggctgctgggcggagaggctcctcacttctcagacggggcagctgccgggcggaggggctcctcacttctcagacggggtggttgccaggcagagggtctcctcacttctcagacggggcggccgggcagagacgctcctcacctcccagacggggtctcggccgggcagaagcgctcctcacatcccagatggggcggtggggcagaggtgctccccacatctcagacgatgggcggccgggcagagacgctcctcacttcctagatgtgatggcggctgggaagaggcgctcctcacttcctagatgggatggcggccgggcggagacgctcctcacttcccagactgggcggccgggcagaggggctcctcacatcccagacgatgggcggccaggcagagacactcctcacttcccagacggggtggcggccgggcagaggctgcaatctcggcactttgggaggccaaggcaggcggctgggaggtggaggttgtagtgagccgagatcacgccactgcactccagcctgggcaccattgagcactgagtgaacgagactccgtctgcaatcccggcacctcgggaggccgaggttggcggatcactcgcggttaggggctggagacccgcccggccaacacagcgaaaccccgtctccaccaaaaccagtcaggcgtggcggcgcgtgcctgcaatcgcaggcactcggcaggctgaggcaggagaatcaggcagggaggttgcagtgagccgagatggcagcagtacagtccagcttcggctccgcatgagagggagaccgtggggagagggagacggagacggagacgagggagagggagggggagggggacggggacgatctgacttattttttaaggattttttttgtgttgagaatccactgaggagaacaggcaagggtcgatgcagagaggctgtttaggaggcttttgcaaaaatccaggcgacactctttctttttctttctttttttttttttgagacagaatcttgctgttgccaggctggagtgcaatggcacgatctcagctcactgcaacctctgccttccgggttcaagcgattctcctgcctcagcctcccgagtagctgggattacaggtgtgcgtcaccatgcccagttaattttttgtatttttagtagagatggggtttcaccatgttggtcagggtggtctcgatcttctgacctcgtgatccacccacttggcctcccaaaatgctgggattacaagcgtaagccaccatgcctggctgatattctttctttctatgcacccaagtctatccctagcttctttccaccacctccctgtgcactcagctgagcttctttctctttctactgttgacttcttccttttctctctcacacaacattcactttctctcttaatcttctcacacagcccacatttcaacccctcactgagccaagcactgtaggtcaagcatagagggttctgctccctaatttcctgagtttataattcttatttttgaatttaaaaaaatgtttttaaaaactaggccaggtgcagtagctcatgcctgtaatcccagcactttgggaggccgaggtgggcagatcacttgaggccacgagttcaagaccagcctggaacatatagtgagatcttgtctctacaaaaaatacaaaaattagcccagtgtggtggcacacacctgtagtcccagatactcgggaggctgacgtgggaggactgattgagcctgggaggtggaggtggcagtgagctgtgatcgcactactgcactccagcctgggcgacagagtgagattgtgtctcaaaataaataaataaataaaaatagagatggggtcttgctacattgcccaggctggtctcaaactctgggcctcaagccatcttcctgcttcggcctcccaaagtgcttgaagtacaggtgtgagctgccacgcccagcctatatctctttgttcttcttttcccttaatacttatcctttctcaatccatttcctcccttccactttaccatttccacactttattttattttctttatttgtaaagatggggtcttgctatgttgcccaggctggtctcggactcctggcctcaagtgatcctcctgcctctgccgtattttcttttctgtttttccccatcttttcctctctccactccatcagtgtccacttggactcctgcactcctgtctctgatctttcctgctgcctaaactttgttttctagaagggccctggccaggcgtggtggctcatgcctgtaatcccagcactttgggaggcggaggcaggtggatcaccagaggtcaggagtccgagaccagcctggccaacatagcgaaacccgtctctactaaaaatacaaaaaattagctgggcttggtggtgtgcacctgtaatcccaacactcgggaggctgaggcaggagaattgtttgaacctgggaggcggaggttgcagtgagccgagatagcgccactgcactccagcctgggcaacagagtgagactccatctcaataaaaataaataaataaatacgtacataaataaataaggccttaagaagccctggccccaccttcactgaaagccgaccagccctctctgcaacccctcagcatttagcaccgtgtaccgcgcccagcagcttcagtaaatgctggttggctttttatttttcctttctttccctttccttttccatcttgctcgcttccttatattttcttcacctttcacttctttttctcccatttctcctcttctgtttctcataggtctccttggttttttttttgttgttgttgtttgtttgttttttgagacagtctcgctctgtcgcccaggctggagtgcggtgacgcgatctcagctcactgcaacctccgcctcccgggtttaagcgattctcctgcctcagcctcccgagtagctgggattacagatgcccgccaccacgcccggctaatttttgtacttttagtagagacgggatttcgccatgttggccaagctggtctagaacccctgacctcaggtgatccgcccgcctcggtctcccaaagtgctgggattacaggcgtgagccaccgcgccagcccgtgtccttgatttctctttcatcattttcccacttcctttcctttcccttccctcttccttcccggttgtttcctttcttctccttcctcccgcccattcccgccattccagcctcttcgccgccgctcaggatcccaccttcggcaggagtgagcgcgcgccaggcaagactcccttggactcgggcgtgagcacgcacgcgagcgcgctccccacgagtggcagccgcttacattttctttttcgctaccagttgcgtcacctagcgaggtccacgctgattggctgtctgagctgggggccgaggtggtgttgggtgagagggggtttgcctcttgctcctctgtgtcagagccgctgtatctctcgccagtttgcgtgaataggttatgtccagcgggtaaagaaaaggaagaggcaatcgggtgtagtggctcaagcctgtaatcccagcactttgggaggccaaggcgggaggattgcttgaggccaggagttcaagaccagcctgggcaacatcgtgagaccgcccatctcttaaaaaaaaaaaaattagctgggcggactccaggtccgcacctggagtcccagctactcaggaggctgtggcaaaaggattgcttgagcctaggagtttgagacctgtgccactgcactttagcctgggcaacagaaccataccttgtctcaaaaaagaaaaaggaaaaaagaaaaggaacaggctatgactctagtggaccttaagagttagcacccaggccagatgtgatggctcatgtctgtaatcccagcactttgggaagccaaggtgcgtggatcatttgaacctaggagttcaagaccagcctgggcaatgtggtgaaaccctatcttttcaaaaaaaaatgcaaaaattagcagggcgtggtggcgcacacctgtagtcccagctacttaaggaggctgaggcgggaggatcacctgagcccggggaggttgagtctgcagtgaaccatgagagccatgattgcgccactgcactccagactgggcgacagagtgagactgtctcaaaaacaaaaacaaaacaacaacaacaaagagttagcacccaaaggtcaaagttctagttgctgctttggagaaggtgtccgccgcttcccatggcagcgccgggtccttacccagcccaagcatttctaggaaaagttgaagacctcagtcagttgggataggaccacctcagtgctgcctgattctaggctgctgttggggatccccagagacaagtccacagcctcctcagggccctatctctgctgccatcttccctcaattccatccaccccagttccctggccttttgcttcacaggtggctgctacatgctcctggaccccaagaatgcaagacctgggcagaaagctgtcctcctgagccccgtgagcctgtcctctggctgtctgagcttttccttccactacatcctccggggccagtctcctggtgcagccctccacatttatgcttcagtcttgggttagagcggagaattaatgggatttacactgatctgggcgcatctcccagggttggcttgatggggaaacatggggcatccctcagggtctagggaggtctggaatatgtgcgagactattccatgaagtggaaatcatggctgggagggcactttgggaggccgaggcaggcggatcacgaggtcaggagatcgagaccatcctggctaacatggtgaaaccccgtccatactaaaaatacaaaaattagctgcctgtagtcccagctacacgggaggctgaggcaggagaatcgcttgaacccgggaggcggaggttgcagtgagccgagatcgcgccactgcactccggcctggtgacagagcaagactccctctcaaataaaaaagaaagttgtgctggcctggcacagtggcttatgcttgtaatcctagcacgttgggagggtgaggctggtggatcacctgaggtcaggagttcgagaccagcctggccaacatagagaaaccttgtctctactaaaaatacaaaaattagccaggtgtggtggcacacgcctgtaatctcagctactcaagaggctgaggcaggagaatcgcttgaacctgggagacagaagttgcagtgagccaagatagtgccactgcactccagcctgggcaacagagcaatactccatctcaaaaaaaaataatgaataaataaaataaaaaagaagattgtgctttcatttggtggtaatcgtccccagctatgccctctgctcctcatcctcctaggtatagttcaaagtcgtttcccagtccccttaagctcacttctccttccaattcctttcactgcagggagtatccggaaacacactctcttctcaggacaacctgggcccaactggcaggctgtttctgtcaattacacagccgtgggacggatacaggtacagagaagcaaggggtcaggtccttgcacatggtaggcacacccaatgttgaaataaattgaggggcctggtgctgtggctcatgcctgtattcccaatactttgggaggctgaggagggaggatcgcttcaggacaggagttcaagaccagcctgggcaacatagaaagaccccatctctacaaaaaaatacaaaaattaggcgggcacagtgatgtgtgcctgtagtcccagctactagggagcctgaggtgggaggatcacttgagccctggaggtcaaggctgcagtgagctatgatcacaccactgtactccagcctgggcaatagagcaagactctgaaaaaaaaaaaaaaagaaagaaagaactgaattgagggtctgggcacagggagtagggattctgggtcctggaatggagtcgagttagatcaggggcttgggggtgtgggctgtgtgctcactcctgctccatctccctttctctccagtttgccgtggtaggcgtttttggaaagaccccagagccagctgtggcagttgatgcaaccagcattgctccttgtgggggtgagagcaggccctgagaggcccggatctctcagaatccggggtgggctgggggagggctggagagcgtcactcaacttgctca

SEQ ID NO: 140 - DNA, 21347 bp, Homo sapiens
aggaaaatcataggcaaagtctccaagaagaagcaagagtaagactctgaaaaatgtagacatttaaaagcagtcagggaactgaaacaaaagtgtctgtgcacacacacaaacacaaacacaagcacgaacacttgctcagggaaggtgcatccccagaaaaggtttgagaggactcttgagccttcacactacactgaaggttttccacagcacagagccagctcccaaagatggagagacatggctgtttttgcaaacatctaattttcaacaaaaaagaaacacaaggcatgtaaagagacagaggattgacctatttacagaaacaaaatatatctctagaaactgactttaaagaaacacaagccactgaattccttgaagaagctttaaaacaattgtcttaaatgctcaaagaattaaaggagaacacacagagacaactaataaaattaagaaaattatgtattaacaaataaaaatatcaacagatagaaattatttttacaaaaactcacaaagaagttctggggctgaagaatacaataacttaatagaaaaattatttagagaagttcaacagcagagtcaaagaggcagaagaaagaatcagcaaatttgaagacaagttatttgaaattattgaatttgaggaggaaaatgaaaataaagcgaaaaaacctgagacttattagacaaaatagactttaactcaaagactgttacaaaagacaaataaggacattacataatgataaaaggaataatttaacaagaatatagaaccattataaacacacatgtgcctcaaatcagagctccaacatatacgaagcaaatattgactgagttaaagggagaaatggagaggtctttaataatagtaagagacttcatattccactttcagtaataggtagaacaaccatacagaatatcaataagtatacagaggacatggaatacactatacatcaattggaccaaaagacatatgcagaacattccacctgggattagcagagtacacatttatctcaaatacacatgcaacattctcccggataggcctcatacggaagcccacaaaacaagtcttaataaatgttaaaatactgaaactagacaaatatctttttccaactacaatggaataagactagaattcagtagcaaaaggaaaactggaaaatccacaaatatgtggaaattaaacaacacactcttatacaaccaatgggtcagagtaaaaattacaaaggaagttataacatatcttgagaaaatgaaaatgagaacacagcataccaaaatttatgagatgcaaagaaagcagtgctaggagaggaatttatacctataaactcttacattaaaaagaaaaaaaatctcaaatcagtaacctagttttacaccttaagacttaagaaaccaaaagaaaattaaaaaaataaaacaaacaaacaaacaacaacaacaaaaaaaaaaaccgtctgcatcaaagctagtagaaggaatgaggaaataaaaaaagattaggacagaaataaatgaagtgaaaactagaaaaatcaatagtgaaaatcaacaaaaccaaaagtttgttctttgagaagaccacaaaaactgataaacttttcactagcttgaagaagaaaaaagagaagaatcaaagaactaaaataaaaatgagagggaaggcattacaactaacttatagaaataaaaaattataggagaataccatgaacaattgtatgctaaattggataacctagatgaaatggatagatccctagaaacaaatctgaaaagacctataactagcaaagatcaaaactctgccaacagaataaagtgcaggaccagacagcttcactcattaattctaccaaacatttgaagagaaatcaacacaaatcttactcaatgcttccaaaaaattgaagaaatgaggacatttatgaattcgttctctgaggccagcattatcctgatgccaaagccagaaaactacataacaatatctctgatgatattgagggatgataaaaatcctcaacagcatatcaaaaggattatacaccttgactaattgtgaattattcctcaaatagccaaaccaatgctgaagaagaaaaatatagttagagtcacatacttcctgactttaaaacttatcacagacagacatagtggtgcatacctgtagtctcggccactcaggaggcagaggatagaggatcccttgatcccaggagttctagacaagcctgagcaacatagtgagaccttgtctctaaaaaaaaataaaagtaaattaacacaatttattacaacaaagcaaccataatgaaaataatgtgttattggcataaagatagacatataggtcaatgaaatagaatagaagagtagcagagaaacttaaaataaataaaccttcatatatatggtcaaattattctttttttgtccaaaaacaggatcttgctatgttgcccaggcaggactcaaactcctggactcaagcaatcctcctgtctcagcctcccgagtagctggagctataggcacaaactatcatgcctagctgattaaaatgattcttgataagggtgccaataccactcaatggagaaaggacaatcttttcaacaggtggtgttgggaaatttagatatgcacatgcaaaagcatgaagctggaccctcaggttacaccatacacaaaaattaactcattaaggatcaaagacataaacatagagttaaaactacaggctgggcgtggtggctaacccctgtaatcccagcactttgggaagccaaggcaggcagatcacaaggtcaagagatagagaccaggctggccaacatggtgaaaccccatctctactaaaaatacaaaaattagctgtgtatggtggtgcatacctgtagtcccagctacttgggaggctgaggcaggagaatcgcttgaacccgggaggtggaggttgcagtgagccaagatcatgcaactgcactccagcctgcacgacagagcaagactccatctcaaaataaataaataaataaataaactacaaaatttctaaaaggaaacataggaggaaatcttcatgacattggatttgacaatgatttcttaactatgataccaaaagcacaggcaacaaatgtaaaaatagataaattagactacataaacattagaaatgtatgtgaatcagtgaacaaagtcaataccatgaaaaggaaatctttgttatgggagcaaatattagcaaatcgtgtatctggtagtgggttgctatacaaaatatgtaaagaacccccacaattaaacaacaagtaaacaaacaaccttattaaaaatggaaaaaaaaacttgaatagacacttatccaaaagaaatttacaaatagccaaaagacacatgaaagtatgctcaacaccattcataattagattaaattatttaaagtaaaacccacagtaagatatcacttcaaacccgagagaatgactactataaaaaataaagcaaaacaaaacagaaaataacaagtgttggtgaggatgtggaggaattagaacccttgtgcactgttggtgagcatataaaatggtataattactatgaaaaagagcatggtgattcctcaaaaagttaatagaattaacatagggtccagcaattccacttgtgggtatatacaatacaaaaagattgaaagtagagtcttgacagggtacttgtacacccacgttcatagctttattattcacaatagctaaaaggtggaagcaatccaagcattcactgctggatgattatagaagcaaaaggaggcatacacatacaatgtgatattatatggccttaaaaaggtaagaaatttatgcacatgctacaatatgaatgaatcctaaagatatgctaaatcaaataagccagtcacaaaaagacaaacactgtatgattccacttatgtgagatatggggtgtagtccatttcatagaaaaagaaagtaaaatggtgattgccaggggctggggagagggagtaagagagaactgttgtttaatgagcgtagagtttcagtgttgcaagaagacaaaaattctagagattggctacacaacgatgtgatgctatttaacattactaaactgtgcactaaaaaaatgattaagacagtaaattttggattatgtattttaccaatttttttaggaaagtattcactgcaaaaatttaggagagttcaacacagttgcagtatatcaatatattaacaatcataacaacaacagcaataaaaatatttttaaaatatactatttaaatagaatagaattttcttctagactttaatagtattttctcatcactgtaattgtttaaagggttgtagatatggaaagaacaaaacaaagattactaacttaacttgttactggttatagaacacatacaaaaaattattccatttgaattatttctggttagatcgcaatagtattcactcacatcccatgagacggtgaatttttgactacctaaaagagaaaaaccttgacaaataggaaatttcagaaagtcagtgctttgctggacaagatatcttatttgacctaatagctaagccatgatatctcatagccaagattcaagttccaatcttcctaatacaactatgttgctgactcaacacctacatctgagttatgtcagttgagagcttgggtgttgccctgcatgaagacagaggcatggaccagatggtatcccagccctatcatcctagataccaggagttgaacttctgagtagacctgccattgtgacgacctgggaaccaatgtcctgaccactcccccattactaagccctttggaacaatctgagcaggagaacaaatgtcatacccaggagggatggtgtcagacctctcagggtgatgtggcccacacacctcactgagcctgtctcagagtgtgtctcctatgagggtggcctgagtcataaggaatagctgtttataaactgtaaatcaatgctaataccaatgagagcatttaaaagtcattaaatatccattgtgcacatagctctgtgttgaaaaacggaggtaagaagtatgaaacacccaaggcaggccatcaaagcatttactgttatctcattagagtgatatgccacatgaaggataaataaaaaagtgggattgagccacactgtcctggaagggtagaggccacggcatgcactgcagggagaagcataatcaaagtacagaatataatccagttcagtttcagaacatttctgagagtagatgacaaaggcttaaactaaagggagaacacagagtcttatttcactgaaggaatttggacatttacccttatacagtgtgcaatcatgaacaagactttactaatgatttagtgttaattatgtacagggatggaagatgttttcttggatgtcataaaagaacagaatcaaagacacactacagtgtttggagatactacgttatcacaggagtctgggcagctgtaataattgatgctctgagacaggtggtacacacacatatacatctctctcaatatgtatgctctgtatatgtgtttataaatatacatgtatctccaccacgttttggttagggtcaccatgtccattttgacctagatatcattcccaagttctgggcatatccagagtctgtcaggggctgggaagaagaggacttgtccctcatatggtttaatctggcttttcttggtcttcctctgaagaaatagtttaatttgtggataaccttgcagtcatggctgtcttagtgactagtgtgtcctagaatgaacagcagcccatttcattaatatcctaaaaatgtataaattcagaacactccattcatataaatcctgtggacatgtagaaagctagtgattctagtggagagagaggagaggggcttccaaagtagcagcataaacacattcacattaaatattaaggactcttgttcttaaaaggcacccgtccccttatggtccaggacggggttctgccagccatttgaccccacatggaagcgtagacttataatgtctcacaaccatgtctcttttcttcctgtttctcatctgtgaccatcatccggtgctcccagtgtgaacccagaaaagtccaaattctcacaccaatacaaagagcagagctgctgcttcttgtttctctaatgagctgcttccttgttcacatctcagtgctgacacatcaaggaccccaccagaagaaaagggctatttaaaagcaaacagatcaccaaacagccagactcactctcattagaaaaaagctgtgcttcgtttgttaaacaaagatcagtatcttcattctgtattcagcaagttatgaatgtttcacttattcagagcctacaatgtttcagtctctctgtcaggcacattttctcttttttgtgttactttattgactttcacaaccaactaattcttctgtaactaattctttttcatcttccagctttatggtttaaaaaatggtacaggctaaatagtttcaacagtcccatctcgcagggcctggtcctgggccgggttatacttccagggttttacttgtgtagatgtctacactgcacccacagccacacagtttggtggtgcacagggacagaaataaacatgcatggaaacctcagggattagtacttcaacttcaacccaggctgcacggagcatcaggtacttcggaagagacagaaatgagataggtcctaagttctaagactgagaactgagaggctctcagggcaagcagccttcaagtgaatgaggtaggtgatggtaggagtcatcctggaaccccgtttcaagtaggcactttcctacctgggagtggctgccttgagcctggggagagaggcaggtgaggagctgtcagtcaccaaccatcacaagacccacgtgggtgtcagaaggaaggtcctctcatgcccaggccctgtctcacagctggggcagagcccaggccaggataaaagggctcagggccagaccaccccatccactcacctcctgaggtgctaaagaaccctgtgctgcctgtgactccggtaagaacagagcagggatgctcagaacagagcaggagggaaggaggggcagggcctccggggctagggccatgttgtcagaggtggagagtttagaaaagactgaaggggcgggggccaaaaggggtctggcactaactgggagcaggaaggaaaagaggaaaagagctggcgggctgtgccatgtgcctttgaactctagaggaaacaaactgctctgggatgaggtgggtgttccagagtgggaactttgaagcacagagacctgctccactctggcagcccacaggagggaagcccacctctgaagatacaaccctgtctctgcctgcaagggaagaactggagctgtggacatgggactaaagactctttggggtttatgaaccccacattttcatgggtctgagatttgttcacaaacttcccagcttggttaggacacaccaagcctgagacccaccgtgtcatcccatcagcctgagcaggtggtgagtgaggaagtctgagctccaacctgagatcagggggtcagggttcaagtactagtctgcagaaactgctaagtttatctgtctctattgaagtgagtttactgacctagtagtctccaagatcctgcacaatgctgaccttccaaagtaaaatcgtcttgcaaattatgaccagagagaatgactgcttcttctcctttaaaaataattttctcttaaatgactcataaattagacaatttcagtcttaagatatatttgtaataatttcttcctccactgacaacacatcagaatcttagatgcattttgcaatattgtttagtcttagtttacagttgtctgacatccaaagatatcttgaaaaagatgatgtgagattttgaggaaattattggaaataaaactactgaagatgatgcttttaaacttgagaggtgctaagagtgtcacaggggcagaggtggcctctgcctgggtctgacttgttatttgactctccctcagctcctgaacacccaccaccgagatgtcctgccagcagagccagcagcagtgccagccccctcccaagtgcactcccaagtgcactcccaagtgccccgcccctaaatgtccccctaagtgccctccagtctcttcctgctgcagtgtcagctccggaggctgctgtggctccagctctgggggcggctgtggctccaactctgggggctgctgcagctctgggggtggtggctgctgcctgagccaccacaggcgccacaggtcccaccgtcgcagaccccagagctctgactgctgcagccagccctcggggggctccagctgctgcggtgggggcagcagccagcactctggaggctgctgctgaagtggaccttgacttcctcttccttctgattctgcctgaatagctgagaggttccagcaaaagcttgaagtcttgcctggagaatccctctgctctggtgtcaggaaacccaaaatctttctccttaatggcatttagagactttcttctgcagatccatggctgccctgggaactccaaagcacacacctacttcctccccagctcacgctactgtattctgtgctgcctgaactgaagaaataaaatccagaatctgctccccaatttgctaccagcctgcttgattttcctgtttgtgtcatccttgttctgctcccctgtgtctgctggtggctgctgaggccttggtggacagaggatggggaaggggtcaggaggaaaaagcttgcatttctgtgtgttttgtgttttttcttctttctgtgttttccttttaaaccaagggactgaaatagcattgagaaatatttttctttcaaattctggttcctttcacctatgtaaccgcatccctcaggcatggccaggaggccgacttcatcctccttctcactgtcacctcttcactcttgtgttcctcgttccccactccttccactaacaatctccccggactcctccttcagattgtatgtacacgtagtagacatataaatatatgtgtgtgtacatgtatatatatacacacatatttatatatactcacattatatggaataaatctttagtttttaaacttaaatcacttttattgatctataactttcacacaataaaacccctttttaaaataaacaattcaattagttttaccaaatgtatacactcttttgtaaccacaattgcaaggaacactctaaaaatgtagttgattatttattaatcattatttgcagtaaggtttaaaaataggctataagtttatggatttacttctggattttctatttttttttttggttcatacatctgtttttatgccagcactatactgttttggttagtataactttgtagtataatttgaaatcaggtagtatgatgcctccagctttattcttttttactcaggagcactttcgctatttggagtcttctatggttccataaaaatgttaagccttttttttctgttgtattagtcagggttctccagagggacagaactaataggatatatgtatatatgaaaggaagtttattagggagaattggctctcgtggtatttcaacagagattgcattgaacctgtagaccactttgaatactgtagactttttaacaatattaattcttccagttcatgagcctgagacatctttccatttgtttgtgtcttcttctatttcttcatcaatgcttttagctttcattgtagttctttcacttctttggttaaatttatttctggctattttatttttgtggctattataaatgagattgttttcttgatttctttttcagattgatttctataagtgtatagaaacactactgatttttgtatgttgattttgtatcctgccactttactaaatttgtcatttctaagagtttcttggtggagtctttagtttttctaaatctaatatcatgttatctgcaaaaaggataatttgacttcttcctttgaaatctggatgccacttatctcttttccttggctaattactccggttaggacttctaccatatgttgaattaaagtggtgaaagtgggcatccttgtcctatttcatacttagtagaaagcctctccatttttcttcattccgtatagtattaggtgtgggttttatcatgttgaggtatgttccttctacatgcaatgtcttgaaggtttttaaccaccaagagatgttgaattttattgaatgctttttcagcctctattgacaaaacttaagctagaccaagaaaaaaagagagaagccccagaaaaatgaaatcaggtaaaaaatgaaacataataacttgtatcacagcaatataaaggataattagagactgttatgaacaactgtacaccaacaaattggaaaacctggaaaaaaatagataaattactggacaacctactgagattgaaccataaagaaatagagaacctgaacagaccaataatgagtaatgagattaaagcagtaataaaaagtttcccatcaagaaaaagctccagacctgatagattccttactggagtctaccaaacatttaaagaagagctaattctgattctactcaaactatttcaaaaaactgaagaacaccaaatacttctaaactcattctacaaggccagaatcacactgataccaaaccaaacagacacaatagaaaaagaaaactacagaccaatatctctgatgaatatagatgcagaaatcctcaacaaaatactagcaaacagaattcaatactaccctgaaaagattattcaccatgatcaagtgggattcatcccagaaatgcaagaatggttcaacatatgcaaataaatagacataatgcatcacatcagcagaatcaaggattgtcttcttttttaaggctgaataatattccttctgctatatagtatatatattcagaatttttaaaattcattcatccactgacagaaatttaggttgtttccagatcttggttattgctaataatgccgaaataatgctgggagtacagatatctctggaaaatactgattttatttccagaagtggagttagcagatcatgaggtagttttattttctatacttttaggaaattccatacggttttacataatggctgtaccaatttatatttccaccaacagtgtacaagaattccctttttgccacatccttgccaacacgttatatttcatccttctgataatagccactttaacaggcatgaagcgatatctcattgtggttcagatttgcatttccctgatgattagtgagattgagaaactttttctgtatacctgttggacatttgtatgtctgagaaatagctattcagtcttttgctcgtttttaaattgggttgtttggttgttgccattcagttgtatgagttccttcatgtataattattaagagtttgtcaagatgagaaagcaaaacaagatcaccagtttccttggtgctggctctgatgcacagagataaaaatataactctgcttaaagtattatatttccagttagatctcaataatgtttccttccatcccatgttatgataaaatgttgatgatgtaaaagataaatgccttgaccctcagaaaagtcagtgctttgctgatcaacatgtctgtattgacctgatagctaggctgtgatttctcaaagccaagacttaatttccagtcttcctgatacaactatgttgctgactcatcacctacatctgagttacgtcagttgagggcttggggttgccctgcatgaaggcagaggcatggaccagatggcatcccagacccatcatcctagataccaggagttgaacttctgagtatacctgccattgtgacaacctgggaaccaatgtcctgaccactgccccattactaagccttttggaacaatctgagcaggagaacaaatgtcatacccaagaaagacggtgtcagacctctcaaggtgatgtggctcacacacctcactgagcctgtctcagagtgtgtctcctataaggatggcctgagtcataaggaatagctgtttataaactgtaaagtcaatgctgttaccaatgagaggatttaaaagtcattaaatatccattgtgtgcatagctctgtgttgaatattgaggtaaagaaatataaaacactcaaggcaggccatcaaataatttactattatctcattagagtgatatgccacaggaagggaaaaaaaaagtgggattgagccacgctgtcctggaagggcagagaccatggcttgcatcacagagagaagcataatcaaagtacaaaaaaataatccagttcagcttcaggtcatttctgagagtacatgacaaaggcttaaatgcgagggagcacacaaagtcttatttcactgcaggaatttggacatttacccttaaacagtgtgcagtcctgaacaagactttactaatgattgagtgttaattatttatggagatgagagagtcttttcctgaatctcacactggaacagtatcaaggaggcccttttatcctggtcttgggctgtgctcctgatgggtgaggcagcacctgggcataagaggaccttacaacatgggttgtatgaccaggtgataaccagcagcttctcacctgcctccctccacaggagatcagaatagctcccatcagtgccacctcatttttcttggagctgccttaggcctttttcttggagtttggcctcccaagtcctctttttctatatccctgatggtatcatttaaaccaaaattttacagaagtcttttaatgtccctgatgtgtcccagattctgtgtgtgtgtgtgtgtgtacgcatgtgtgtgtaaatacatgtctatgccatcacagttacaagcctggtaggagtcagacatatctgggacagaatcctggttctgtcacttattagctgtgtgacttctgaaaatcccaaattatctcatcctccgtttcctgaaatttaaaatgaagataataaagattagtctccaggatgtcgtgaggatcaatgaaattgtagaaagaaaatgcacattaaagttcctgtaacacagtgaaccctcatatgaaacacctgtctatcaataattttaaagggaatgaacactttttgagatggtccaagtctcgggcactatgtggagtgaaggaaaagagttccctagtggaggaggctggaagacctgaaaaaataggaggacttgaaatacaatgggaaacttttagtgttattgctttgtttcaacatgaacaaaagtttttgtctgaaggtctatttaaaaacatttttaggagattaagatttactaatgtcaatttggtatataacaggtgttccttttgtatcttgaggaaaatattatttaaaaagtaaaagaactaattagatgaaagcaaattagactagggagtaatcatgtgaaaaagttctcttttcaggaagtgtccaaaacaattctccagaacgtgtgatgaggtagaaatggccacaataataccaatatccaggtcataatgggtatagagaatcaatatctgagatatgtatatgaacataggcatagatagatatagaagtagattatatagatatggatatataatcggccttgttctattattacagtatcatatatctcaagatgcatggccttccctgaagttacaatgccttacttctctagggtttctccatgattctaattttcactggaatctgaaaatgatctttccacaccatcccgcactccagaaataattacccctgaccattaagaaaatctcatccagagctctgcactgtgttcaggatcaaggtcaatgtccattgagtgacattcaaggctctgtgcataagaccctgtacaattcctctaatttatgctttgctaagcaggactgcctattagctatactttgaagatgtctcttcctactttacctctatgttttattccaatatttttttttctctctgagacactgcagttcaaatctcacttgctccattttccttttttttttttttgacatacctcatgaatcaggttttaacaaaactttggacagcacaatttgtgacttatattgtgtagtccccatcagctactagtacaaggtcatggccacatgggtggttaaaactttttaaatcctgtcagcagcattagtgctggggtttcatggaaggtatgaatggtaagacttagaaaagaagttggaaacactttctgttaagtcttaaatgtaatacttaagaagcacatgcatttttctatagagagtcatgggcaagttgagaaatatggtacagggagtgtgttctggaataaagtgtagataatttaatgaagatggagaaggaagaaagcaacaagatttgatggaaggttaatagaaaagcaatttttacttgcaaatgtgcctggaactaaacttattgcagaagtagtcagtgggaaaactgtattttcaaaatatattcatgggttttgttcttttttatttcatttgtttacttattatatttttctttttttatccatttatatacatgcatgtgtgtgcatgtttgtgtgtgcacctggagatgtgcagaagtgtgtgtttttgcatgtgatgtgtgtgagggaggaaggatattggtggggctaggtcaggaggagcagactgcactcacagagaaagagaagcttggagagactggtcaagcccttgaaagggaccagaaacaaagaagctatgtttataagagacagttcagacttggtcagaagcaatgctgcttcaggccagttgacataggacagacagagttgggagcaatggtcccttcccactcctgcccccattaaccccaattcactccagagtgccccactgtcccctgaggttccaaggccaccaactgcagaggacaaggtgaagagaacaagagccactcaaggagaatagggtcctcatagaacaagacactgagcagattccttgttttagtcctttaatcagcagatgcacgctgcaaatgacattgagtaagctaggggcttagacagagcgtgggagggtagccacaaaggtgaggtccaaggccagtgaatggagatccaggagaggatctgagtttctggactccagggaaaagatatgctcttggcaagttcagagctttcccttggacctgtgagcctctcaggcaggcctagtaggagaagggggatgtccttggcagtttgcggtcctggattctgctcttctaggctcagggtccacttcagcagcagcctccagagtgctggccactccccccgccacagcagctggagccccccgagggctggctgcagcagccagagctctggggtctgtggcagtgggacctacggcgcctgtggtggctcaggcagcagccacctcccccagaactgcagcatcccccagagctggagccacagctgcccccagagctggagccacagcagcctccggagctgacactgcagcaggaagagacaggagggcacttagggggacactttgggggacactttggggtggggcacttgggagggcacttgggggtgcacttgggagggggctggcactgctgctggctctgctggcaggacatcttggtggcggattcaggagctgaaagagagtcaaacagcaagtcagacctaggcagaggccacccctgcctattcttgtcctttccacattgtttctatttcctttattttgatgaactgttcaaatgtcatggtaaatcattaatcactgaaaattttgttgtttcttgtagtttggcaaatgctctcacactgtatcttttgagttcacaatttcatcttaagacagtcaagaattactatatcttttacaaagaaggaaactgaggcagtaagccatatgaaaaaatatctgtcaagattaaacatttagtaaattaaaggaagcagtttttctcattgtgtcaaataaaaccctgaaactgtccagtgtggaaacctggggatataaacattttcttggaaaaagataatgaaggattatctcttggagtaacttcctaggagactttgtcttgtaaaaacctgcgcatgtacaattgtaaatggttttggagacaggctggtctcacaggctccctttgttaaggaagatgctggagaacagtatttttggtgcatagaggggatctgaactcaggtgccctggctctaggctggtgcactgccatattcatcacgcaacggcctcacagtaacatgttggcacagtgatcctcagcttgctatgtctaactactttaagagattctcaattccaatttgaatctagagataagtgagtttcaaaaagccctaaaagatccattaattatctctactccactgattgagaactactatctccagctcaaatttgcaaggagtgtcacagttttgctctgaaaagtaagtgtcctatttgaagttgttctagcagagtctatttgcctgggcttcaactccctctgtccttaaaactcaactagctgaagcacaaagacagagacatctaattcttatttgtgttaccagttggccctctccctgcctcctgagcacatcctccttcaatctttctgaggtcttgacttctatccagatggatctcagccctcaaggtcctgcccagcctcccctcctgcctagggctgagcaacactctgtggaagccccagcaactattctcaaagaacacttaccggggtcacaggcagcacagggtccttcagcacctcgggaggtgagtggatggagtgctcaggcccagagcccttttatcctggcctgggctctgcctccagctgtgagacagggcctgggcatgagaggacctgccttctgacacccacatgggttctgaggtgggtggtgactggcagctcctcacttgccttcctccatggggctcagaaaagctgctcccagcttggactatggccacttagaaatagaaatggagtgggaaaatccctaccatcatttcctgtgttgttctccgtggagaatacctaatctgtttagtcttggagcttgagttctctgttttgttaactcccaaatcttacctctgtggctctgggcaacctggcttaactcaagtttcatagaatcctccaaccctcaactatcttatagttgtgtgtgtgtgtgtgtgtgagtgtgagagagagagagagagtgtgtgtgtgtgtgtgtgtgtgtgtgtgcgtgtgcttctgtattaaagccattaggtaactggttaaagagtcagacatagagagaaacctgattctgccacttattacctgcatgaccttatgaaaagcattaatacctcatcgttcttgttctcagtttgtcaactctgtaatagagataatataaaaacaattgtccagggatggctgagagtcaatgaaataatgcaaaggaagtttctggtggagagcttataacatgtcattttctctaaacaaatgccaatgcattaatatttttaaattatagctgctttctaaggagagataatagcctccagctccatccatgtttcttcaaaggacatgatcttattcttttttatggctgcatactattccatggtatatgtgtaccacattttctttatctagtctaccattgatgggtatttgggttgattccatgtctttgctattgtgaatagtgctggagtgaacatacacattcatatgtcattatgatagaacaatttatattcatttggataacgctccttcttcaacatccaggctttattccgtgacctatgcatttctaaaacagtgccattcaactgtaacttctttatgagtcttaattttcaaatatgactacagtaaactatccttgattctgcagctttgttcttatatttatgtacccctcaacagtttctacaacagaggtggactccataggtaagcaatttaaaaatgaattgattactattagcatcatctttactttgtgtatgacttaagccatcatcattggaattctcactctgagacatttacattacagtatactagccttatcaccctgcagaagtctgccactgaattacctggctatggctcatgttgttccaaagaatgtatttaataatagagtagtcaagatattgattactcagcttacattggcagttctgatccagaagcccagcccattcattccaaggatgatgaggattagaagctattctgtccatgactctgataccacaaagggtagcacccaaactgtcaattaatctgacatggattgggttaataaggtagcaatatgatgtaacatcatgaggattgtttccttatgtttggtgttagatttcaatagcatttgaaatttattgaatttggtaccattttaatgctaacaatatgcactagcaaaggagtgattttctgaaaatacatttctatgttgtcaggctctcatatcacaagagattggtgggaagaatgctgagacacagtaaaaattaacttagacttagtggattttactctgtgtcccagagccagcaccacacatgactgatttttaatttgcttccttcctctgcaacccctgcatagagcagtaacaataaactgatactccaaaattattagaagaatatacagactatctaattatttctttataagtaattggataaaatatttaagcatgaaaaaacttgataaatctcatcacatagtgaaaggaatactatatgtcagaaagcacaattttaaaggatgaaaaatataaataaccagctgagaaaaagtaaagtatgtaagtcaggaatagtattaaaatctatgataaatagtaagtccttacaactttatagaaaagaaataagcctatctacaaatgaatgggcaaagtgcatgaacaaacagatagcttggaaagaaatacatgaccaatacattttgaaatttgttatttcatatttgcatatacaaataaccaaagactagtatataaaacaaggatggtctttcaaggatgaggtctgagtctgccactgaattgcctggctgtggctcatgttgttccaaacaatgtatttaatacgagagtagtgaagacattggttactcagcttacattagtagttctgatctagaagcacagcccgtccatttcaaggatgataaggattagaagatattcctttatattgaactagaagaaacttaaaatcaataacaaaacagtattactgaaggtgataggaaatggatcttataaattggcataataatgaaaattaagatgacatttggtgacccattactcaacaaataataattttctgtatacaaatcaaaattttaaatgtgcatactttttatccaacagttgtactttcaagaatttaacttaaggagaaaaaactttaagaaagaagatatatagacaagaatgattactatagaaattaaaataatattaagagttcgaaaagttgcaagatgtaagaataaatttacattaaccagcaacaaataattcaaaaatataatttttaaaattgccatttaaaatagcaaaaatacataaagtctaaaatacaattttaatgtaaaatatatttgataaaatgagaagactattaaacagcattacagaataccataataaagagatataccatatttatgggtgagtagaaaaaaattataataaaataaaataattcttcataaattaatgcatattctcaatgatgttttcatcaaaattctaataatgatttgttttgcttcatcttcattgtgtaggatgtgacaaactggctctaatgtttatataaaatgacaaaggtttaataatcaccaagacaatcttaaggaatgatgaaacctgtgtgatttagataccgcaattgattatacacctatggtaattaaggcagcaggatgttctcagaggtgttgacaaattggcaatgacaagaattgttcacccaattataaatctacggaaatgtgaaaaattgattctgacccataggtatttcagatgagtgggggaaaatggaaaatttgattacaatactaagacaattggttatccattcagaaaaatgtttaaaatatataaaatgtacaaaaattcctttcttgattgaataaaaaccttcatttttaaaaagaaaaaattttcaactttttaaagatagggaaaagatttctaaacttacaaatggttgagatttattaaaatcatgaaaattgcaaacaatatagttattgttgcagaaattcaactatgttaaaaataaaacactagttcatcaaatgacaccattaaaatgcaaacaagaacatatttgtttggaaaagatattcacaacacatttaatagcagtacattagtaactagaatatgtaaagaacatttacaaatactaacaaaaggagataaacaaattgaaaaacattttcgagaaaaagcagacaagtcacagaagggaaacctcaattaaccaaaaatacattaaaagatgctgtgatcactacaaagcagaggaacacatattaaactaccgacagataccagtgcacatccatcgaatggcaattattgaagtttaggaacaatgtgcagcaagaatgattcttatacaccataggtgcaaactgaaatcagtatgagcaatttggagagatgggtgtgatccaaaattcaacagttccacttataggtacataacttggtgagactctcccacaaatacacaagtagacacgcacaaaaatttccttagctgcaatattgattcagtgaaaagtgaaaacactctaaatgtctatccaaaagagagaagctaacaaatcatgatgcactcataagatggatactacaccgttgtaaaaatgagtaaactatggctatacagatcaacttgagtaactagcaaaaacaatgtttaaggaagagaacaagtcaaaaatgagtgtcttaagtatgatgccatttctatagagttaaaaccatgtaatccatagtgtatattgtatcagggtaacctgta

SEQ ID NO: 141 - DNA, 23819 bp, Homo sapiens
ttgcaaagagatgatgagagaatttggggaaagtattggaagtgaaactactggacatgatgtttccataattacaagtcatgctaagagtgtcagaggggcagaggtggcctctgcctaggtctgattttctgtctgactctccctcagctcctaagtacctactgccgagatgtcctgccagcagagccagcagcagtgccagccccctcccaagtgcactcccaagtgccctcccaagtgtcccacccccaaatgccctccaaagtgtccccctaagtgccctccagtctcttcctgctgcagtgtcagctccggaggctgctgtggctccagctctgggggcagctgtggctccagctctgggggctgctgcagctctgggggaggtggctgctgcctgagccaccacaggcaccacaggtcccaccgtcacagaccccagagctctgactgctgcagccagccctcagggggctccagctgctgtggagggggcagcggccagcactctggaggctgctgctgaagtggaccttgacttcctcttccttctgattctgcctgaatagctgagaggttccagcaaaagcttgaagtcttgcctggagaatccctctgctctggtgtcaggaaacccaaaatctttctccttaatggcatttagagactttcttctgcagatccatggctgccctgggaactccaaagcacacacctacttcctccccagctcacgctgctgtattctgtgctgcctgaactgaagaaataaaatccagaatctgccccccaacttgctaccagcctgcttgattttcctgtttgtgtcatccttgttctgctcccctgtgtctgctggtggctgctgaggccttggtggacagaggatggggaaaggggtcaggaggaaaaagcttgcatttctgtgtgttttgtgttttttcttctttcggtgttttccttttaaaccaagggactgaaatagcattgagaaatatttttctttcaaattctggttcctttcacctatgtaaccgcatccctcaggcatggccaggaggccgacttcatcctccttcccactatcacctcttcattcttgtgttcctcgttccccactccttccactaacaatctccctggactcctcctccatactgtatgtgcatgcattcacacacacatatgtacatgcacatagatgagatgaatctgcattgtaaaaaaattaaatcacatttagtgctgtataatttgcatgcaataaaattcaataaaattaaatgtaaaattaaatgagttttgtcaaatatttatagctgcataactataattgcaataacacaccaaaaatgtagttaatttattgagaagattttcaaaataacacaaaatctagaatacataaatgaaaatgtggatacagttaaccacattaaaatgaaattctaagtatcagatagtaccactaaaagcaaggaagggtaaaaaattaacttgggaaaattataatatatgtgatagggagatgactcatattggtaagaaacatagagttcataaaaactgagtaaataaatgttcctataaaagttttggcagaattcatatttcattcacaaataattaatgaagaaaaccaataacttctgaaattagattttaaaagcaatttaatctcattaataaaaagagcatagctcatcttttggggatgagaactcattattggttcacaagctttctgtgagcattttagcttacaaaacattgttgttgaagctatgtggaaatgatcacttactctttgtaatttagaatgctaactggcataacaattcatgcaacagatttatttggtgattaatttattcatttaccaatacttattggatttctagtattaggcaaatgaggcaaaatataataataaaaaatagatatttaagagtgttcactgctgaagtgacatcagatgatgacataagatggtaaataaggaacctccaggctctagctcacttcagagacattggacaatgatataaagacaaaaacagctttccgaaaactttaaaaacaaagtaagaagcttcagcaacaaagcaaagttttaataaagaaagtaaccatactcaaatggcaggaaattttgtggtgcttttgctcacccctaccccatcccatcttacgcataatgtggtgtggtcagaggaggctgcgcaatttctcagcctttcttacagatggaaggaaaagagtggaacttgcatgcaagattgtgggttgtgtgaggactgtgtgaggaactggtttttgtctcacctgagtttagagcaccaatgagtcagtggcatattctggatattcggttgaaggctgctgaaagcagaggctgcactgtggcatgaaacagctgcaaggggactgcagacttgcaagtgcctaaagacaagagattagcagcagaggaaaatcataggcaaagtctccaagaagaagcaagagtaagactctgaaaaatgtagacatttaaaagcagtcagggaactgaaacaaaagtgtctgtgcacacacacaaacacaaacacaagcacgaacacttgctcagggaaggtgcatccccagaaaaggtttgagaggactcttgagccttcacactacactgaaggttttccacagcacagagccagctcccaaagatggagagacatggctgtttttgcaaacatctaattttcaacaaaaaagaaacacaaggcatgtaaagagacagaggattgacctatttacagaaacaaaatatatctctagaaactgactttaaagaaacacaagccactgaattccttgaagaagctttaaaacaattgtcttaaatgctcaaagaattaaaggagaacacacagagacaactaataaaattaagaaaattatgtattaacaaataaaaatatcaacagatagaaattatttttacaaaaactcacaaagaagttctggggctgaagaatacaataacttaatagaaaaattatttagagaagttcaacagcagagtcaaagaggcagaagaaagaatcagcaaatttgaagacaagttatttgaaattattgaatttgaggaggaaaatgaaaataaagcgaaaaaacctgagacttattagacaaaatagactttaactcaaagactgttacaaaagacaaataaggacattacataatgataaaaggaataatttaacaagaatatagaaccattataaacacacatgtgcctcaaatcagagctccaacatatacgaagcaaatattgactgagttaaagggagaaatggagaggtctttaataatagtaagagacttcatattccactttcagtaataggtagaacaaccatacagaatatcaataagtatacagaggacatggaatacactatacatcaattggaccaaaagacatatgcagaacattccacctgggattagcagagtacacatttatctcaaatacacatgcaacattctcccggataggcctcatacggaagcccacaaaacaagtcttaataaatgttaaaatactgaaactagacaaatatctttttccaactacaatggaataagactagaattcagtagcaaaaggaaaactggaaaatccacaaatatgtggaaattaaacaacacactcttatacaaccaatgggtcagagtaaaaattacaaaggaagttataacatatcttgagaaaatgaaaatgagaacacagcataccaaaatttatgagatgcaaagaaagcagtgctaggagaggaatttatacctataaactcttacattaaaaagaaaaaaaatctcaaatcagtaacctagttttacaccttaagacttaagaaaccaaaagaaaattaaaaaaataaaacaaacaaacaaacaacaacaacaaaaaaaaaaaccgtctgcatcaaagctagtagaaggaatgaggaaataaaaaaagattaggacagaaataaatgaagtgaaaactagaaaaatcaatagtgaaaatcaacaaaaccaaaagtttgttctttgagaagaccacaaaaactgataaacttttcactagcttgaagaagaaaaaagagaagaatcaaagaactaaaataaaaatgagagggaaggcattacaactaacttatagaaataaaaaattataggagaataccatgaacaattgtatgctaaattggataacctagatgaaatggatagatccctagaaacaaatctgaaaagacctataactagcaaagatcaaaactctgccaacagaataaagtgcaggaccagacagcttcactcattaattctaccaaacatttgaagagaaatcaacacaaatcttactcaatgcttccaaaaaattgaagaaatgaggacatttatgaattcgttctctgaggccagcattatcctgatgccaaagccagaaaactacataacaatatctctgatgatattgagggatgataaaaatcctcaacagcatatcaaaaggattatacaccttgactaattgtgaattattcctcaaatagccaaaccaatgctgaagaagaaaaatatagttagagtcacatacttcctgactttaaaacttatcacagacagacatagtggtgcatacctgtagtctcggccactcaggaggcagaggatagaggatcccttgatcccaggagttctagacaagcctgagcaacatagtgagaccttgtctctaaaaaaaaataaaagtaaattaacacaatttattacaacaaagcaaccataatgaaaataatgtgttattggcataaagatagacatataggtcaatgaaatagaatagaagagtagcagagaaacttaaaataaataaaccttcatatatatggtcaaattattctttttttgtccaaaaacaggatcttgctatgttgcccaggcaggactcaaactcctggactcaagcaatcctcctgtctcagcctcccgagtagctggagctataggcacaaactatcatgcctagctgattaaaatgattcttgataagggtgccaataccactcaatggagaaaggacaatcttttcaacaggtggtgttgggaaatttagatatgcacatgcaaaagcatgaagctggaccctcaggttacaccatacacaaaaattaactcattaaggatcaaagacataaacatagagttaaaactacaggctgggcgtggtggctaacccctgtaatcccagcactttgggaagccaaggcaggcagatcacaaggtcaagagatagagaccaggctggccaacatggtgaaaccccatctctactaaaaatacaaaaattagctgtgtatggtggtgcatacctgtagtcccagctacttgggaggctgaggcaggagaatcgcttgaacccgggaggtggaggttgcagtgagccaagatcatgcaactgcactccagcctgcacgacagagcaagactccatctcaaaataaataaataaataaataaactacaaaatttctaaaaggaaacataggaggaaatcttcatgacattggatttgacaatgatttcttaactatgataccaaaagcacaggcaacaaatgtaaaaatagataaattagactacataaacattagaaatgtatgtgaatcagtgaacaaagtcaataccatgaaaaggaaatctttgttatgggagcaaatattagcaaatcgtgtatctggtagtgggttgctatacaaaatatgtaaagaacccccacaattaaacaacaagtaaacaaacaaccttattaaaaatggaaaaaaaaacttgaatagacacttatccaaaagaaatttacaaatagccaaaagacacatgaaagtatgctcaacaccattcataattagattaaattatttaaagtaaaacccacagtaagatatcacttcaaacccgagagaatgactactataaaaaataaagcaaaacaaaacagaaaataacaagtgttggtgaggatgtggaggaattagaacccttgtgcactgttggtgagcatataaaatggtataattactatgaaaaagagcatggtgattcctcaaaaagttaatagaattaacatagggtccagcaattccacttgtgggtatatacaatacaaaaagattgaaagtagagtcttgacagggtacttgtacacccacgttcatagctttattattcacaatagctaaaaggtggaagcaatccaagcattcactgctggatgattatagaagcaaaaggaggcatacacatacaatgtgatattatatggccttaaaaaggtaagaaatttatgcacatgctacaatatgaatgaatcctaaagatatgctaaatcaaataagccagtcacaaaaagacaaacactgtatgattccacttatgtgagatatggggtgtagtccatttcatagaaaaagaaagtaaaatggtgattgccaggggctggggagagggagtaagagagaactgttgtttaatgagcgtagagtttcagtgttgcaagaagacaaaaattctagagattggctacacaacgatgtgatgctatttaacattactaaactgtgcactaaaaaaatgattaagacagtaaattttggattatgtattttaccaatttttttaggaaagtattcactgcaaaaatttaggagagttcaacacagttgcagtatatcaatatattaacaatcataacaacaacagcaataaaaatatttttaaaatatactatttaaatagaatagaattttcttctagactttaatagtattttctcatcactgtaattgtttaaagggttgtagatatggaaagaacaaaacaaagattactaacttaacttgttactggttatagaacacatacaaaaaattattccatttgaattatttctggttagatcgcaatagtattcactcacatcccatgagacggtgaatttttgactacctaaaagagaaaaaccttgacaaataggaaatttcagaaagtcagtgctttgctggacaagatatcttatttgacctaatagctaagccatgatatctcatagccaagattcaagttccaatcttcctaatacaactatgttgctgactcaacacctacatctgagttatgtcagttgagagcttgggtgttgccctgcatgaagacagaggcatggaccagatggtatcccagccctatcatcctagataccaggagttgaacttctgagtagacctgccattgtgacgacctgggaaccaatgtcctgaccactcccccattactaagccctttggaacaatctgagcaggagaacaaatgtcatacccaggagggatggtgtcagacctctcagggtgatgtggcccacacacctcactgagcctgtctcagagtgtgtctcctatgagggtggcctgagtcataaggaatagctgtttataaactgtaaatcaatgctaataccaatgagagcatttaaaagtcattaaatatccattgtgcacatagctctgtgttgaaaaacggaggtaagaagtatgaaacacccaaggcaggccatcaaagcatttactgttatctcattagagtgatatgccacatgaaggataaataaaaaagtgggattgagccacactgtcctggaagggtagaggccacggcatgcactgcagggagaagcataatcaaagtacagaatataatccagttcagtttcagaacatttctgagagtagatgacaaaggcttaaactaaagggagaacacagagtcttatttcactgaaggaatttggacatttacccttatacagtgtgcaatcatgaacaagactttactaatgatttagtgttaattatgtacagggatggaagatgttttcttggatgtcataaaagaacagaatcaaagacacactacagtgtttggagatactacgttatcacaggagtctgggcagctgtaataattgatgctctgagacaggtggtacacacacatatacatctctctcaatatgtatgctctgtatatgtgtttataaatatacatgtatctccaccacgttttggttagggtcaccatgtccattttgacctagatatcattcccaagttctgggcatatccagagtctgtcaggggctgggaagaagaggacttgtccctcatatggtttaatctggcttttcttggtcttcctctgaagaaatagtttaatttgtggataaccttgcagtcatggctgtcttagtgactagtgtgtcctagaatgaacagcagcccatttcattaatatcctaaaaatgtataaattcagaacactccattcatataaatcctgtggacatgtagaaagctagtgattctagtggagagagaggagaggggcttccaaagtagcagcataaacacattcacattaaatattaaggactcttgttcttaaaaggcacccgtccccttatggtccaggacggggttctgccagccatttgaccccacatggaagcgtagacttataatgtctcacaaccatgtctcttttcttcctgtttctcatctgtgaccatcatccggtgctcccagtgtgaacccagaaaagtccaaattctcacaccaatacaaagagcagagctgctgcttcttgtttctctaatgagctgcttccttgttcacatctcagtgctgacacatcaaggaccccaccagaagaaaagggctatttaaaagcaaacagatcaccaaacagccagactcactctcattagaaaaaagctgtgcttcgtttgttaaacaaagatcagtatcttcattctgtattcagcaagttatgaatgtttcacttattcagagcctacaatgtttcagtctctctgtcaggcacattttctcttttttgtgttactttattgactttcacaaccaactaattcttctgtaactaattctttttcatcttccagctttatggtttaaaaaatggtacaggctaaatagtttcaacagtcccatctcgcagggcctggtcctgggccgggttatacttccagggttttacttgtgtagatgtctacactgcacccacagccacacagtttggtggtgcacagggacagaaataaacatgcatggaaacctcagggattagtacttcaacttcaacccaggctgcacggagcatcaggtacttcggaagagacagaaatgagataggtcctaagttctaagactgagaactgagaggctctcagggcaagcagccttcaagtgaatgaggtaggtgatggtaggagtcatcctggaaccccgtttcaagtaggcactttcctacctgggagtggctgccttgagcctggggagagaggcaggtgaggagctgtcagtcaccaaccatcacaagacccacgtgggtgtcagaaggaaggtcctctcatgcccaggccctgtctcacagctggggcagagcccaggccaggataaaagggctcagggccagaccaccccatccactcacctcctgaggtgctaaagaaccctgtgctgcctgtgactccggtaagaacagagcagggatgctcagaacagagcaggagggaaggaggggcagggcctccggggctagggccatgttgtcagaggtggagagtttagaaaagactgaaggggcgggggccaaaaggggtctggcactaactgggagcaggaaggaaaagaggaaaagagctggcgggctgtgccatgtgcctttgaactctagaggaaacaaactgctctgggatgaggtgggtgttccagagtgggaactttgaagcacagagacctgctccactctggcagcccacaggagggaagcccacctctgaagatacaaccctgtctctgcctgcaagggaagaactggagctgtggacatgggactaaagactctttggggtttatgaaccccacattttcatgggtctgagatttgttcacaaacttcccagcttggttaggacacaccaagcctgagacccaccgtgtcatcccatcagcctgagcaggtggtgagtgaggaagtctgagctccaacctgagatcagggggtcagggttcaagtactagtctgcagaaactgctaagtttatctgtctctattgaagtgagtttactgacctagtagtctccaagatcctgcacaatgctgaccttccaaagtaaaatcgtcttgcaaattatgaccagagagaatgactgcttcttctcctttaaaaataattttctcttaaatgactcataaattagacaatttcagtcttaagatatatttgtaataatttcttcctccactgacaacacatcagaatcttagatgcattttgcaatattgtttagtcttagtttacagttgtctgacatccaaagatatcttgaaaaagatgatgtgagattttgaggaaattattggaaataaaactactgaagatgatgcttttaaacttgagaggtgctaagagtgtcacaggggcagaggtggcctctgcctgggtctgacttgttatttgactctccctcagctcctgaacacccaccaccgagatgtcctgccagcagagccagcagcagtgccagccccctcccaagtgcactcccaagtgcactcccaagtgccccgcccctaaatgtccccctaagtgccctccagtctcttcctgctgcagtgtcagctccggaggctgctgtggctccagctctgggggcggctgtggctccaactctgggggctgctgcagctctgggggtggtggctgctgcctgagccaccacaggcgccacaggtcccaccgtcgcagaccccagagctctgactgctgcagccagccctcggggggctccagctgctgcggtgggggcagcagccagcactctggaggctgctgctgaagtggaccttgacttcctcttccttctgattctgcctgaatagctgagaggttccagcaaaagcttgaagtcttgcctggagaatccctctgctctggtgtcaggaaacccaaaatctttctccttaatggcatttagagactttcttctgcagatccatggctgccctgggaactccaaagcacacacctacttcctccccagctcacgctactgtattctgtgctgcctgaactgaagaaataaaatccagaatctgctccccaatttgctaccagcctgcttgattttcctgtttgtgtcatccttgttctgctcccctgtgtctgctggtggctgctgaggccttggtggacagaggatggggaaggggtcaggaggaaaaagcttgcatttctgtgtgttttgtgttttttcttctttctgtgttttccttttaaaccaagggactgaaatagcattgagaaatatttttctttcaaattctggttcctttcacctatgtaaccgcatccctcaggcatggccaggaggccgacttcatcctccttctcactgtcacctcttcactcttgtgttcctcgttccccactccttccactaacaatctccccggactcctccttcagattgtatgtacacgtagtagacatataaatatatgtgtgtgtacatgtatatatatacacacatatttatatatactcacattatatggaataaatctttagtttttaaacttaaatcacttttattgatctataactttcacacaataaaacccctttttaaaataaacaattcaattagttttaccaaatgtatacactcttttgtaaccacaattgcaaggaacactctaaaaatgtagttgattatttattaatcattatttgcagtaaggtttaaaaataggctataagtttatggatttacttctggattttctatttttttttttggttcatacatctgtttttatgccagcactatactgttttggttagtataactttgtagtataatttgaaatcaggtagtatgatgcctccagctttattcttttttactcaggagcactttcgctatttggagtcttctatggttccataaaaatgttaagccttttttttctgttgtattagtcagggttctccagagggacagaactaataggatatatgtatatatgaaaggaagtttattagggagaattggctctcgtggtatttcaacagagattgcattgaacctgtagaccactttgaatactgtagactttttaacaatattaattcttccagttcatgagcctgagacatctttccatttgtttgtgtcttcttctatttcttcatcaatgcttttagctttcattgtagttctttcacttctttggttaaatttatttctggctattttatttttgtggctattataaatgagattgttttcttgatttctttttcagattgatttctataagtgtatagaaacactactgatttttgtatgttgattttgtatcctgccactttactaaatttgtcatttctaagagtttcttggtggagtctttagtttttctaaatctaatatcatgttatctgcaaaaaggataatttgacttcttcctttgaaatctggatgccacttatctcttttccttggctaattactccggttaggacttctaccatatgttgaattaaagtggtgaaagtgggcatccttgtcctatttcatacttagtagaaagcctctccatttttcttcattccgtatagtattaggtgtgggttttatcatgttgaggtatgttccttctacatgcaatgtcttgaaggtttttaaccaccaagagatgttgaattttattgaatgctttttcagcctctattgacaaaacttaagctagaccaagaaaaaaagagagaagccccagaaaaatgaaatcaggtaaaaaatgaaacataataacttgtatcacagcaatataaaggataattagagactgttatgaacaactgtacaccaacaaattggaaaacctggaaaaaaatagataaattactggacaacctactgagattgaaccataaagaaatagagaacctgaacagaccaataatgagtaatgagattaaagcagtaataaaaagtttcccatcaagaaaaagctccagacctgatagattccttactggagtctaccaaacatttaaagaagagctaattctgattctactcaaactatttcaaaaaactgaagaacaccaaatacttctaaactcattctacaaggccagaatcacactgataccaaaccaaacagacacaatagaaaaagaaaactacagaccaatatctctgatgaatatagatgcagaaatcctcaacaaaatactagcaaacagaattcaatactaccctgaaaagattattcaccatgatcaagtgggattcatcccagaaatgcaagaatggttcaacatatgcaaataaatagacataatgcatcacatcagcagaatcaaggattgtcttcttttttaaggctgaataatattccttctgctatatagtatatatattcagaatttttaaaattcattcatccactgacagaaatttaggttgtttccagatcttggttattgctaataatgccgaaataatgctgggagtacagatatctctggaaaatactgattttatttccagaagtggagttagcagatcatgaggtagttttattttctatacttttaggaaattccatacggttttacataatggctgtaccaatttatatttccaccaacagtgtacaagaattccctttttgccacatccttgccaacacgttatatttcatccttctgataatagccactttaacaggcatgaagcgatatctcattgtggttcagatttgcatttccctgatgattagtgagattgagaaactttttctgtatacctgttggacatttgtatgtctgagaaatagctattcagtcttttgctcgtttttaaattgggttgtttggttgttgccattcagttgtatgagttccttcatgtataattattaagagtttgtcaagatgagaaagcaaaacaagatcaccagtttccttggtgctggctctgatgcacagagataaaaatataactctgcttaaagtattatatttccagttagatctcaataatgtttccttccatcccatgttatgataaaatgttgatgatgtaaaagataaatgccttgaccctcagaaaagtcagtgctttgctgatcaacatgtctgtattgacctgatagctaggctgtgatttctcaaagccaagacttaatttccagtcttcctgatacaactatgttgctgactcatcacctacatctgagttacgtcagttgagggcttggggttgccctgcatgaaggcagaggcatggaccagatggcatcccagacccatcatcctagataccaggagttgaacttctgagtatacctgccattgtgacaacctgggaaccaatgtcctgaccactgccccattactaagccttttggaacaatctgagcaggagaacaaatgtcatacccaagaaagacggtgtcagacctctcaaggtgatgtggctcacacacctcactgagcctgtctcagagtgtgtctcctataaggatggcctgagtcataaggaatagctgtttataaactgtaaagtcaatgctgttaccaatgagaggatttaaaagtcattaaatatccattgtgtgcatagctctgtgttgaatattgaggtaaagaaatataaaacactcaaggcaggccatcaaataatttactattatctcattagagtgatatgccacaggaagggaaaaaaaaagtgggattgagccacgctgtcctggaagggcagagaccatggcttgcatcacagagagaagcataatcaaagtacaaaaaaataatccagttcagcttcaggtcatttctgagagtacatgacaaaggcttaaatgcgagggagcacacaaagtcttatttcactgcaggaatttggacatttacccttaaacagtgtgcagtcctgaacaagactttactaatgattgagtgttaattatttatggagatgagagagtcttttcctgaatctcacactggaacagtatcaaggaggcccttttatcctggtcttgggctgtgctcctgatgggtgaggcagcacctgggcataagaggaccttacaacatgggttgtatgaccaggtgataaccagcagcttctcacctgcctccctccacaggagatcagaatagctcccatcagtgccacctcatttttcttggagctgccttaggcctttttcttggagtttggcctcccaagtcctctttttctatatccctgatggtatcatttaaaccaaaattttacagaagtcttttaatgtccctgatgtgtcccagattctgtgtgtgtgtgtgtgtgtacgcatgtgtgtgtaaatacatgtctatgccatcacagttacaagcctggtaggagtcagacatatctgggacagaatcctggttctgtcacttattagctgtgtgacttctgaaaatcccaaattatctcatcctccgtttcctgaaatttaaaatgaagataataaagattagtctccaggatgtcgtgaggatcaatgaaattgtagaaagaaaatgcacattaaagttcctgtaacacagtgaaccctcatatgaaacacctgtctatcaataattttaaagggaatgaacactttttgagatggtccaagtctcgggcactatgtggagtgaaggaaaagagttccctagtggaggaggctggaagacctgaaaaaataggaggacttgaaatacaatgggaaacttttagtgttattgctttgtttcaacatgaacaaaagtttttgtctgaaggtctatttaaaaacatttttaggagattaagatttactaatgtcaatttggtatataacaggtgttccttttgtatcttgaggaaaatattatttaaaaagtaaaagaactaattagatgaaagcaaattagactagggagtaatcatgtgaaaaagttctcttttcaggaagtgtccaaaacaattctccagaacgtgtgatgaggtagaaatggccacaataataccaatatccaggtcataatgggtatagagaatcaatatctgagatatgtatatgaacataggcatagatagatatagaagtagattatatagatatggatatataatcggccttgttctattattacagtatcatatatctcaagatgcatggccttccctgaagttacaatgccttacttctctagggtttctccatgattctaattttcactggaatctgaaaatgatctttccacaccatcccgcactccagaaataattacccctgaccattaagaaaatctcatccagagctctgcactgtgttcaggatcaaggtcaatgtccattgagtgacattcaaggctctgtgcataagaccctgtacaattcctctaatttatgctttgctaagcaggactgcctattagctatactttgaagatgtctcttcctactttacctctatgttttattccaatatttttttttctctctgagacactgcagttcaaatctcacttgctccattttccttttttttttttttgacatacctcatgaatcaggttttaacaaaactttggacagcacaatttgtgacttatattgtgtagtccccatcagctactagtacaaggtcatggccacatgggtggttaaaactttttaaatcctgtcagcagcattagtgctggggtttcatggaaggtatgaatggtaagacttagaaaagaagttggaaacactttctgttaagtcttaaatgtaatacttaagaagcacatgcatttttctatagagagtcatgggcaagttgagaaatatggtacagggagtgtgttctggaataaagtgtagataatttaatgaagatggagaaggaagaaagcaacaagatttgatggaaggttaatagaaaagcaatttttacttgcaaatgtgcctggaactaaacttattgcagaagtagtcagtgggaaaactgtattttcaaaatatattcatgggttttgttcttttttatttcatttgtttacttattatatttttctttttttatccatttatatacatgcatgtgtgtgcatgtttgtgtgtgcacctggagatgtgcagaagtgtgtgtttttgcatgtgatgtgtgtgagggaggaaggatattggtggggctaggtcaggaggagcagactgcactcacagagaaagagaagcttggagagactggtcaagcccttgaaagggaccagaaacaaagaagctatgtttataagagacagttcagacttggtcagaagcaatgctgcttcaggccagttgacataggacagacagagttgggagcaatggtcccttcccactcctgcccccattaaccccaattcactccagagtgccccactgtcccctgaggttccaaggccaccaactgcagaggacaaggtgaagagaacaagagccactcaaggagaatagggtcctcatagaacaagacactgagcagattccttgttttagtcctttaatcagcagatgcacgctgcaaatgacattgagtaagctaggggcttagacagagcgtgggagggtagccacaaaggtgaggtccaaggccagtgaatggagatccaggagaggatctgagtttctggactccagggaaaagatatgctcttggcaagttcagagctttcccttggacctgtgagcctctcaggcaggcctagtaggagaagggggatgtccttggcagtttgcggtcctggattctgctcttctaggctcagggtccacttcagcagcagcctccagagtgctggccactccccccgccacagcagctggagccccccgagggctggctgcagcagccagagctctggggtctgtggcagtgggacctacggcgcctgtggtggctcaggcagcagccacctcccccagaactgcagcatcccccagagctggagccacagctgcccccagagctggagccacagcagcctccggagctgacactgcagcaggaagagacaggagggcacttagggggacactttgggggacactttggggtggggcacttgggagggcacttgggggtgcacttgggagggggctggcactgctgctggctctgctggcaggacatcttggtggcggattcaggagctgaaagagagtcaaacagcaagtcagacctaggcagaggccacccctgcctattcttgtcctttccacattgtttctatttcctttattttgatgaactgttcaaatgtcatggtaaatcattaatcactgaaaattttgttgtttcttgtagtttggcaaatgctctcacactgtatcttttgagttcacaatttcatcttaagacagtcaagaattactatatcttttacaaagaaggaaactgaggcagtaagccatatgaaaaaatatctgtcaagattaaacatttagtaaattaaaggaagcagtttttctcattgtgtcaaataaaaccctgaaactgtccagtgtggaaacctggggatataaacattttcttggaaaaagataatgaaggattatctcttggagtaacttcctaggagactttgtcttgtaaaaacctgcgcatgtacaattgtaaatggttttggagacaggctggtctcacaggctccctttgttaaggaagatgctggagaacagtatttttggtgcatagaggggatctgaactcaggtgccctggctctaggctggtgcactgccatattcatcacgcaacggcctcacagtaacatgttggcacagtgatcctcagcttgctatgtctaactactttaagagattctcaattccaatttgaatctagagataagtgagtttcaaaaagccctaaaagatccattaattatctctactccactgattgagaactactatctccagctcaaatttgcaaggagtgtcacagttttgctctgaaaagtaagtgtcctatttgaagttgttctagcagagtctatttgcctgggcttcaactccctctgtccttaaaactcaactagctgaagcacaaagacagagacatctaattcttatttgtgttaccagttggccctctccctgcctcctgagcacatcctccttcaatctttctgaggtcttgacttctatccagatggatctcagccctcaaggtcctgcccagcctcccctcctgcctagggctgagcaacactctgtggaagccccagcaactattctcaaagaacacttaccggggtcacaggcagcacagggtccttcagcacctcgggaggtgagtggatggagtgctcaggcccagagcccttttatcctggcctgggctctgcctccagctgtgagacagggcctgggcatgagaggacctgccttctgacacccacatgggttctgaggtgggtggtgactggcagctcctcacttgccttcctccatggggctcagaaaagctgctcccagcttggactatggccacttagaaatagaaatggagtgggaaaatccctaccatcatttcctgtgttgttctccgtggagaatacctaatctgtttagtcttggagcttgagttctctgttttgttaactcccaaatcttacctctgtggctctgggcaacctggcttaactcaagtttcatagaatcctccaaccctcaactatcttatagttgtgtgtgtgtgtgtgtgtgagtgtgagagagagagagagagtgtgtgtgtgtgtgtgtgtgtgtgtgtgcgtgtgcttctgtattaaagccattaggtaactggttaaagagtcagacatagagagaaacctgattctgccacttattacctgcatgaccttatgaaaagcattaatacctcatcgttcttgttctcagtttgtcaactctgtaatagagataatataaaaacaattgtccagggatggctgagagtcaatgaaataatgcaaaggaagtttctggtggagagcttataacatgtcattttctctaaacaaatgccaatgcattaatatttttaaattatagctgctttctaaggagagataatagcctccagctccatccatgtttcttcaaaggacatgatcttattcttttttatggctgcatactattccatggtatatgtgtaccacattttctttatctagtctaccattgatgggtatttgggttgattccatgtctttgctattgtgaatagtgctggagtgaacatacacattcatatgtcattatgatagaacaatttatattcatttggataacgctccttcttcaacatccaggctttattccgtgacctatgcatttctaaaacagtgccattcaactgtaacttctttatgagtcttaattttcaaatatgactacagtaaactatccttgattctgcagctttgttcttatatttatgtacccctcaacagtttctacaacagaggtggactccataggtaagcaatttaaaaatgaattgattactattagcatcatctttactttgtgtatgacttaagccatcatcattggaattctcactctgagacatttacattacagtatactagccttatcaccctgcagaagtctgccactgaattacctggctatggctcatgttgttccaaagaatgtatttaataatagagtagtcaagatattgattactcagcttacattggcagttctgatccagaagcccagcccattcattccaaggatgatgaggattagaagctattctgtccatgactctgataccacaaagggtagcacccaaactgtcaattaatctgacatggattgggttaataaggtagcaatatgatgtaacatcatgaggattgtttccttatgtttggtgttagatttcaatagcatttgaaatttattgaatttggtaccattttaatgctaacaatatgcactagcaaaggagtgattttctgaaaatacatttctatgttgtcaggctctcatatcacaagagattggtgggaagaatgctgagacacagtaaaaattaacttagacttagtggattttactctgtgtcccagagccagcaccacacatgactgatttttaatttgcttccttcctctgcaacccctgcatagagcagtaacaataaactgatactccaaaattattagaagaatatacagactatctaattatttctttataagtaattggataaaatatttaagcatgaaaaaacttgataaatctcatcacatagtgaaaggaatactatatgtcagaaagcacaattttaaaggatgaaaaatataaataaccagctgagaaaaagtaaagtatgtaagtcaggaatagtattaaaatctatgataaatagtaagtccttacaactttatagaaaagaaataagcctatctacaaatgaatgggcaaagtgcatgaacaaacagatagcttggaaagaaatacatgaccaatacattttgaaatttgttatttcatatttgcatatacaaataaccaaagactagtatataaaacaaggatggtctttcaaggatgaggtctgagtctgccactgaattgcctggctgtggctcatgttgttccaaacaatgtatttaatacgagagtagtgaagacattggttactcagcttacattagtagttctgatctagaagcacagcccgtccatttcaaggatgataaggattagaagatattcctttatattgaactagaagaaacttaaaatcaataacaaaacagtattactgaaggtgataggaaatggatcttataaattggcataataatgaaaattaagatgacatttggtgacccattactcaacaaataataattttctgtatacaaatcaaaattttaaatgtgcatactttttatccaacagttgtactttcaagaatttaacttaaggagaaaaaactttaagaaagaagatatatagacaagaatgattactatagaaattaaaataatattaagagttcgaaaagttgcaagatgtaagaataaatttacattaaccagcaacaaataattcaaaaatataatttttaaaattgccatttaaaatagcaaaaatacataaagtctaaaatacaattttaatgtaaaatatatttgataaaatgagaagactattaaacagcattacagaataccataataaagagatataccatatttatgggtgagtagaaaaaaattataataaaataaaataattcttcataaattaatgcatattctcaatgatgttttcatcaaaattctaataatgatttgttttgcttcatcttcattgtgtaggatgtgacaaactggctctaatgtttatataaaatgacaaaggtttaataatcaccaagacaatcttaaggaatgatgaaacctgtgtgatttagataccgcaattgattatacacctatggtaattaaggcagcaggatgttctcagaggtgttgacaaattggcaatgacaagaattgttcacccaattataaatctacggaaatgtgaaaaattgattctgacccataggtatttcagatgagtgggggaaaatggaaaatttgattacaatactaagacaattggttatccattcagaaaaatgtttaaaatatataaaatgtacaaaaattcctttcttgattgaataaaaaccttcatttttaaaaagaaaaaattttcaactttttaaagatagggaaaagatttctaaacttacaaatggttgagatttattaaaatcatgaaaattgcaaacaatatagttattgttgcagaaattcaactatgttaaaaataaaacactagttcatcaaatgacaccattaaaatgcaaacaagaacatatttgtttggaaaagatattcacaacacatttaatagcagtacattagtaactagaatatgtaaagaacatttacaaatactaacaaaaggagataaacaaattgaaaaacattttcgagaaaaagcagacaagtcacagaagggaaacctcaattaaccaaaaatacattaaaagatgctgtgatcactacaaagcagaggaacacatattaaactaccgacagataccagtgcacatccatcgaatggcaattattgaagtttaggaacaatgtgcagcaagaatgattcttatacaccataggtgcaaactgaaatcagtatgagcaatttggagagatgggtgtgatccaaaattcaacagttccacttataggtacataacttggtgagactctcccacaaatacacaagtagacacgcacaaaaatttccttagctgcaatattgattcagtgaaaagtgaaaacactctaaatgtctatccaaaagagagaagctaacaaatcatgatgcactcataagatggatactacaccgttgtaaaaatgagtaaactatggctatacagatcaacttgagtaactagcaaaaacaatgtttaaggaagagaacaagtcaaaaatgagtgtcttaagtatgatgccatttctatagagttaaaaccatgtaatccatagtgtatattgtatcagggtaacctgta
